United States Patent 11,596,699 (RNA ENCODING AN ANTIBODY) - sequence listing, part 10

SEQ ID NO: 54843 - RNA, 396 nt, Artificial Sequence
  derived and/or modified sequence opt11 from anti-HIV-1_HeavyChain
caaguccaacuccaacaauggggcgccggacuccucaaacccuccgaaacccucucccuaaccugcgccaucuacggcuccucauucuccggccacuacuggauguggauccgccaaucccccgccaaaacccucgaauggaucgccgaaaucaaccacaccggcggcacccgcuacaaccccucccucgccucccgaguacgcgucuucucagacacauccaaaaaccaauucucccucaacaugaccucccucaccgccgccgacaccggcaucuacuacugcguccgcggccaccucucccgcgaccgccucggccaauacgccuucugguccggcgcccucaucgacuaccucgaccccuggggccaaggcacccucgucacagucuccucc

SEQ ID NO: 54844 - RNA, 387 nt, Artificial Sequence
  derived and/or modified sequence opt11 from anti-HIV-1_HeavyChain
caaguccaacuccaccaauggggcgccggccuccucaaacccuccgaaacccucucccuaaccugcgccgucuacggcuccuucaccggcuuccaauggaccuggguccgccaaacccccggcaaaggccucgaauggaucggcgaaaucaaccacuccggccuccucgucaccggaaaaaccgacuacaacccaucccucgaaucccgcgucaccaucuccgucgacaccuccaaaaaccaauucucccucaaacucaccuccgucaccgccgcagacaccggagucuacuacugcgcccgcgccggcggcauguccgacugggccuaccccuacuacuacggcauggacgucuggggccaaggcaccauggucaccgucuccucc

SEQ ID NO: 54845 - RNA, 357 nt, Artificial Sequence
  derived and/or modified sequence opt11 from anti-HIV-1_HeavyChain
cagguccagcucguggaaucgggcgggggcgugguccagcccgggcgcucgcucacgcucucgugcgcgaccucgggcuuugacuuuagcucguacggguuccauugggugcgccaggccccgggcaagggccugcaaugggucucgaucauaagccaugacgggagcaucaaaaauuacggggacucgaugaagggcagauucucggucucgcgcgauaacgcgaaagauauauuguacuugcaaaugaacucgcucaggcccgaugacacggccuuguaccauugcgugcgcggggacggggaaaauggcgggaccgauuacuggggccugggaacgcucgugaccgugagcgcg

SEQ ID NO: 54846 - RNA, 357 nt, Artificial Sequence
  derived and/or modified sequence opt11 from anti-HIV-1_HeavyChain
caaguggacuuggucgagagcgggggcggggucgugcaaccgggcaagagcuugaaauugagcuguaccgcgagcggguucacguucacgagcuauggcaugcacugggucaggcaaauacccgggaaagggcucgaguggguggccauaaucucgcacgauggcacgaucaagaacuauggcgauagcgugaaagggcgcuuuaccauaagcagggacaaugccaugaacauacucuaucuacagaugaauaaccugcgcggggacgauaccgcgcucuauuacugugucaggggcgauggcgagaacgggggcacggacuauugggggcaagggaccguggucacggucucgagc

SEQ ID NO: 54847 - RNA, 369 nt, Artificial Sequence
  derived and/or modified sequence opt11 from anti-HIV_V3_HeavyChain
gaaguccaacucguccaauccggcgccgaagucaaaaaacccggcgaaucccucaaaaucuccugccaaggcuucggcuacaccuucuccaccuacuggaucggcuggguccgccaaaugcccggcaaaggccucgaauggcucggcaucaucuaccccgaagacucagaaaccaucuacucacccuccuuccaaggccaagccaccaucuccgccgacaaaucccucucaaccgccuaccuccaaugguccggccuccgcgccuccgacuccgccaucuacuacugcgcccgccucggcuacugcggcuccaccuccugcuccuucuucgacuucuggggccgcggcacccuagucaccgucucaucc

SEQ ID NO: 54848 - RNA, 369 nt, Artificial Sequence
  derived and/or modified sequence opt11 from anti-HIV_V3_HeavyChain
gagguccagcucgugcaaucgggcgcggaagugaccaagcccggggaaucgcucaagaucucgugcaagggcucgggcuauagcuuuagcacgcacuggaucgcgugggugcgccagaugccgggcaggggcuuggaauggaugggguucauauacccggacgauagcgauaccagguacucgcccucgcuccagggccaugucauaaucucggccgauaaaucgcucucgaccgcguacuugcaauggagcucacucaaggccucggacacggccauguacuauugcgcgcgcuugggcggggacgaguaccagagcucgggcgggauggaugucuggggccagggcacgaccgugaucgugagcucg

SEQ ID NO: 54849 - RNA, 393 nt, Artificial Sequence
  derived and/or modified sequence opt11 from anti-HIV_V3_HeavyChain
gaaguccaacucguccaauccggcgccgaagucaaaaaacccggcgccaccgucaaaaucuccugcaaagucuccggcuacacccucaccgacuacuacauccacuggguccaacaagccccaggccgcggccucgaauggcucggccucgucgaccccgaaaacggcgaaacccucuacgccgaaaaauuccaaggccgcgucacacucaccgccgacaccuccaccgacaccgccuacauggaacucaaaucccuccgauacgaagacaccgccgucuacuacugcgccaccgaaggcccccccuccuacuacgacuccggcaccuacgccaaaucccuccccgccuccuucgcaugcuggggccaaggcacccucgucaccgucucaucc

SEQ ID NO: 54850 - RNA, 369 nt, Artificial Sequence
  derived and/or modified sequence opt11 from anti-HIV_V3_HeavyChain
caaguccaacuccaagaauccggccccggccucgucaaacccuccgaaacccucucccucaccugcaccgucuccggcggcuccaucaacaacuacuacugguccuggauccgccaaccccccggcaaaggccucgaauacaucggcuacaucuucuacuccggcuccaccaacuacaaccccucccuaaaaucccgcgucaccuucuccgucgacaccuccaaaaaccaauucucccucaaacucaccuccgucaccgccaccgacaccgccgucuacuacugcgcccgcggcccccuccucuacuucggcgcaccccgcacccacuucgacuacuggggccaaggcgcccucgucaccgucuccucc

SEQ ID NO: 54851 - RNA, 372 nt, Artificial Sequence
  derived and/or modified sequence opt11 from anti-HIV_V3_HeavyChain
gagguccagcucgugcaaucgggcgcggaagugaaaaagcccggggaaucgcuaaagaucucgugcaagggcucgggcuauagcuuuagcucgcacuggaucgggugggugcgccagcucccgggcaagggcuuggaauggauggggaucauauacccggacgauagcgauaccaaguacaaucccucguuccagggccaggucacgaucucggccgaucgcucgaucucgaccgcguacuugcaauggagcucgcucaaggccucggacacggccauguacuauugcgcgcgcgugggcuaugacucguacggguacucgggcucgaacuuugacgagugggggcaagggaccuuggucacggucucgagc

SEQ ID NO: 54852 - RNA, 357 nt, Artificial Sequence
  derived and/or modified sequence opt11 from anti-HIV_V3_HeavyChain
gagguccagcucgugcaaucgggcgcggaagugaaaaagcccggggaaucgcucaagaucucgugcaagggcucgggcuauaacuuuaacucggacuggaucgggugggugcgccagaugccgggcaagggcuuggaaugggucgggaugauauacccggacgauuucgaggucaggcacucgccaccguuccagggcagggucacgaugucggucgauaaaucgaucucgaccgcguacuugcaauggagcucgcuaaagagcucggacacgggcauguacuuuugcgcgcgcuuggacgggaacgcggccgcguucgauuacuggggccagggcacgcaagugaccgugagcucg

SEQ ID NO: 54853 - RNA, 360 nt, Artificial Sequence
  derived and/or modified sequence opt11 from anti-HIV_V3_HeavyChain
gacgugcaauugguccagagcggggcagaggucaagaaagcgggcgagagcuugaaaauaagcugucgcccgagcggguacaauuucgcggacuauuggauaggcugggucaggcaaaugcccgggaaagggcucgaguggaugggcauaaucuuucccgaugacucggacacgcgcuauggcccgagcuuugaagggcaagugaccauaagcgcggacaagagcauaaacacggccuaucuccaguggaauagcuugaaagcgagcgauaccgcgauguauuucugugccaggcacgggggcucgggcgcggccccgggagauuacuggggccagggcacgcucgugaccgugagcucg

SEQ ID NO: 54854 - RNA, 363 nt, Artificial Sequence
  derived and/or modified sequence opt11 from anti-HIV_V3_HeavyChain
gagguccagcucgugcaaucgggcgcggaagugaaaaagcccggggccacagucaagauaucgugcaaggucucgggcuauaccuuuaccgauuacuuuaugcauugggugcaagaggccccgggcaagggcuuggccuggauggggcuaguggacccggaaaauggcgauaccguguacgcggaaaagcuccagggcagggucacgaugucggccgauaccucgcgagauaccgcguacauggaauugaccucgcucaggagcgaggacacggccguguacuauugcgcgaucgggaaaucggucgcgggcacgagcgcguacgauaucuggggccagggcacgauggugaccgugagcucg

SEQ ID NO: 54855 - RNA, 369 nt, Artificial Sequence
  derived and/or modified sequence opt11 from anti-HIV_V3_HeavyChain
caggugcaguuggugcagaguggggcggaggugaggaagccgggggcgagugugaaggugaguuguaaggcgaguggggauacguuuaauaaucaugauauaaauugggugaggcaggcgccggggcaggggccggagugggugggguggaugaauccgaagagugggaaugcgggguaugcgcagaaguuucaggggagggugacgaugacgagggauacgaguauaaguacggcguauauggaguugaggaguuugacgagugaggauacggggguguacuauugugcgagguugacgguggauugugaugaugggggguguuauggggauuauugggggcaggggacguuggugacggugaguagu

SEQ ID NO: 54856 - RNA, 354 nt, Artificial Sequence
  derived and/or modified sequence opt11 from anti-HIV_V3_HeavyChain
gaaguguacuugcaacagagcggggccgagcucaaggaaccgggcgcgaacgugaaaauaagcuguaaagcguucggguucauauucacggacuauuucauacacuggcucaggcaagcgcccgggaaagggccccagugggugggcguggucgaucccgaggacgggagcacgaccuaugccgaggccuuucaagggcgcgugagcauaaccgcggacaggagcacggacacggccuauauggaucucgcaggcuugaccucggacgauaccgcggucuauuacugugcccugauguggaacgagagcgggcccgauaacuggggccagggcacgcucgugaucgugagcucg

SEQ ID NO: 54857 - RNA, 393 nt, Artificial Sequence
  derived and/or modified sequence opt11 from anti-HIV_V3_HeavyChain
gaagugcaaguggucgaguucgggggcgagguaaagaaaccgggcgcgagcgugaaagugagcugugaagcgagcggguacacguucgcgaaauuugccauacacugggucagacaagcgcccaggcaagggcucgaguggaugggcuggaucaauggagaugacgggaaaacggaauauagccagaaauuucaagaucgcgugaccaugaccagggacacgagcgcgagcacggucuauauggagcucucgagcuugcgaucggaagauaccgcgcucuauuacugugccagggccauguacccagacacgguaacgggcaaugacaaucccgcgccaccgcccuuugaaggggacuauugggggcaagggaccuuggucacggucucgagc

SEQ ID NO: 54858 - RNA, 393 nt, Artificial Sequence
  derived and/or modified sequence opt11 from anti-HIV_V3_HeavyChain
gaagugcaauuggucgagagcggaggcgggcuagugaaaccgggcgggagcuugcgcuugaccugugucgcgagcggguucacguucucggacgugugguugaacuggguuaggcaagcgcccgggaaagggcuagagugggugggcagaaucaagagcaggacagauggcgggaccacggacuaugccgcgagcgugaaagggcgauuuaccauaagcagggacgauagcaagaacacgcucuaucuccagaugaauagcuugaaaacggaagauaccgcggucuauagcuguaccacggacggguucauaaugauacgcgggguaucggaagauuacuauuacuauuacauggacgugugggggaaagggaccacggucacggucucgagc

SEQ ID NO: 54859 - RNA, 387 nt, Artificial Sequence
  derived and/or modified sequence opt11 from anti-HIV_CD4bs_HeavyChain
gaggaacagcucguggaaucaggcgggggccuggucaagcccgggggcucgcaaaggcucucgugcgcggcaucggaauuuaccuuuagcagauacacgaugaauugggugcgccaggccccgggcaagggcuuggaaugggucucgagcauaagcgggaacgauaacaauaucuauuacgcggacucggucaagggcagguucacgaucucgcgcgauaacgcgcgaaauagcuuguacuugcaaauaaacucgcucagagucgaggacacggccguguacuauugcgcgcgcgggccccuggacucguacgauuucuggagcgggagcaggcacuauuacgggcucgaugucuggggacagggcacgaccgugaccgugagcuca

SEQ ID NO: 54860 - RNA, 372 nt, Artificial Sequence
  derived and/or modified sequence opt11 from anti-HIV_CD4bs_HeavyChain
caaguccaacucguccaaucaggcuccgaacucaaaaaacccggcgccuccgucaaagucuccugcaaagccuccggcuacaccuucaccucccacaucaucaacuggguccgccaagcccccggccaaggacucgaauggaugggcuggaucaacaccaacaccggcaaccccaccuacgcccaaggcuucaccggccgcuucgucuucucccucgacaccuccguauccauggccuaccuccaaaucucaucccucaaagccgaagacaccggcgucuacuacugcgcccgcggcuuccgccaauggcucgucgcccgcaucaccuacuucgacuacuggggccaaggcacccucgucaccgucuccucc

SEQ ID NO: 54861 - RNA, 369 nt, Artificial Sequence
  derived and/or modified sequence opt11 from anti-HIV_CD4bs_HeavyChain
gagcuaagacuccaggccucgggcccgggcuuggucaagcccucggaaacgcucucgcucgugugcucggucucgggcgugagcauaagcgauagcuauuggaauuggauacgccagcccgcgggcaagggcuuggaauggaucgggcgcguguacacgcgcgggacccauaccuauaacccgagcuuaggcgggcgcgcgaccgugagcggggacacgaacaagaacgaggucucgcucaagcucaugagcgugaccgcggccgauaccgcggucuauuacugugccagggccuugagcggggacuggaccaggcgcuauuucuauauggaugucuggggcaggggaacgcccgugaccgugagcucg

SEQ ID NO: 54862 - RNA, 381 nt, Artificial Sequence
  derived and/or modified sequence opt11 from anti-HIV_CD4bs_HeavyChain
caacuccaacuccaagaaucaggcccccgacucgucaaacccuccgaaacccucucacucaccugcacagucuccggcggcuccaucagcuccggcgacuacuacuggaccuggauccgccaaccccccggcgaaggccuagaauacaucggauacaucuacuccggcggcuccaccgacuacaacccaucccuaaaaucacgcgccuccaucucccaagacaccuccaccaacgaauucucacucaaacucacaucagucaccgccgccgacaccgccgucuacuucugcgcccgcgaccgacgcguccuccucugguucggcgaaccccgccgcggccucgacuucuggggccccggcacacucgucaccguauccuca

SEQ ID NO: 54863 - RNA, 396 nt, Artificial Sequence
  derived and/or modified sequence opt11 from anti-HIV_CD4bs_HeavyChain
gaagugcaauuggucgagagcgggggcgggcucgugaaaccgggcgggagcuugcgauugagcugugccgcgagcggguucacguucucgagcgcguggaugagcugggucaggcaagcgcccgggaaagggcucgagugggugggcaggaucaagagcaagagcgauggcgagaccacggacuaugccgcgcccgugaaagggcgcuucaccauaagcagggacaaucuagagagcacgcucuaucuccagcucaauagcuugaaaacggaagauaccgcagucuauuacugugccacggccacgcccucguacuaugacauaaugacgggcaauuacaaguacuauuacuauauggaugucuggggcaagggcacgaccgugaccgugagcucg

SEQ ID NO: 54864 - RNA, 363 nt, Artificial Sequence
  derived and/or modified sequence opt11 from anti-HIV_CD4bs_HeavyChain
caaguccaacucgucgaauccggcggcggccucgucaaacccggcggcucccuccgccucuccugcgccgccuccggcuucaucuuccgcgaccacuacaugaccuggauccgccaagcccccggcaaaggccucgaaugggucuccuacaucuccuccuccuccaacaacauccaauacgccgacuccgucaaaggccgcuucaccgucucccgcgacaacgccaaaaacucccucuaccuccaaaugaacucccuacgcgccgacgacaccgccgucuacuacugcgcccgcuccggccccuucuacaacuacggcccacccaacaacuggggccaaggcacccucgucaccgucucaucc

SEQ ID NO: 54865 - RNA, 378 nt, Artificial Sequence
  derived and/or modified sequence opt11 from anti-HIV_CD4bs_HeavyChain
caagugcaauuggucgagagcgggggcggggucgugcaaccgggcgggagcuugaccuugagcuguaccgcgagcggguucccguucaauagcuaugccaugcacugggucaggcaagcgcccgggaaagggcucgagugggugagcaugaccucgcacgauggcgggaacaaggacuuugucgacagcgugaaagggcgcuuuaccauaagcagggacaauagcaggaacacgcucuuucuccagaugaauagcuugagccaggacgauaccggggucuauuacugugucaggggcaagcucgaggacuauaacuuuugggggcacuaucgcgauuucgauagcuggggccagggcacgcucgugaccgugagcgcg

SEQ ID NO: 54866 - RNA, 405 nt, Artificial Sequence
  derived and/or modified sequence opt11 from anti-HIV_CD4bs_HeavyChain
gaaccgcacguggucgagagcgggggcgggauggcgaaaccgggcgggagcuugcgcuugagcugugccgggagcggguucacguucacgaacgcguggaugaacugggucagacaagcgcccgggaaagggcucgagugggugggcuugaucaagagcaagagcgauggagggaccacggacuaugccgcggacguggaagggcgcuuuacaauaagcagggacgaucucgagagcacgauguuucucgagaugcauagcuugcaaauagaagauaccgcggucuauuucuguaccacgcaauauccaagguacuaugacuugaugacgggcaauuacaagcgcagguacuuuagcucgggcauggacgugugggggcaagggaccgcggucacggucucgagc

SEQ ID NO: 54867 - RNA, 384 nt, Artificial Sequence
  derived and/or modified sequence opt11 from anti-HIV_CD4bs_HeavyChain
caaguccaacuccaagaauccggccccggccucgucaaaccaucccaaacccucucccucaccugcaccgucuccggcgacuccgucuccuccggcaacuacuacugguccuggauccgacaacccgccggcaaaccccucgaauggaucggccacaucuccaccggcggcggcaccaaaaacaaccccucccuccaaucccgcgucaccaucucccucgacuccuccaaaaaccaagucucccuaucccucuccuccgucaccgccgccgacaccgccgucuacaccugcgcccgcggccccccccgcucccucugguucggcgaccccaccuacuccuacauggacgucuggggcaaaggcaccaccgucaccgucuccucc

SEQ ID NO: 54868 - RNA, 372 nt, Artificial Sequence
  derived and/or modified sequence opt11 from anti-HIV_CD4bs_HeavyChain
caagugcaauugguccagagcggggccgaggucaagaaaccgggcucgagcgugaaagugagcuguaaagcgagcgggggcacguucaauagccaugccuuuaccugggucagacaagcgcccgggcaagggcuagaguggaugggcgggaucauacccacgcucgggcucgcgaacgaugcccagaaauuucaaggacgcuuuaccauaaccgcggacgagagcacgaccacggucuauauggagcucucgagcuugcgcucggaagauaccgcggucuauuacugugccaggcgcccguacuaugaccagguaucgggcgugggcgcguucgauaucuggggccagggcacgcgcgugaccgugagcucg

SEQ ID NO: 54869 - RNA, 390 nt, Artificial Sequence
  derived and/or modified sequence opt11 from anti-HIV_V2_HeavyChain
caagugcaauugguccagagcggggccgaggucaagaaaccgggcucgagcgugaaagugagcugugaagcgagcggggucacgagcucgagcuauaccauaagcugggucaggcuagcgcccgggcaagggcucgaguggaugggcaggaucacgcccauauucgauaucacgaacuaugcccagaaauuucaagggcgcgugaccuugaccgcggacaagagcacgggcacgaccuauauggagcuaucgagcuugcgcucggacgauaccgcggucuauuacugugccagggacaagagcgaugucguggucgugaccucgaucaggccagcguacuauuacgggauggaugucuggggccagggcacgaccgugaccgugagcucg

SEQ ID NO: 54870 - RNA, 366 nt, Artificial Sequence
  derived and/or modified sequence opt11 from anti-HIV_V2_HeavyChain
caagugcaacugguccagagcggggccgaggucaagaaaccgggcucgagcgugaaagugagcuguaaagcgagcgggggcacguucaggagcuaugccauaagcugggucagacaagcgcccgggcaagggcucgaguggaugggcgggaucauacccauauucgggaccgcggacuaugcccagaaauuucaagggaaagugaccauaaccgcggacgagagcacgagcacggccuauauggagcucucgagccugaccucggaagauaccgcgauguauuacugugccaggagcagagaccauuucuuugacacgcgaguguuccagggcuggggccagggcacgcucgugaccgugagcucg

SEQ ID NO: 54871 - RNA, 363 nt, Artificial Sequence
  derived and/or modified sequence opt11 from anti-HIV_V2_HeavyChain
cagguccagcucgugcaaucgggcgcggaagugaaaaagcccgggagcucggucaaggucucgugcaaggccucgggcgggaacuuuaacacguacacgaucucgugggugcgccaggccccgggccagggcuuggaauggaugggacgcauaaucccgaucuuuggcauagucaaucccgcgcaaaaguucccgggcagggucacgaucaaugucgauaaaucgaccaauaccgcguacauggaauugagcucgcucaggagcgaggacacggccguguacuauugcgcgaccucgggcgugggcuugcacuuuggcuauuucgauuacuggggccagggcacgcaagugaccgugagcucg

SEQ ID NO: 54872 - RNA, 378 nt, Artificial Sequence
  derived and/or modified sequence opt11 from anti-HIV_V2_HeavyChain
caaguccaacuccaacaauggggccccggccuccucaaacccuccgaaacccucucccuaaccugcgccgucuacggcggcuccuucggccgcuacuacugguccuggauccgccaauccuccggcgaaggccucgaauggcucggccaaaucgaccacaccggcuccaccaccuacaaccccucccucaaaggccgcgucaccaucuccaucgacucauccaccaaccaauucucccucaaagucaccuccgucaucgccgccgacaccgccgucuacuacugcgcccgcgcccccuccggcuaccccggcguaucccucuaccaauacuacggccucgacgucuggggccaaggcaccaccgucaccgucuccccc

SEQ ID NO: 54873 - RNA, 366 nt, Artificial Sequence
  derived and/or modified sequence opt11 from anti-HIV_V2_HeavyChain
caagugcaauugguccagagcggggccgaggucaagaaaccgggcucgagcgugaaagugagcuguaaagcgagcgggggcacguucucgaacuaugccauaagcugggucaggcaagcgcccgggcaagggcucgaguggaugggcgggaucauacccauauucgggaccacggacuaugcccagaaauuucaagggcgcgugaccauaaccgcggacgcgagcacgagcacggccuauauggagcuaucgagcuugcgcucggacgauaccgcggucuauuacugugccaggagcaggggccauuacuuugacacgcgcguguucgagggcuggggccagggcacgcucgugaccgugagcucg

SEQ ID NO: 54874 - RNA, 372 nt, Artificial Sequence
  derived and/or modified sequence opt11 from anti-HIV_V2_HeavyChain
caaguccaccucguccaauccggcaccgaagucaaaaaacccggcgccuccgucaccgucuccugcaaagccuccggcuacuccuucaccggcuacuaccuccacuggguccgccaagcccccggccaaggccucgaauggaugggcuggaucaaccccaacuccggcggcaccuacuacgcccaaaacuuccaagcccgcgucaccaugacccgcgacaccuccaucuccaccgucuacauggaccucucccgccuccgcuccgacgacaccgcagucuacuacugcguccgccgcgccguccucaccgcccucccaccccgcuacuacuucgacuucuggggccaaggcacccucgucaccgucuccuca

SEQ ID NO: 54875 - RNA, 318 nt, Artificial Sequence
  derived and/or modified sequence opt11 from anti-HIV_V3_LightChain
ucccucgaacucacccaaccccccuccgucuccgucuccccaggccaaaccgucuccaucaccugcuccggcaaccuccucggcgacaaagacgccuccugguaccaacucaaacccggccaaucacccauccucgucaucuaccuagacaccgaacgccccuccggcauccccgaacgcuucuccggcuccaaauccggcaacaccgccacccucaccaucuccggcacccaagccauggacgaagccgaauacuucugccaagccugggacaccaccaccguccucuucggcggcggcacccgccucaccguccuc

SEQ ID NO: 54876 - RNA, 324 nt, Artificial Sequence
  derived and/or modified sequence opt11 from anti-HIV_V3_LightChain
agcgaugaauugacccagcccccgagcgugagcgugagcccgggccagaccgcgcgcauaaccuguagcggggacgcgcucccggaaaaguacgcguacugguaccagcaaaagagcgggcaagcgcccgugcucgugaucgaugaagauaacaagcgcccguucgggaccccggaaagguucucgggcucgcgcucaggcacgauggcgaccuugaccauaaccggggcccagauggaggacgaggccgauuacuauugcucaagcacggacucgcgcgggaccuauuggguguucgggggcgggaccaagcucacggucuua

SEQ ID NO: 54877 - RNA, 336 nt, Artificial Sequence
  derived and/or modified sequence opt11 from anti-HIV_V3_LightChain
caauccguccucacccaaccccccucagucuccgccgcccccggccaaaaagucaccaucuccugcuccgccggcaacuccaaaaucggcgacaacuacaucuccugguaccaacacguccccggcgccgcccccaaacuccucaucuacgaaaacgacaaacgccccuccggcauccccgaccgcuucuccggcuccaaauccggcaccuccgccucccucggcaucaccggccuccaaaccggcgacgaagccgacuacuacugcgccgccugggacaacucccucuccuccgcccucuacgucuucggcaccggcaccaaagucaccguccuc

SEQ ID NO: 54878 - RNA, 339 nt, Artificial Sequence
  derived and/or modified sequence opt11 from anti-HIV_V3_LightChain
gacaucgucaugacccaaucccccgacucccucgccgucucccucggcgaacgcgccaccaucaacugcaaauccucccaaaacgucuucuacuccuccaacaaccgcaacuaccuagccugguaccaacaacgccccggccaaccccccaaacuccucuucuacugggccuccacccgcgaauccggcguccccgaccgcuucuccggcuccggcuccggcaccgacuucacccucaccaucuccucccuccaaaccgaagacgucgccaucuacuacugccaacaauacuacaacaccccccccaccuucggccccggcaccaaagucgaaaucaaa

SEQ ID NO: 54879 - RNA, 318 nt, Artificial Sequence
  derived and/or modified sequence opt11 from anti-HIV_V3_LightChain
uccuacgaacucacccaaccccccuccgucuccgucucccccggccaaaccgccaccaucaccugcuccggcgaccuccucggcgacaaauacgccuccugguaccgccaaaaacccggccaaucccccguccucgucaucuacgaagacaccaaacgccccuccggccuacccgaacgcuucuccggcuccaacuccggcaacaccgccacccucaccaucuccgaaacccaagccauggacgaagccgacuacuacugccaagccugggacacccgcaccgucgucuucggcggcggcaccaaacucaccguccuc

SEQ ID NO: 54880 - RNA, 327 nt, Artificial Sequence
  derived and/or modified sequence opt11 from anti-HIV_V3_LightChain
caaucaguccugacccaacccccaagcguaagcgcagccccaggccaaaaaguaaccauaagcugcagcggacgcucaagcgacaucgaaaacaaauucguaagcugguaccaacaacuacccggaaccgcacccaaacuccuaaucuacgaagacaacaaacgcccaagcggaauccccgacagauucucaggcucaaaaucaggcacaagcgcaacccuaggcauaaccggacuccaaaccggagacgaagccgacuacuacugcggaaccugggacaacaaccuacgcgcaggcuucggcggaggcacacaccuaaccguacuc

SEQ ID NO: 54881 - RNA, 324 nt, Artificial Sequence
  derived and/or modified sequence opt11 from anti-HIV_V3_LightChain
agcuacgaacuaacccaaccccccuccgucuccgucagccccggccaaaccgcccgcaucaccugcagcggcgacgcccuccccaacaaauacgcauucugguaccaacaaaaaagcggccaagcccccguccucgucaucuucgacgacaacagacgccccgccggcauccccgaaagauucuccggcucacgcuccggcacccucgccacccuaaccaucuccggcgcccaagucgaagacgaagccgacuacuacugcuacagcaccgacaacgacggcaaauacuucgucuucggcuccggcaccauggucacaguccua

SEQ ID NO: 54882 - RNA, 318 nt, Artificial Sequence
  derived and/or modified sequence opt11 from anti-HIV_V3_LightChain
uccuacgaacucacccaaccccccuccgucuccgucucccccggccaaaccgccuccaucaccugcuccggccacaaacucggcgacaaauacgccucaugguaccaacacaaacccggccaaucccccguccucgucaucuacgaagacacccaacgccccuccggaauccccgaacgcaucuccggcuccaaauccggcaacacagccacccucaccaucuccggcacccaagccauggacgaagccgacuacuacugccaagccugggacucccgcgccgccgucuucggcggcggcacccgccucaccguccuc

SEQ ID NO: 54883 - RNA, 327 nt, Artificial Sequence
  derived and/or modified sequence opt11 from anti-HIV_V3_LightChain
caauccgcccucacccaacccgccuccgucuccggcucccccggccaauccaucaccaucuccugcaccggcaucuccuccgacaucggcaccgacaacuacgucuccugguaccaacaacaccccggcaaagcccccaaacucaucaucuacgaagucuccaaccgccccuccggcaucucccaccgcuucuccggcuccaaauccggcaacaccgccucccucaucaucuccggccuccaagucgaagacgaagcccacuacuacugcaacuccuaccgcuccgacacccucgucuucggcggcggcaccaaagucaccguccuc

SEQ ID NO: 54884 - RNA, 333 nt, Artificial Sequence
  derived and/or modified sequence opt11 from anti-HIV_V3_LightChain
caauccguccucacccaaccccccuccgccuccggcacccccggccaacgcgucaccaucuccugcuccggcuccuccuccaacaucggcuccaacaccgucaacugguaccaacaccuccccggcaccgcccccaaacuccucaucuacuccaacgaccaacgccccuccggcguccccgaccgcuucuccggcuccuccuccggcaccuccgccucccucgccaucuccggccuccaauccgaagacgaagccgacuacuacugcgccgccugggacgacucccucaacggccccuucgucuucggcaccggcaccaaagucaccguccuc

SEQ ID NO: 54885 - RNA, 318 nt, Artificial Sequence
  derived and/or modified sequence opt11 from anti-HIV_V3_LightChain
gacauccaaaugacacaaucccccuccucccucuccgccuccgucggcgaccgcaucaccaucaccugccgcaccucccaauccaucgacaaccaccucaacugguaccaacacaaacccggcaaagcccccaaacuccucaucuccgccgccucccgccuccaauccggcguccccucccgauucaccggcuccggcuccggcaccgaauucacccucaccaucuccucccuccaacccgaagacuucgccgucuacuacugccaacaaucauacaucaccaucaccuucggccccggcaccaaagucgacaucaaa

SEQ ID NO: 54886 - RNA, 321 nt, Artificial Sequence
  derived and/or modified sequence opt11 from anti-HIV_V3_LightChain
gaaaucgucaugacccaaucccccgccacccucuccgucucccccggcgaaggcgucacccucuccugccgagccucccaauccgucuccucaaacauccucugguaccaacaacgccccggccaagccccccgccuccuccucuacggcgccuccacccgcgccaccggcauccccgcccgauucuccggcuccggcuccggcaccgaauucacccucaccaucaacuccaugcaauccgaagacuucgccaucuacuacugccaacaauaccacgacuggcuauggacccuaggccaaggcacccaagucgaaaucaaa

SEQ ID NO: 54887 - RNA, 327 nt, Artificial Sequence
  derived and/or modified sequence opt11 from anti-HIV_V3_LightChain
uccuacgaacucacccaaccccccuccgucuccgucucccccggccaaaccgccuccaucaccugcuccggcgacaaaaugggcgaacgcuacaccuccugguaccaacaaaaacccggccaaucccccguccucgucauguccgaaaacaucaaacgccccgccggcauccccgaacgcuucuccggcuccuccuccggcaacaccgccauccucaccaucuccggcacccaagccgucgacgaagccgacuacuacugccaagucugggacaccaccaccaccuccuacgucaucuucggcggcggcaccaaacucaccguccuc

SEQ ID NO: 54888 - RNA, 321 nt, Artificial Sequence
  derived and/or modified sequence opt11 from anti-HIV_V3_LightChain
gacauccaaaugacccaaucccccuccucccucuccgccuccgucggcgaccgcgucaccaucaccugccaagccucccaagacaucggcaacuaccucaacugguaccaccaaaaacccggcaaagcccccaaacuccucaucuacgacgccuccaacgucgaaaccggcgucgccucccgcuucuccggcuccggcuccggcaccgacuucacccucaccaucuccucccuccaacccgaagacaucggcaccuacuucugccaacaauacgaaucccuccccugggccuucggcggcggcaccaaagucgaaauccgc

SEQ ID NO: 54889 - RNA, 333 nt, Artificial Sequence
  derived and/or modified sequence opt11 from anti-HIV_V3_LightChain
aacuucaaacucacccaaccccacuccgucuccgaaucccccggcaaaaccgucaccaucuccugcacccgcaccuccggcaccaucgccaccaacuacguccaaugguuccaacaacgccccggcuccucccccaccaccaugaucuacgaaaacgacaaacgccccuccggcguccccgaccgcuucucaggcuccaucgacaccuccuccaacuccgccucccucaccaucuccggccucaaaaccgaagacgaagccgacuacuacugccaauccuacaacuccaccgacaucgucgucuucggcggcggcaccaaacucaccguccuc

SEQ ID NO: 54890 - RNA, 327 nt, Artificial Sequence
  derived and/or modified sequence opt11 from anti-HIV_V3_LightChain
caaucaguccucacccaaccccccuccgucuccgccgcccccggccaaaaagucaccaucuccugcuccggcuccuccuccaacaucggcaacaacauggucuccugguaccaacaacaccccggcaccgcccccaaacuccucaucuacgaaaacuccaaacgccccuccggcauccccgaccgcuucuccggcucccgcuccggcaccuccgccacccucggcaucaucggccuccaaaccggcgacgaagccgaauacuacugcgccaccugggacggcucccuccgcaccgucuucggcggcggcacaaaacucaccguccuc

SEQ ID NO: 54891 - RNA, 324 nt, Artificial Sequence
  derived and/or modified sequence opt11 from anti-HIV_V3_LightChain
agcuaugaauugacccagcccccgagcgugagcgugagcccgggccagaccgcgcgcauaaccuguagcggggacgcgcucccgaaccaguacggguacugguaccagcaaaagcccgggcaagcgcccgugcucgugaucuuuaaagauagcgagcgcccgagcgggaucccggaaagguucucgggcucgagcucgggcacgaccgugaccuugaccauaagcgggguccaggccgaggacgaggccgauuacuauugccagagcgcggacucgagcgggaacuaugaaguguucgggggcgggaccaagcucacggucuug

SEQ ID NO: 54892 - RNA, 330 nt, Artificial Sequence
  derived and/or modified sequence opt11 from anti-HIV_V3_LightChain
caauccguccucacccaaccccccuccgucuccgaagccccccgccaacgcgucaccaucuccugcuccggcuccuccuccaacaucggcaacaacgccgucaacugguaccaacaaguccccggcaaagcccccaaacuccucaucuacuacgacgaccuccuccccuccggcgucuccgaccgcuucuccggcuccaaauccggcuccuccgccucccucgccaucuccggccuccaauccgaagacgaagccgacuacuacugcgccgccugggacgacucccucaaagucuacgucuucggcaccggcaccuccgucaccguccuc

SEQ ID NO: 54893 - RNA, 333 nt, Artificial Sequence
  derived and/or modified sequence opt11 from anti-HIV_V3_LightChain
gacaucgucaugaaccaauccccccccucccucgccgucacccccggcgaacccgccuccaucuccugccgcgccucccaaucccuccucuacuccgacggccacaacuaccucgacugguaccuccaaaaacccggccaagccccccaacuccucaucuaccucggcuccacccgcgccuccggcguccccgaccgcuucucaggcuccggcuccggcaccgacuucacccucaaaaucucccgcgucgaagccgaagacgucggcgucuacuacugcaugcaaccccuccaauccuacaccuucggccaaggcaccaaacucgaaaucaaa

SEQ ID NO: 54894 - RNA, 321 nt, Artificial Sequence
  derived and/or modified sequence opt11 from anti-HIV_V3_LightChain
gccuacgaacucacccaaccccccuccgucuccguaucccccggccaaacagcccgcaucaccugcuccggcgacgcccuccccaaccaauacgcauacugguaccaccaacgacccggccaagcccccguccucgucauccacaaagacaccgaacgccccuccggcauccccgcccgcuucuccggcuccuccuccggcaccaccguaacccucaccaucuccgaaguccaagccgaagacgaaggcgacuacuacugccaauccgccgacaccuccgccuacgucgucuucggcggcggcacaaaacucaccguccuc

SEQ ID NO: 54895 - RNA, 330 nt, Artificial Sequence
  derived and/or modified sequence opt11 from anti-HIV_V3_LightChain
caauccguccucacccaagcccccuccuccuccggcacccccggccaauccgucaccaucuccugcuccggcuccuccuccaacauggaaaucaacuacgucuacugguaccgccaauuccccggcaccgccccccaacuccucaucuacaacgacaaccaacgccccuccggcguccccgaccgcuucuccgccuccaaaucaggcaccuccgccucccucgccaucggcggccuccgcuccgaagacgaagccgacuacuucugcgccgucuggcacggcgaccgcggcggccccgucuucggcggcggcaccaaacuaaccguccuc

SEQ ID NO: 54896 - RNA, 327 nt, Artificial Sequence
  derived and/or modified sequence opt11 from anti-HIV_V3_LightChain
uccuacgaacucaaacaaccccgcuccgucuccgucucccccggccaaaccgcccgcaucacaugcuccggcgacgccaugcccaaccaauacgcauacugguaccaacaacgccccggccgcgcccccguccuccucaucuucaaagacaacgaacgcgccuccggcauccccgaacgcaucuccggcuccuccucaggcaccaccgccacccucaccaucaaccgcguccaagccgaagacgaagccgacuaccucugccaauccgccgacuccuccggcgccuuccccugggucuucggcggcggcaccacccucaccguccuc

SEQ ID NO: 54897 - RNA, 324 nt, Artificial Sequence
  derived and/or modified sequence opt11 from anti-HIV_V3_LightChain
agcuacgaacuaacccagcccccgagcguaagcguaagcccgggccagaccgcacgcauaaccugcagcggagacgcacucccgaaagaauacgcauacugguaccagcagaaaagcggacaagcacccguacucguaaucuacgaagacaccagacgcccgagcggaaucccggaaagguucucgggcucaagcucaggcacaauggcgacccugaccguaagcggggcccacgucgacgacgaagccgacuacuacugcuacagcagagacacaagcgcaaaccaauggguauucggaggcggaaccaaacucacaguccug

SEQ ID NO: 54898 - RNA, 318 nt, Artificial Sequence
  derived and/or modified sequence opt11 from anti-HIV_V3_LightChain
gaaaucguccucacccaaucacccgccacccucucccucucccccggcgaacgcgccacccucuccugccgcgccucccaauccaucuccaccuaccucggcugguaccaacaaaaacccggccaagccccccgccuccucaucuacgacgccuccaaccgcgccaccggcauccccgcccgcuucuccggcuccggcuccggcaccgacuucacccucaccaucuccucccucgaacccgaagacuucgccgucuacuacugccaacaacgauacaccuggaucaccuucggccaaggcacccgccucgaaaucaaa

SEQ ID NO: 54899 - RNA, 327 nt, Artificial Sequence
  derived and/or modified sequence opt11 from anti-HIV_V3_LightChain
uccuacgaacucacccaaccccccuccgucuccgucucccccggccaaaccgcccgcaucaccugcuccggcgacgcccuccccaaccaauacgucuacugguaccaacaacgacccggccaagcccccgucgucguccucuacaaagacaccgaacgccccuccggcauccccgaacgcuucuccggcuccuccuccggcaccaccgucacccucaccaucuccggcguccaagccgaagacgaagccgacuacuacugccaauccgccgacaacuccggcgccuacccccucuucuucggcggcggcaccaaacucaccguccuc

SEQ ID NO: 54900 - RNA, 333 nt, Artificial Sequence
  derived and/or modified sequence opt11 from anti-HIV_V3_LightChain
caauccguccucacccaaccccccuccgucuccgccgcccccggccaaaaagucaccaucuccugcuccggcuccucauccaacaucggcaacaacuacguccucugguaccaacaauuccccggcaccgcccccaaacuccucaucuacggcaacaacaaacgccccuccggcauccccgaccgauucuccggcuccaaauccggcaccuccgccacccucggcaucaccggccuccaaaccggcgacgaagccgacuacuucugcgccaccugggacuccggccucuccgccgacugggucuucggcggcggcaccaaacucaccguccuc

SEQ ID NO: 54901 - RNA, 321 nt, Artificial Sequence
  derived and/or modified sequence opt11 from anti-HIV_V3_LightChain
gacauccaaaugacccaaucccccuccucccucuccgccuccgucggcgaccgcgucaccaucaccugccgcgccucccaagaaaucgacaacuaccucgccugguaccaacaacgccccggcaaagcccccaaaucccucaucuacgccgccuccucccuccaaggcggcgucccccccaaauucuccggcuccggcuccggcaccgaauucacccucaccaucuccucccuccaagccgaagacuucgccaccuacuacugccaacaauacaacgccuacccccucaccuucggccaaggcacccgccucgacaucaac

SEQ ID NO: 54902 - RNA, 324 nt, Artificial Sequence
  derived and/or modified sequence opt11 from anti-HIV_V3_LightChain
uccuacgaacucacccaaccccccucccucuccgucucccccggccaaaccgccuccaucaccugcuccggcgacggccuccccaaacaauacggcuacugguaccaacaaaaacccggccaagccccccuccucgucauccucaaagacaccgaacgccccuccggcauccccgaacgcuucuccggcuccuccuccggcaccaccgucacccucaccaucuccggcguccaagccgaagacgaagccgacuacuacugccaauccgucgacuccaccggcuccuacuacgucuucggccccggaaccaaagucaccguccuc

SEQ ID NO: 54903 - RNA, 324 nt, Artificial Sequence
  derived and/or modified sequence opt11 from anti-HIV_V3_LightChain
uccuacgaacucacccaaccccccuccgucuccgucuccccaggccaaaccgcccgcaucaccugcuccggcgacguccuccccaaaaaauacgccuacugguaccaacaaaaauccggccucgcccccguccucgucaucuacgaagacaaccgccgccccuccggcauccccgaacgcuucuccggcuccuccuccggcaccauggccacccucaccaucuccggcgcccaagucgaagacgaaggcgacuacuacugcuccuccaccgacuccuccggcgaccacuacgucuucggcaccggcaccaaagucaccguccua

SEQ ID NO: 54904 - RNA, 321 nt, Artificial Sequence
  derived and/or modified sequence opt11 from anti-HIV_V3_LightChain
gccuacgaacucacccaaccccccuccgucuccgucucacccggccaaaccgcccgcaucaccugcuccgccgaagcccucuccaaccaauacgccuacugguaccgccaacgccccggccaagccccccuccucaucaucuacaaagacaccaaacgccccuccggcauccccgaacgcuucuccggcuccaccuccggcaccaccgucacccucaccaucuccggcguccaagccgaagacgaagccgacuacuacugccaauccgccgacuccuccggcgacuacgucuucggcggcggcaccaaagucaccguccuc

SEQ ID NO: 54905 - RNA, 333 nt, Artificial Sequence
  derived and/or modified sequence opt11 from anti-HIV_CD4bs_LightChain
caacccguccucacccaauccuccuccgccuccgccucccucggcuccuccgucaaacucaccugcacccucggcuccggccacuccggauccaucaucgccuggcaccaacaacaacccggcaaagccccccgcuaccuaaugaaaguccaaucauccggcuccuacaacaaaggcuccggcguccccgaccgcuucuccggcuccuccuccggagccgaccgcuaccucaccaucuccaaccuacaauucgaagacgaaggcgacuacuacugcgaaaccugggacaccaacaaauacgucuucggcaccggcaccaaagucaccguccuc

SEQ ID NO: 54906 - RNA, 324 nt, Artificial Sequence
  derived and/or modified sequence opt11 from anti-HIV_CD4bs_LightChain
gaacucguccucacccaaucccccggcacccucucccucucccccggcgaacgcgccacccucuccugccgcgccucccaauccgucgccuccuacuaccucgccugguaccaacaaaaacccggccaagccccccgccuccucaucuacggcgccuccucccgcgccaccggcauccccgaccgcuucuccggcuccgucuccggcaccgacuucacccucaccaucucccgccucgaacccgaagacuucgcccucuacuacugccaacaauacggcuccuccccccucuccuucggcggcggcaccaaagucgaaauccgc

SEQ ID NO: 54907 - RNA, 333 nt, Artificial Sequence
  derived and/or modified sequence opt11 from anti-HIV_CD4bs_LightChain
caauccgcacucacccaaccccccuccauguccggcucacccggccaauccaucaccaucuccugcaccggcuccggcuccgacgucggcucccacaacuucgucuccugguaccaacaacaccccgcccgcguccccaaacuccucaucuacgccgucggcaaccgccccuccggcgucuccgaacgcuucuccggcuccaaauccggcaacaccgccuaccucaccaucuccggccuccaagccgacgacgaagccgacuacuacugcuccucccacaccaccggcaccacccucgaagucuucggcggcggcacccgccucaccguccuc

SEQ ID NO: 54908 - RNA, 333 nt, Artificial Sequence
  derived and/or modified sequence opt11 from anti-HIV_CD4bs_LightChain
gacaucgucaugacccaauccccccucucccuccccgucacccccggcgaacccgccuccaucuccugccgcucauccgaaucccuccuccacuccaacggcuucaucuaccucgacugguaccuccaaaaacccggccaauccccccaacuccucaucuaccucggcuccaaacgcgccuccggcgucuccgaccgcuucuccggcuccggcuccggcaccgccuucacccucaaaaucucccgcgucgaagccgaagacgucggcgucuacuacugcaugcaagcccucgaaucccgcaccuucggccaaggcaccaaacucgaaaucaaa

SEQ ID NO: 54909 - RNA, 327 nt, Artificial Sequence
  derived and/or modified sequence opt11 from anti-HIV_CD4bs_LightChain
gaaaucguccucacccaaucccccggcacccuaucccucucccccggcgaacgcgccacccucuccugccgcgccucccaauccgucuccuccuccuaccucgccugguaccaacaaaaacccggccaaucaccccgccuccucaucuacggcgccuccucccgcgccaccggcauccccgaccgcuucuccggcuccggcuccggcaccgacuucacccucaccaucucccgccucgaacccgaagacuucgccgucuacuacugccaacacuacggcuccuccuccaucuucaccuucggccccggcaccaaagucgacauccgc

SEQ ID NO: 54910 - RNA, 330 nt, Artificial Sequence
  derived and/or modified sequence opt11 from anti-HIV_CD4bs_LightChain
aacuucaugcucacccaaccccacuccgucuccggcucccccggcaaaaccgucaccaucuccugcacccgcuccuccggcuccaucgccggcaacuacguccaaugguaccaacaacgccccggcaccucccccaccaccgucaucuacgaaaacgaccaacgcuccuccggcguccccgaccgcuucuccggcuccaucgacuccuccuccaacuccgccucccucaccaucuccggacucaaaaccgaagacgaagccgacuacuacugccacuccuacgacgccaccaaccaagucuucggcggcggcaccaaacucaccguccuc

SEQ ID NO: 54911 - RNA, 333 nt, Artificial Sequence
  derived and/or modified sequence opt11 from anti-HIV_CD4bs_LightChain
gacgucgucgucacccaauccccccucucccuccccgucacccucggccaacccgccuccaucuccugccgcuccucccaaucccucgucuacuccgacggcaccacccaccucaacugguaccaccaacgccccggccaaccaccccgccgccucaucuaccgcgucuccaaccgcgacuccggcguccccgaccgcuucuccggcuccggcuccggcaccgacuucacccuccgcaucucccgcgucgaagccgaagacgucggccucuacuacugcaugcucgccacccaccccuucaccuucggccccggcaccaaagucgaaaucaaa

SEQ ID NO: 54912 - RNA, 336 nt, Artificial Sequence
  derived and/or modified sequence opt11 from anti-HIV_CD4bs_LightChain
cagagcgugcucacgcaaccgcccucggucucgggcgcgcccgggcaaacggucacgaucucgugcacgggcucgagcucaaacauaggcccgagcuaugacgugcaaugguaccagcaauuucccgggcgcgcgcccaagcuccugaucucgggcaauaacaaucgcgcgagcggggucccggacagguucucgggcucgaaaucgggcacgagcgcgagcuuggccauaaccgggcuccagagcgaggacgaggccgauuacuauugccagaccuaugacucgagcuugagcgggcacguggucuuuggcgggggcacgcgccugaccgugcuc

SEQ ID NO: 54913 - RNA, 321 nt, Artificial Sequence
  derived and/or modified sequence opt11 from anti-HIV_CD4bs_LightChain
gacauccaaaugacacaaucccccuccacccucuccgccuccgucggcgaccgcgucaccaucaccugccgcgccuccgccuccaucuacaccuggcucgccugguaccaacaacgacccggcaaagcccccgaaguccucaucuacaaagccuccacccucaaauccggcguccccucccgcuucuccggcuccggcuccggcaccgaauucacccucaccaucuccucccuccaacccggcgacuucgccaccuacuacugccaacaauacaccaccuacccacucaccuucggcggcggcaccaccgucgaaaucaaa

SEQ ID NO: 54914 - RNA, 330 nt, Artificial Sequence
  derived and/or modified sequence opt11 from anti-HIV_CD4bs_LightChain
caaucagcccucacccaacccgccuccgucuccggcucccccggccaauccaucaccaucuccugcaccggcaccuccaacgacaucggcaccuacaaccucgucuccugguaccaacaccaccccaacaaagcccccaaagucgucgucuacgaaaacaacaaacgccccuccggcaucuccaaccgcuucuccggcuccaaauccggcaacaccgccucccucaccaucuccggccuccaagccgaagacgaagccgacuacuacugcugcuccuacgccggcuccuccaccugggucuucggcggcggcaccaaacucaccguccuc

SEQ ID NO: 54915 - RNA, 321 nt, Artificial Sequence
  derived and/or modified sequence opt11 from anti-HIV_V2_LightChain
gacauccaaaugacccaaucccccuccacccucuccgccuccgucggcgaccgcgucaccaucaccugccgcgccucccaaaccaucuccuccuggcucgccugguaccaacaaaaauccggcaccgcccccaaacuccucaucuacaaagccuccuccaucgucuccggcguccccucccgcuucuccggcuccggcuccggcaccgaauucacccucaccaucaccucccuccaacccgacgacuucgccaccuacuacugccaacaauacaacuccucccccgaaaccuucggccaaggcaccaaagucgaaaucaaa

SEQ ID NO: 54916 - RNA, 318 nt, Artificial Sequence
  derived and/or modified sequence opt11 from anti-HIV_V2_LightChain
gaaaucguccucacccaaucccccggcacccucucccucucccccggcgaacgcgccacccuauccugccgcgccucccaauccgucuccuccuaccucgccugguaccaacaaaaacccggccaagcaccccgccuccucaucuacgacgccuccucccgcgccaccggcauccccgaccgcuucuccggcuccggcuccggcaccgacuucacccucaccaucucccgccucgaacccgaagacuucgccgucuacuacugccaacacuacgccggaucccgcaccuucggccaaggcaccaaagucgaaaucaaa

SEQ ID NO: 54917 - RNA, 333 nt, Artificial Sequence
  derived and/or modified sequence opt11 from anti-HIV_V2_LightChain
caauccguccucacccaaccccccuccgucuccggcgcccccggccaacgcgucaccaucuccugcaccggcuccuccuccaacaucggcgcccacuacgacguccacugguaccaacaacuccccggcaccgcccccaaacuccucaucuacggcaacuccaaccgccccuccggcguccccgaccgcuucuccggcuccaaauccggcaccuccgccucccucgccaucaccggccuccaagccgaagacgaagccgacuacuacugccaauccuacgacuccucccucuccggcuacgucuucggcaccggcaccaaagucaccguccuc

SEQ ID NO: 54918 - RNA, 324 nt, Artificial Sequence
  derived and/or modified sequence opt11 from anti-HIV_V2_LightChain
gacaccgucaugacccaaucccccgccacccucuccgucucccccggcgaacgcgucacccucuccugccgcgccucccaaaucaucaacaccaaccuagccugguaccaaaaacgccccggccaagccccccgccuccucaucuacgccgccuccgcccgcgccaccggcauccccgcccgcuucuccggcuccggcuccggcaccgaauucacacucaccaucuccggccuccaauccgaagacuccgccgucuacuacugccaacaauacaaacacuggccccccuacaccuucggccgcggcaccaaacucgaaauccgc

SEQ ID NO: 54919 - RNA, 321 nt, Artificial Sequence
  derived and/or modified sequence opt11 from anti-HIV_V2_LightChain
gaaaucguccucacccaaucccccggcacccucucccucucccccggcgaacgcgccacccucuccugccgcgccucccaauccgucuccuccuccuaccucgccugguaccaacaaaaacccggccaagccccccgccuccuaaucuacggcgccuccucccgcgccaccggcauccccgaccgcuucuccggcuccggcuccggcaccgacuucacccucaccaucucccgccucgaacccgaagacuucgccgucuacuacugccaacaauacggcuccucccgcaccuucggccaaggcaccaaagucgaaaucaaa

SEQ ID NO: 54920 - RNA, 321 nt, Artificial Sequence
  derived and/or modified sequence opt11 from anti-HIV_V2_LightChain
gacauccaaaugacccaaucacccuccucccucuccgccuccguaggcgaccgcgucaccaucaccugccgcgccucccaauccaucuccggcaaccucaacugguaccaacaaaaacccggcaaagcccccaaccuccucaucuacggcgccuccucccuccaauccggcguccccucccgcuucuccggcuccggcuccggcaccgacuucacccucaccaucuccucccuccaacccgaagacuucgccaccuaccacugccaacaaucccacuccaccucauggaccuucggccaaggcaccaaagucgucaucaaa

SEQ ID NO: 54921 - RNA, 327 nt, Artificial Sequence
  derived and/or modified sequence opt11 from anti-HIV_10E8
gccuccgaacucacccaagaccccaccguauccgucgcccucggccaaaccgucaccaucaccugccgcggcgacucccuccgcaaccacuacaccuccugguaccaacaaaaaaccggccaagccccaguccuccucaucuaccccaaacacaaccgcucccccggcaucuccgaccgcuucuccgccuccuccuccggcaacaccgccucccucaccaucaccggcgcccaaaccgaagacgaaggcgacuacuacugcuccucccgcgacaaauccggcucccgccucgucaccuucggcggcggcaccgaagucaccggccuc

SEQ ID NO: 54922 - RNA, 327 nt, Artificial Sequence
  derived and/or modified sequence opt11 from anti-HIV_10E8
gccuccgaacucacccaagaccccaccgucuccgucgcccucggccaaaccgucaccaucaccugccgcggcgacucccuccgcaaccacuacaccuccugguaccaacaaaaaaccggccaagcccccguccuccucaucuaccccaaacacaaccgcucccccggcaucuccgaccgcuucuccgccuccuccuccggcaacaccgccucccucaccauaaccggcgcccaaaccgaagacgaaggcgacuacuacugcuccucccgcgacaaauccggcucccgccucgucaccuucggcggcggcaccaaagucaccgucguc

SEQ ID NO: 54923 - RNA, 327 nt, Artificial Sequence
  derived and/or modified sequence opt11 from anti-HIV_10E8
gccuccgaacucacccaagaccccaccgucuccgucgcccucggccaaaccgucaccaucaccugccgcggcgacucccuccgcaacuacuacaccuccugguaccaacaaaaacccggccaagcccccguccuccucaucuaccccaaacacaaccgcccccccggcaucuccgaccgauucuccgccuccuccuccggcaacaccgccucccucaccaucaccggcgcccaaaccgaagacgaaggcgacuacuacugcuccucccgcgacaaaucaggcucccgccucgucaccuucggcggcggcaccaaagucaccggccuc

SEQ ID NO: 54924 - RNA, 327 nt, Artificial Sequence
  derived and/or modified sequence opt11 from anti-HIV_10E8
gccuccgaacucacccaagaccccaccgucuccgucgcccucggccaaaccgucaccaucaccugccgcggcgacucccuccgcaacuacuacaccuccugguaccaacaaaaacccggccaagcccccguccuccucaucuaccccaaacacaaccgcccccccggcaucuccgaccgcuucuccgccuccuccuccggcaacaccgccucccucaccaucaccggcgcccaaaccgaagacgaaggcgacuacuacugcuccucccgcgacaaauccggcucccgccucgucaccuucggccgcggcaccaaacucaccgucgua

SEQ ID NO: 54925 - RNA, 327 nt, Artificial Sequence
  derived and/or modified sequence opt11 from anti-HIV_10E8
gccuccgaacucacccaagaccccaccgucuccgucgcccucggccaaaccgucaccaucaccugccgcggcgacucccuccgcaaccacuacaccuccugguaccaacaaaaaaccggccaagcccccguccuccucaucuaccccaaacacaaccgcucccccggcaucuccgaccgcuucuccgccuccuccuccggcaacaccgccucacucaccaucaccggagcccaaaccgaagacgaaggcgacuacuacugcuccucccgcgacaaauccggcucccgccucgucaccuucggcggcggcaccaaagucaccguccuc

SEQ ID NO: 54926 - RNA, 327 nt, Artificial Sequence
  derived and/or modified sequence opt11 from anti-HIV_10E8
gccuccgaacucacccaagaccccaccgucuccgucgcccucggccaaaccgucaccaucaccugccgcggcgacucccuccgcaacuacuacaccuccugguaccaacaaaaaccccgccaagcccccguccuccucaucuaccccaaacacaaccgcccccccggcaucuccgaccgcuucuccgccuccuccuccggcaacaccgccucccucaccaucaccggcgcccaaaccgaagacgaaggcgacuacuacugcuccucccgcgacaaauccggcucccgccucgucaccuucggcggcggcaccaaacucaccguccuc

SEQ ID NO: 54927 - RNA, 327 nt, Artificial Sequence
  derived and/or modified sequence opt11 from anti-HIV_10E8
gccuccgaacucacccaagaccccaccgucuccgucgcccucggccaaaccgucaccaucaccugccgcggcgacucccuccgcaacuacuacaccuccugguaccaacaaaaacccggccaagcccccguccuccucaucuaccccaaacacaaccgcccccccggcaucuccgaccgcuucuccgccuccuccuccggcaacaccgccucccucaccaucaccggcgcccaaaccgaagacgaaggcgacuacuacugcuccucccgcgacaaauccggcucccgccucgucaccuucggcggcggcaccaaacucaccguccuc

SEQ ID NO: 54928 - RNA, 327 nt, Artificial Sequence
  derived and/or modified sequence opt11 from anti-HIV_10E8
gccuccgaacucacccaagaccccaccgucuccgucgcccucggccaaaccgucaccaucaccugccgcggcgacucccuccgcaaccacuacaccucaugguaccaacaaaaaaccggccaagcccccauccuccucaucuaccccaaacacaaccgcccccccggcaucuccgaccgcuucuccgccucauccuccggcaacaccgccucccucaccaucaccggcgcccaaaccgaagacgaaggcgacuacuacugcuccucccgcgacaaauccggcucacgccucgucaccuucggcggcggcaccaaacucaccguccuc

SEQ ID NO: 54929 - RNA, 327 nt, Artificial Sequence
  derived and/or modified sequence opt11 from anti-HIV_10E8
ucgagcgaucucacgcaagaucccgcggucucggucgcgcucgggcaaacggucaggaucacgugccagggcgauagcuugcgcagguacuaugccgggugguaucaacagaaaccgggccaggccccggucuuggucguguacgggcgcgauaacaggcccucaggcauacccgaucgcuuuagcgggagcacgagcgggaacacggccucgcucacgaucgcgggcgcgcaagcggaagaugacgcggacuauuacuguagcucacgcgauaaaucgggcucgcgcuugagcguguucgggggcgggaccaagcucacggucuug

SEQ ID NO: 54930 - RNA, 327 nt, Artificial Sequence
  derived and/or modified sequence opt11 from anti-HIV_10E8
gcgagcgagcucacgcaagaucccgcggucucggucgcguucgagaaaacggucacgaucacgugccagggcgauagcuugcgcucgcacuaugucucgugguaucaaaagcgcccgggccaggccccgguccuggucuuuuacgggaaaaauaacaggcccucgggcauacccgaucgcuuuagcgggagcacgagcgggaacacggccucgcucacgaucgcgggcgcgcaagcggaagaugacgcggacuauuacuguagcucgcgcgauaaaucaggcucgcgcuugagcguguucgggggcgggaccaagcucacggucccg

SEQ ID NO: 54931 - RNA, 327 nt, Artificial Sequence
  derived and/or modified sequence opt11 from anti-HIV_10E8
gcgagcgagcucacgcaagaucccgcggucucggucgcgcucaagcaaacggucacgaucacgugcaggggcgauagcuugcgcucgcacuaugucucgugguaucaacagaaaccgggccaggccccgguccuggucuuuuacgggaaaaauaacaggcccucgggcauacccgaucgcuuuagcgggagcucgagcgggaacacggccucgcucacgaucgcgggcgcgcaagcggaagaugacgcggacuauuacuguagcucgcgcgauaaaucgggcucgcgcuugagcguguucgggggcgggaccaagcucacggucuug

SEQ ID NO: 54932 - RNA, 327 nt, Artificial Sequence
  derived and/or modified sequence opt11 from anti-HIV_10E8
ucgagcgagcucacgcaagaucccggggucucggucgcgcucaagcaaacggucacgaucacgugcaggggcgauagcuugcgcucgcacuaugucucgugguaucaaaagaaaccgggccaggccccgguccuggucuuuuacgggaaaaauaucgggcccucaggcauacccgaucgcuuuagcgggagcacgagcgggaacacggccucgcucacgaucgcgggcgcgcaagcggaagaugacgcggacuauuacuguagcucgcgcgauaaaucgggcucgcgcuugagcguguucgggggcgggaccaagcucacggucuug

SEQ ID NO: 54933 - RNA, 327 nt, Artificial Sequence
  derived and/or modified sequence opt11 from anti-HIV_10E8
gccuccgaacucacccaagaccccgccgucuccgucgcccucaaacaaaccgucaccaucaccugccgcggcgacucccuccgcucccacuacgucuccugguaccaaaaaaaacccggccaagcccccguccucguauucuacggcaaaaacaaccgccccucaggcaucccagaccgcuucuccggcuccuccuccggcaacaccgccucacucaccaucgccggcgcccaagccgaagacgacgccgacuacuacugcuccucccgcgacaaauccggcucccgccucuccgucuucggcggcggcaccaaacucaccguccuc

SEQ ID NO: 54934 - RNA, 327 nt, Artificial Sequence
  derived and/or modified sequence opt11 from anti-HIV_10E8
gcgagcgagcucacgcaagaucccggggucucggucgcgcucaagcaaacggucacgaucacgugcaggggcgauagcuugcgcucgcacuaugucucgugguaucaaaagcgcccgggccaggccccggucuuggucuuuuacgggaaaaauaacaggcccucgggcauacccgaucgcuuuagcgggagcacgagcgggaacacggccucgcucacgaucgcgggcgcgcaagcggaagaugacgcggacuauuacuguagcucgcgcgauaaaucgggcucgcgcuugagcguguucgggggcgggaccaagcucacggucuug

SEQ ID NO: 54935 - RNA, 327 nt, Artificial Sequence
  derived and/or modified sequence opt11 from anti-HIV_10E8
gcgagcgagcucacgcaagaucccggggucucggucgcgcucgagcaaacggucacgaucacgugcaggggcgauagccugcgcucgcacuaugucucgugguaucaaaagaaaccgggccaggccccggucuuggucuuuuacgggaaaaauaacaggcccucgggcauacccgaucgcuuuagcgggagcacgagcgggaacacggccucgcucacgaucgcgggcgcgcaagcggaagaugacgcggacuauuacuguagcucgcgcgauaaaucgggaucgcgcuugagcguguucgggggcgggaccaagcucacggucuug

SEQ ID NO: 54936 - RNA, 327 nt, Artificial Sequence
  derived and/or modified sequence opt11 from anti-HIV_10E8
gcgagcgagcucacgcaagaucccggggucucggucgcgcucaagcaaacggucacgaucacgugcaggggcgauagcuugcgcucgcacuaugucucgugguaucaaaagaaaccgggccaggccccggucuuggucuuuuacgggaaaaauaacaggcccucgggcauacccgaucgcuuuagcgggagcacgagcgggaacacggccucgcucacgaucgcgggcgcgcaagcggaagaugacgcggacuauuacuguagcucgcgcgauaaaucgggcucgcgcuugagcguguucgggggcgggaccaagcucacggucuug

SEQ ID NO: 54937 - RNA, 327 nt, Artificial Sequence
  derived and/or modified sequence opt11 from anti-HIV_10E8
uccuccgaacucacccaagaccccggcgucuccgucgcccucaaacaaaccgucaccaucaccugccgcggcgacucccuccgcucacacuacgucuccugguaccaaaaaaaacccggccaagcccccguccucgucuucuacggcaaaaacaaccgcccauccggcauccccgaccgcuucuccggcuccacauccggcaacaccgccucccucaccaucgccggcgcccaagccgaagacgacgccgacuacuacugcuccucccgcgacaaauccggcucccgccucuccgucuucggcggcggcaccaaacuaaccguccuc

SEQ ID NO: 54938 - RNA, 327 nt, Artificial Sequence
  derived and/or modified sequence opt11 from anti-HIV_10E8
ucgagcgagcucacgcaagagaccggggucucggucgcgcucgggcgcacggucacgaucacgugcagaggcgauagcuugcgcucgcacuaugccucgugguaucaagagaaaccgggccaggccccgaaauugcucuuuuacgggaaaaauaacaggcccucgggcauacccgaucgcuuuagcgggagcgcgagcgggaacagggccucgcucacgaucucgggcgcgcaagcggaagaugacgcggaauauuacuguagcucgcgcgauaaaucgggcucgcgcuugagcguguucgggggcgggaccaagcucgcggucuug

SEQ ID NO: 54939 - RNA, 327 nt, Artificial Sequence
  derived and/or modified sequence opt11 from anti-HIV_10E8
uccuccgaacucacacaagaaaccggcgucuccgucgcccucggccgcaccgucaccaucaccugccgcggcgacucccuccgcucccacuacgccuccugguaccaaaaaaaacccggccaagcccccaaacuccucuucuacggaaaaaacaaccgccccuccggcauccccgaccgcuucuccggcuucgccuccggcaacagagccucccucaccaucuccggcgcccaagccgaagacgacgccgaauacuacugcuccucacgcgacaaauccggcucccgccuauccgucuucggcggcggcaccaaacucacaguccuc

SEQ ID NO: 54940 - RNA, 327 nt, Artificial Sequence
  derived and/or modified sequence opt11 from anti-HIV_10E8
ucgagcgagcucacgcaagagaccggggucucggucgcgcucgggcgcacggucacgaucacgugcaggggcgauagccugcgaucgcacuaugccucgugguaucaaaagaaaccgggccaggccccgaaauugcucuuuuacgggaaaaauaacaggcccucgggcauacccgaucgcuuuagcgggagcgcgagcgggaacagggccucgcucacgaucucgggcgcgcaagcggaagaugacgcggaauauaucuguagcucgcgcgauaaaucgggcucgcgccugagcguguucgggggcgggaccaagcucacggucuug

SEQ ID NO: 54941 - RNA, 327 nt, Artificial Sequence
  derived and/or modified sequence opt11 from anti-HIV_10E8
ucgagcgagcucacgcaagagaccggggucucggucgcgcucgggcgcacggucacgaucacgugcaggggcgauagcuugcgcucgcacuaugccucgugguaucaaaagaaaccgggccaggccccgaaauugcucuuuuacgggaaaaauaacaggcccucgggcauacccgaucgcuuuagcgggagcgcgagcgggaacagggccucgcucacgaucucaggcgcgcaagcggaagaugacgcggaauauuacuguagcucgcgcgauaaaucgggcucgcgcuugagcguguucgggggcgggaccaagcucacggucuug

SEQ ID NO: 54942 - RNA, 327 nt, Artificial Sequence
  derived and/or modified sequence opt11 from anti-HIV_10E8
ucaagcgagcucacgcaagagaccggggucucggucgcgcucgggcgcacggucacgaucacgugcaggggcgauagcuugcgcucgcacuaugcaucgugguaucaaaagaaaccgggccaggccccgauccugcucuuuuacgggaaaaauaacaggcccucgggcauacacgaucgcuuuagcgggagcgcgagcgggaacagggccucgcucacgaucucgggcgcgcaagcggaagaugacgcggaauauuacuguagcucgcgcgauaaaucgggcucgcgcuugagcguguucgggggcgggaccaagcucacggucuug

SEQ ID NO: 54943 - RNA, 393 nt, Artificial Sequence
  derived and/or modified sequence opt11 from anti-HIV_10E8
gaagugcaacuggucgagagcgggggcgaucucgugaaaccgggcgggagcuugcgcuugagcuguagcgcgagcggguucucguucaagaacacguggaugaccugggucaggcaagcgcccgggaaagggcuagagugggugggcaggaucacgggcccgggcgagggcuggaccucggacuaugccgcgaccgugcaagggcgcuuuacaauaagcaggaacaauaugauagacaugcuauaucucgagaugaaucgcuugcgcacggacgauaccgggcucuauuacuguguccauaccgagaaauauuacaauuucuggggcggguacccgcccggggaagaguacuuucaacauugggggcgcgggacauuggucauagucucgagc

SEQ ID NO: 54944 - RNA, 393 nt, Artificial Sequence
  derived and/or modified sequence opt11 from anti-HIV_10E8
gagauaagguugguggagagcgggggggggcuagugaagccgggggggagcuugagauugagcuguagcgcgagcggguucaauuucgauagcgcguggaugacgugggugaggcagccgccagggaaggggcuggagugggugggaaggauaacggggccgggggagggguggagcgugggguaugcggagagcgugaaagggagguuuauaauaagcaggauaaauagcauaaacuuucuguaucuggagaugaauaacuugaggccggaggauacggggagcuauuucugugcgcauacggggaagcauuacgauuucuggaggggguacccgccgggggaggaguacuuucaggauugggggcaggggacacaggugauagugucgagc

SEQ ID NO: 54945 - RNA, 393 nt, Artificial Sequence
  derived and/or modified sequence opt11 from anti-HIV_10E8
gaaauacgcuuggucgagagcgggggcgggcucgugaaaccgggcgggagcuugcgcuugagcuguagcgcgagcggguucaauuucgauagcgcguggaugaccugggucaggcaaccgcccgggaaagggcucgagugggugggcaggaucacgggcccgggcgagggcuggagcguggacuaugccgagagcgugaaagggcgcuuuaucauaagcaggaucaauagcauaaacuuucucuaucucgagaugaauaacuugcgaccggaagauaccgggagcuauuucugugcccauaccgggaaacauuacgauuucuggcgcggguacccgcccggggaagaguacuuucaagauugggggcaagggacccaggucauagucucgagc

SEQ ID NO: 54946 - RNA, 393 nt, Artificial Sequence
  derived and/or modified sequence opt11 from anti-HIV_10E8
gaggugagauugguggagagcggggggaggcuggugaggccgggggggagcuugagguugagcuguagcgcgagcggguucaauuucgauaacgcguggaugacguggguaaggcagccgccggggaaggggcuggaguggguggggaggauaacgggaccgggggagggguggagcguggacuaugcggcgagcgugaaggggagauuuacgauaagcaggaugaauagcauaaacuuuuucuaucuggagaugaauaacuugaagauagaggauacggggcuguauuucugugcgaggacggggaagcauuacgcguucuggggaggguacccgccgggggaggaguacuuggaggauugggggcaggggacguuggugauagugaguagc

SEQ ID NO: 54947 - RNA, 393 nt, Artificial Sequence
  derived and/or modified sequence opt11 from anti-HIV_10E8
gaggucaggcucguggaaucgggcgggggccuggucaagcccgggggcucgcucaggcucucgugcucggccucgggcuuuaacuuugacgaugccuggaugacgugggugcgccagcccccgggcaagggccuggaaugggucgggcgcauaagcgggcccggggaaggguggucggucgauuacgcggaaucgguaaagggcagguucacgaucucgcgcuugaacucgaucaauuucuuguacuuggaaaugaacaaugucaggaccgaggacacgggcuauuacuuuugcgcgcgcacgggcaagcacuaugacuuuuggucgggcuauccaccgggagaggaauauuuccaggacuggggccagggcacgcuagugaucgugagcucg

SEQ ID NO: 54948 - RNA, 393 nt, Artificial Sequence
  derived and/or modified sequence opt11 from anti-HIV_10E8
gaagugcgcuuggccgagagcgggggcgggcucgugaaaccgggcgggagcuugcgcuugagcuguagcgcgagcggguucgauuucgauaacgcguggaugaccugggucaggcaaccgcccgggaaagggcucgagugggugggcaggaucacgggcccgggcgagggcuggagcguggacuaugccgcgccaguggaagggcgauuuaccauaagcaggcucaauagcauaaacuuucucuaucuagagaugaauaacuugcgcauggaagauagcgggcucuauuucugugccaggaccgggaaauauuacgauuucuggagcggguacccgcccggggaagaguacuuucaagauugggggcaagggaccuuggucauagucccgagu

SEQ ID NO: 54949 - RNA, 393 nt, Artificial Sequence
  derived and/or modified sequence opt11 from anti-HIV_10E8
gaagugcgcuuggucgagagcgggggcgggcucgugaaaccgggcgggagcuugcgcuugagcuguagcgcgagcggguucgauuucgauaacgcguggaugaccugggucaggcaaccgcccgggaaagggcucgagugggugggcaggaucacgggcccgggcgagggcuggagcguggacuaugccgcgcccguggaagggcgcuuuaccauaagcaggcuaaauagcauaaacuuucucuaucuagagaugaauaacuugcgcauggaagauagcgggcucuauuucugugccaggaccgggaaauauuacgauuucuggagcggguacccgcccggggaagaguacuuucaagauugggggcaagggaccuuggucauagucccgagc

SEQ ID NO: 54950 - RNA, 393 nt, Artificial Sequence
  derived and/or modified sequence opt11 from anti-HIV_10E8
gaagugcgcuuggucgagagcgggggcgggcucgugaaaccgggcgggagcuugcgcuugagcuguagcgcgagcggguucgauuucgauaacgcguggaugaccugggucaggcaaccgcccgggaaagggcucgagugggugggcaggaucacgggcccgggcgagggcuggagcguggacuaugccgcgcccguggaagggcgcuuuaccauaagcaggcuaaauagcauaaacuuucucuaucucgagaugaauaacuugcgcauggaagauagcgggcucuauuucugugccaggaccgggaaauauuacgauuucuggagcggguacccgcccggggaagaguacuuucaagauugggggcaagggaccuuggucauagucucgagc

SEQ ID NO: 54951 - RNA, 393 nt, Artificial Sequence
  derived and/or modified sequence opt11 from anti-HIV_10E8
gaagugcgauuggccgagagcgggggcgggcuugugaaaccgggcgggagcuugcgauugagcuguagcgcgagcggguucgauuucgauaacgcguggaugaccugggucaggcaaccgcccgggaaagggcucgaguggguggggaggaucacgggcccgggcgagggcuggagcguggacuaugccgcgcccguggaagggcgauuuacgauaagcaggcuaaauagcauaaacuuucucuaucuagagaugaauaacuugcgcauggaagauagcgggcuauauuucugugccaggaccgggaaauauuacgauuucuggagcggguacccgcccggggaagaguacuuucaagauugggggcgcgggaccuugguaauagucucgagc

SEQ ID NO: 54952 - RNA, 393 nt, Artificial Sequence
  derived and/or modified sequence opt11 from anti-HIV_10E8
gaagugcgcuuggucgagagcgggggagggcucgugaaaccgggcgggagcuugcgcuugagcuguagcgcgagcggguucgauuucgauaacgcguggaugaccugggucaggcaaccgcccgggaaagggcucgagugggugggcaggaucacgggcccgggcgagggcuggagcguggacuaugccgcgccaguggaagggcgcuuuaccauaagcaggcucaauagcauaaacuuucuauaucuagagaugaauaacuugcgcauggaagauagcgggcucuauuucugugccaggaccgggaaauauuacgauuucuggagcggguacccgccaggggaagaguacuuucaagauugggggcgcgggacccuggucauagucucgagc

SEQ ID NO: 54953 - RNA, 333 nt, Artificial Sequence
  derived and/or modified sequence opt11 from anti-HIV-1_LightChain
caauccguccucacccaaccccccuccgucuccgcagcccccggccaaaaagucaccaucuccugcuccggccgcuccuccaacaucggcaacaacaacgucuucugguaccaacaacuacccggcaccgcccccaaacuccucaucuacgacaacgacaaacgccccuccggcauccccgaccgcuucucaggcuccaaauccggcaccuccgccacccucggcaucaccggccuccaaaccggagacgaagcagacuacuacugcggcaccugggacuccucccucuccgccggcggcgucuucggcaccggcaccaaagucaccguccuc

SEQ ID NO: 54954 - RNA, 336 nt, Artificial Sequence
  derived and/or modified sequence opt11 from anti-HIV-1_LightChain
cagagcgugcucacgcaaccggccucggucucgggcucgcccgggcaaucgaucacgaucucgugcacgggcacgaaaucggacauaggcggguacaaguacgugagcugguaccagcaacaucccgggaaagcgcccaagaucuugaucuaugacgugaacaagcgcccgagcgggaucccggacagguucucaggcucgaaaucgggcacgagcgcgacauugggcauaaccgggcuccagaccggggacgaggccgauuacuauugcgggaccugggacaauagcuugagcacgggcggggucuuuggcacgggcacgaaagugaccgugcuc

SEQ ID NO: 54955 - RNA, 321 nt, Artificial Sequence
  derived and/or modified sequence opt11 from anti-HIV-1_LightChain
caauccguccucacccaaccccccuccgucuccgcagcccccggccaacgcgucaccaucuccugcuucggcucccgcuucuccuccgucuccugguaccaacaacuccccggcaccgcccccaaacuccucaucuacgaaaacaccaaacgccccuccggcauccccgaccgcuucuccggcuccaaauccggcaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 54956 - RNA, 333 nt, Artificial Sequence
  derived and/or modified sequence opt11 from anti-HIV-1_LightChain
caauccguccucacccaaccacccuccgccuccggcacccccggccaaaccaucaccaucuccugcuccggcuccuccuccaacaucggcuccaacgacgucuacugguaccaacaccuccccggcaccacccccaaagucgucaucuacaaaaacaaccgccgccccuccggcauccccgaccgcuucuccggcuccaaauccggcaccuccgccacccucggcaucaccggccuccaaaccggcgacgaagccgacuacuacugcggaaccugggaccgcucccucuccgccggcggcgucuucggcaccggcaccaaagucaccguccuc

SEQ ID NO: 54957 - RNA, 327 nt, Artificial Sequence
  derived and/or modified sequence opt11 from anti-HIV-1_LightChain
caauccguccucacccaaccccccuccauguccgccgcccccggccaaaaagucaccaucuccugcuccggcuccaccuccaucaucggcaacaacuacaucuccugguaccaacaacuccccggcaccgcccccaaacuccucaucuacgaagacaacaaacgccccuccggcauccccgaccgcuucuccggcuccaaauccggcaccuccgccacccucggcaucaccggccuccaaaccggcgacgaagccgacuacuacugcggcaccuggcacuccucccucuccgcaggcggcgucuucggcaccggcaccaaagucacc

SEQ ID NO: 54958 - RNA, 333 nt, Artificial Sequence
  derived and/or modified sequence opt11 from anti-HIV-1_LightChain
caauccguccucacccaaccccccuccgucuccgccgcccccggccucaaagucaccaucuccugcuccggcaacaccuccaacgucggcgacaacuucgucuccugguaccgcuaccuccccggcaccgcccccaaacuccucuccuacgaagacgacaaacgccccuccggcauccccgaccgcuucucaggcuccaaauccggcaccuccgccacccucggcaucaccggccuccaaaccggcgacgaagccgacuacuacugcggcaccugggacuccucccucuccgccggcggcguauucggcaccggcaccaaagucaccguccuc

SEQ ID NO: 54959 - RNA, 333 nt, Artificial Sequence
  derived and/or modified sequence opt11 from anti-HIV-1_LightChain
caauccguccuaacccaaccccccuccgccuccggcacccccggccaacgcgucaccaucuccugcuccggcuccuccuccaacaucggcuccaacaccgucaacugguaccaacaauuccccggcaccgcccccaaacuccucaucuacgaaaacaaccgccgucccuccggcguccccgcccgcuucuccggcuccaaauccggcaccuccgccacccucgccaucaccggccuccaaaccggcgacgaagccgacuacuacugcgccaccugggacuccucccucuccgccggcggcgucuucggcaccggcaccaaagucaccguccuc

SEQ ID NO: 54960 - RNA, 318 nt, Artificial Sequence
  derived and/or modified sequence opt11 from anti-HIV-1_LightChain
caauccguccucacccaaccccccuccgucuccgccgcccccggccaaaaagucaccaucuccugcuccggcuccuccuccaacaucggcaacaacuacgucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacaacucccuauccaccggcggcgucuucggcaccggcacc

SEQ ID NO: 54961 - RNA, 288 nt, Artificial Sequence
  derived and/or modified sequence opt11 from anti-HIV-1_LightChain
gggcucucgcccucgcucuguagcgggagcucgagcaauaucgggaacaauuacgugagcugguaccagcaauugcccgggaccgcgcccaagcucuugaucuaugaaaauaccaagcgcccgagcgggaucccggacagguucucgggcucgaaaucgggcacgagcgcgaccuugggcauaaccgggcuccagaccggggacgagggcgauuacuauugcgggaccugggacaggagcuugagcgcgggcggggucuuuggcacgggcacgaaagugaccgugcuc

SEQ ID NO: 54962 - RNA, 333 nt, Artificial Sequence
  derived and/or modified sequence opt11 from anti-HIV-1_LightChain
caauucguccucacccaaccacccuccgucuccgccgcccccggccaacgcgucaccgucuccugcuccggcaccaccuccgacaucggcgaaaacuacgucuccugguaccaaaaauucuccgaagccgcccccaaacuccuccucuacgacaacgacaaacgccccuccggcauccccgaccgcuucuccggcuccaaauccggcaccuccgccacccuaggcaucaccggccuccaaaccggcgacgaagccgacuacuacugcggcaccugggacuccucccucuccgccggcggcgucuucggcaccggcaccaaagucaccguccuc

SEQ ID NO: 54963 - RNA, 327 nt, Artificial Sequence
  derived and/or modified sequence opt11 from anti-HIV-1_LightChain
caauccguccucacccaaccccccuccgucuccgccgcccccggccaaaaagucaccaucuccugcuccggcggcuccuccaacaucggcaacuacuacgucuccugguaccuccaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccuggcacucaucccucucagccggcggcgucuucggcaccggcaccaaagucacc

SEQ ID NO: 54964 - RNA, 333 nt, Artificial Sequence
  derived and/or modified sequence opt11 from anti-HIV-1_LightChain
caauccguccucacccaaccccccuccgucucagccgcccccggccaaaaagucaccaucuccugcuccggcaacauguccaacaucggcgacaacgccguauccugguaccgccaaguccccgaagcccccccacaacuccucaucuucggcaacgacaaacgccccuccggcgucaccgaccgcuucuccggcuccaaauccggcaccuccgccacccucggaaucaccggccuccaaaccggcgacgaagccgacuacuacugcggcaccugggaccgcucccucuccgccggcggcgucuucggcaccggcaccaaagucaccguccuc

SEQ ID NO: 54965 - RNA, 336 nt, Artificial Sequence
  derived and/or modified sequence opt11 from anti-HIV-1_LightChain
caauccguccucacacaaccccccucagucuccggcgcccccggccaacgcgucaccaucuccugcaccggcuccuccuccaacaucggcgccggcuacgacguccacugguaccuccaacuccccggcaccgccccccgccuccucaucuacgacaacgacaaacgccccuccggaauccccgaccgcuucuccggcuccaaauccggcaccuccgccacccucggcaucaccggccuccaaaccggcgacgaagccgacuacuacugcggcaccuggcacuccucccucuccgccggcggagucuucggcaccggcaccaaagucaccguccuc

SEQ ID NO: 54966 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcuccaccuccaacaucggcaacaacuucgucuccugguaccaacaacuccccggcaccgcccccaaacuccucuucuacgacaacuacaaacgccccuccggcauccccgaccgcuucuccggcucaaaauccggcaccuccgccacccucgccaucaccggccuccaaaccggcgacgaagccgacuacuacugcgccaccugggacuccucccucuccgccggcggcgucuucggcaccggcaccaaagucaccguccuc

SEQ ID NO: 54967 - RNA, 336 nt, Artificial Sequence
  derived and/or modified sequence opt11 from anti-HIV-1_LightChain
cagagcgugcucacgcaaccgcccucggucucgggcgcgcccgggcaaagggucacgaucucgugcacgggcgggagcucaaacauaggcgcgggcuaugacgugcacugguaccagcacuugcccgggaccgcgccccagcucuugaucuaugaaaauaccaagcgcccgagcgggaucccggacagguucucgggcucgaaaucgggcacgagcgcgaccuugggcauaaccgggcuccagaccggggacgaggccgauuacuauugcgggaccugggacaggagcuugagcgcgggcggggucuuuggcacgggcacgaaagugaccgugcuc

SEQ ID NO: 54968 - RNA, 333 nt, Artificial Sequence
  derived and/or modified sequence opt11 from anti-HIV-1_LightChain
caaucaguccucacccaaccccccucccucuccgccgcccccggccaacgcgucaccgucuccugcuccggcuccuccuccaacaucggcgacaacuacgucuccugguaccaacaacuccccggagccgccccccgccuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacaacucccucuccaccggcggcgucuucggcaccggcaccaaagucaccguccuc

SEQ ID NO: 54969 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggccgcuccuccaacaucggcaacuacuucgucuccugguaccaacaauuccccggcaccgcccccaaacuccucaucuacgacaacaacaaacgccccuccggcauccccgaccgcuucuccggcuccaaauccggcaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 54970 - RNA, 333 nt, Artificial Sequence
  derived and/or modified sequence opt11 from anti-HIV-1_LightChain
caaucaguccucacccaaccacccuccgccuccggcacccccggccaacgcgucaccaucuccugcuccggcuccuccuccaacaucggcuccaacgccguccacugguuccgccaacuacccggcaccgcccccaaacuccuaaucuacgaaaacaacaaacgccccuccggcauccccgaccgcuucuccggcuccaaauccggcaccuccgccacccucggcaucaccggccuccaaaccggcgacgaagccgacuacuacugcgccaccugggacuccucccucuccgccggcggcgucuucggcaccggcaccaaagucaccguccuc

SEQ ID NO: 54971 - RNA, 333 nt, Artificial Sequence
  derived and/or modified sequence opt11 from anti-HIV-1_LightChain
caaucaguccucacccaaccccccuccgucuccgccgccuccggccaaaaagucaccaucuccugcuccggcuccuccuccaacaucggcaacaacuacgucuccugguaccaccaacuccccggcaccgcccccaaacuccuaaucuacgacaccaacaaacgccccuccggcauccccgaccgcuucuccggcuccaccuccggcaccuccgccacccucggcaucaccggccuccaaaccggcgacgaagccgacuacuacugcggcaccugggacaacucccucuccaccggcggcgucuucggcaccggcaccaaagucaccguccuc

SEQ ID NO: 54972 - RNA, 333 nt, Artificial Sequence
  derived and/or modified sequence opt11 from anti-HIV-1_LightChain
caacccguccucacccaaccccccuccgucuccgccgcccccggccaaaccgucaccaucuccugcuccggcuccuucuccaacaucgaaaccaacuacgucuccugguaccaacaacuccccggcaccgcccccaaacuccucaucuacgacaacaacaugcgccccuccggcauccccgaccgcuucuccggcuccaaauccggcaccucagccacccucggcaucaccggccuccaaaccggcgacgaagccgacuacuacugcggcaccugggacacaucccucuccgccggcggcgucuucggcaccggcaccaaagucaccguccuc

SEQ ID NO: 54973 - RNA, 336 nt, Artificial Sequence
  derived and/or modified sequence opt11 from anti-HIV-1_LightChain
caacccguccucacccaaccccccuccgucuccggcgcccccggccaacgcgucaccaucuccugcaccggcuccuccuccaacaucggcgccggcuacgacguccacugguaccaacaacuccccggcaccgcccccaaacuccucaucuacgaaaacaacaaacgccccuccggcauccccgaccgcuucuccggcucaaaauccggcaccuccgccacccucggcaucaccggccuccaaaccggcgacgaagccgacuacuacugcggcaccugggacaacucccucuccaccggcggagucuucggcaccggcaccaaagucacaguccuc

SEQ ID NO: 54974 - RNA, 333 nt, Artificial Sequence
  derived and/or modified sequence opt11 from anti-HIV-1_LightChain
caauccguccucacccaaccccccucccucuccgccgcccccggccaacgcaucaccaucuccugcuccggcuccuccuccaacaucggcaacaacuacgucuccugguaccaacaauuccccggcaccgcccccaaacuccucaucuacgaaaacaacaaacgccccuccggcauccccgaccgcuucucagccuccaaauccggcaccuccgccacccucggcaucaccggccuccaaaccggcgacgaagccaacuacuacugcggcaccuggcacuccucccucuccgccggcggcgucuucggcaccggcaccaaagucaccguccuc

SEQ ID NO: 54975 - RNA, 333 nt, Artificial Sequence
  derived and/or modified sequence opt11 from anti-HIV-1_LightChain
caaucggucuuaacccagcccccgagcgugagcgcggccccgggccagcgcgugaccauaagcuguuucgggagcagguucaaugucgggaccucgagcgugagcugguaccagcaauugcccgggaccgcgcccaagcucuugaucgaugccaauggcgagcgcccgagcgggaucccggacagguucucgggcucgaaaucgggcacgagcgcgaccuugggcauaaccgggcuccagaccggggacgaggccgauuacuauugcgggaccugggacucgagcuugagcgcgggcggggucuuuggcacgggcacgaaagugaccgugcuc

SEQ ID NO: 54976 - RNA, 333 nt, Artificial Sequence
  derived and/or modified sequence opt11 from anti-HIV-1_LightChain
caauccguccucacacaaccccccuccgucuccgccacccccggccaaaaagucaccaucuccugcuccggcucccgcuccaacaucggcucccacuacgucuccugguaccaacaauuccccggcaccgcccccaaacuccucaucuacgacaacaacaaacgccccuccggcauccccgaccgcuucuccggcuccaaauccggcaccuccgccacccucggcaucaccggccuccaaaccggcgacgaagccgacuacuacugcggcaccuggcacuccucccucuccgccggcggcgucuucggcaccggcaccaaagucaccguacuc

SEQ ID NO: 54977 - RNA, 333 nt, Artificial Sequence
  derived and/or modified sequence opt11 from anti-HIV-1_LightChain
caauccguccucacccaaccccccuccgccuccggcacccccggccaacgcgucaccaucuccugcuccggcuccuccuccaacaucggcucaaaccacgucuacugguaccaacaacuacccggcaaaacccccaaacuacuaaucuaccgcaacaaccaacgccccuccggcauccccgaccgcuucuccggcuccaaauccggcaccuccgccacccucggcaucaccggccuccaaaccggcgacgaagccgacuacuacugcggcaccugggacuccucccucuccaccggcggcgucuucggcaccggcaccaaagucaccguccuc

SEQ ID NO: 54978 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcucaggcuccuccgccaacaucggcaacaacuacgucuccugguaccaacaauuccccggcaccggcccccgccucaucaucuacgaauccaacaaacgccccuccggcaucuccgaccgcuucuccggcucccaauccgacgccgccgccacccucgacaucaccggccuccaaaccggcgacgaagccgacuacuacugcggcaccugggacuccucccucucagccggcggcgucuucggaaccggcacccgcgucaccguccuc

SEQ ID NO: 54979 - RNA, 336 nt, Artificial Sequence
  derived and/or modified sequence opt11 from anti-HIV-1_LightChain
caauccguccuaacccaaccacccuccgucuccggcgcccccggccaaaccgucaccaucuccugcaccggcgacaccuccaacaucggcgccgacuaccgcguccacugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacaacucccucuccaccggcggcgucuucggcaccggcaccaaagucaccguacuc

SEQ ID NO: 54980 - RNA, 333 nt, Artificial Sequence
  derived and/or modified sequence opt11 from anti-HIV-1_LightChain
caauccguccuaacccaaccccccucacucuccgccgcccccggccaacgcgucaccgucuccugcuccggcuccuccuccaacaucggcaacaacuacgucuccugguaccaacaacuccccggcgccgcccccaaacuccucaucuacaacaacaacauccgccccuccggcauccccgaacgcuucuccggcuccaaauccggcaccuccgccacccucggcaucaccggccuccaaaccggcgacgaaggcgacuacuacugcggcaccugggaccgcucccucuccgccggcggcgucuucggcaccggcaccaaagucaccguccuc

SEQ ID NO: 54981 - RNA, 333 nt, Artificial Sequence
  derived and/or modified sequence opt11 from anti-HIV-1_LightChain
caaucggucuugacccagcccccgagcgcgagcgggaccccgggccagcgcgugaccauaagcuguagcgggagcucgagcaauaucgggggcaauuacgugagcugguaccagcaauugcccgggaccgcgcccaagcuauuaaucucggaaaauaacaagcgcccgagcgggaucccggacagguucucaggcucgaaaucgggcacgagcgcgaccuugggcauaaccgggcuccagacaggggacgaggccgauuacuauugcgggaccugggacucgagcuugagcgcgggcggggucuuuggcacgggcacgaaagugaccgugcuc

SEQ ID NO: 54982 - RNA, 333 nt, Artificial Sequence
  derived and/or modified sequence opt11 from anti-HIV-1_LightChain
caaucccuccucacccaaccccccuccgucuccgccgcccccggccaaaaagucaccaucuccugcuccggcuccuccuccaacaucggcaacaacuucgucuccugguaccaacaacuccccggcaccgcccccaaacuccucaucuacgaaaacaacaugcgccccuccggcauccccgaccgcuucuccggcuccaaauccggcaccuccgccacacucggcaucaccggccuccaaaccggcgacgaagccgacuacuacugcggcaccugggacuccucacucuccgccggcggagucuucggcaccggcaccaaagucaccguccuc

SEQ ID NO: 54983 - RNA, 333 nt, Artificial Sequence
  derived and/or modified sequence opt11 from anti-HIV-1_LightChain
caauccguccucacccaaccccccuccgucuccgccgcccccggccaaaaagucaccaucucaugcuccggcaccuccuccaacaucgccaacuacuacgucuccugguaccgccaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacuccucccucuccgccggaggcgucuucggcaccggcaccaaaguaaccguccuc

SEQ ID NO: 54984 - RNA, 333 nt, Artificial Sequence
  derived and/or modified sequence opt11 from anti-HIV-1_LightChain
caacccguccucacccaaccccccuccgucuccggcgcccccggccaacgcgucaccaucuccugcuccggcuccuccuccaacaucggcaacaacgacgucuccugguaccaacaaguacccggcaccgcccccaaacuccucaucuacgaaaacaacaaacgccccuccggcauccccgaccgcuucuccggcuccaaauccggcaccuccgccacccuaggcaucaccggccuccaaaccggcgacgaagccgacuacuacugcggcaccugggacaccucccucuccgccggcggcgucuucggcaccggcaccaaagucaccguccuc

SEQ ID NO: 54985 - RNA, 333 nt, Artificial Sequence
  derived and/or modified sequence opt11 from anti-HIV-1_LightChain
caacucguccucacccaaccccccuccgucuccgccgcccccggccaacgcgucaccaucuccugcuucggcucccgcuucaacgucggcaccuccuccgucuccugguaccaacaacuccccggcaccgcccccaaacuccucaucgacgccaacggcgaacgccccuccggcauccccgaccgcuucuucggcuccgaauccggcaccuccgccacccucggcaucaccggccuccaaaccggcgacgaagccgacuacuacugcggcaccuggcacuccucccucuccgccggcggcgucuucggcaccggcaccaaagucaccguccuc

SEQ ID NO: 54986 - RNA, 333 nt, Artificial Sequence
  derived and/or modified sequence opt11 from anti-HIV-1_LightChain
uccuacgaacucacccaaccccccuccgucuccgcagcccccggccaaaaagucaccaucuccugcuccggcuccuccuccaacaucggcaacaacuacgucuccugguaccaacaacuacccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 54987 - RNA, 333 nt, Artificial Sequence
  derived and/or modified sequence opt11 from anti-HIV-1_LightChain
caauccguccucacccaaccacccuccgccuccggcacccccggccaacgcgucaccaucuccugcuccggcuccaccuccaacaucggcaccuacuacgucuccugguaccaacaacuccccggcaccgcccccaaacuccucaucuacgaaaacaccaaacgccccuccggcauccccgaccgcuucuccggcuccaaauccggcaccuccgccacccucggcaucaccggccuccaaaccggcgacgaaggcgacuacuacugcggcaccugggaccgcucccuauccgccggcggcgucuucggcaccggcaccaaagucaccguccuc

SEQ ID NO: 54988 - RNA, 336 nt, Artificial Sequence
  derived and/or modified sequence opt11 from anti-HIV-1_LightChain
caauccgcccucacccaacccgccuccgucuccgccucccccggccaauccauagccaucuccugcaccggcaccuccuccgacgucggcuccuacaacuacgucuccugguaccaacaacuccccggcaccgcccccaaacuccucaucuacgaaaacaccaaacgccccuccggcauccccgaccgcuucuccggcuccaaauccggcaccuccgccacccucggcaucaccggccuacaaaccggcgacgaagccgacuacuacugcggcaccugggacagaucccucuccgccggcggcgucuucggcaccggcaccaaagucaccguccuc

SEQ ID NO: 54989 - RNA, 330 nt, Artificial Sequence
  derived and/or modified sequence opt11 from anti-HIV-1_LightChain
caauccguccucacccaaccccccuccgucuccgccgcccccggccaacgcgucaccaucuccugcuccggcggcuccuccaacaucggcaacaaccacgucuccugguaccaacaccuccccggccgcgccccccaacuccucaucuacgacaccacccaacgccccuccggcauccccgaccgcuucuccggcuccaaauccggcaccuccgccacccucggcaucaccggccuccaaaccggcgacgaagccgacuacuacugcggcaccugggacuccucccucuccaccggcggcgucuucggcaccggcaccaaagucaccguc

SEQ ID NO: 54990 - RNA, 333 nt, Artificial Sequence
  derived and/or modified sequence opt11 from anti-HIV-1_LightChain
caaucggucuugacccagcccccgagcgcgagcgggaccccgggccagcgcgugaccauaagcuguagcgggagcucgagcaauaucgggagcaaguacgugugcugguaccagcaauugcccgggaccgcgcccaagcucuugaucuaucgcaauaaccagcgcccgagcgggaucccggacagauucucgggcucgaaaucgggcacgagcgcgaccuugggcauaaccgggcuccagaccggggacgaggccgauuacuauugcgggaccuggcacagcucauugagcgcgggcggggucuuuggcacgggcacgaaagugaccgugcuc

SEQ ID NO: 54991 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcgacuccuccaccuucgaaaacgacuacgucugcugguaccaacaacuccccggcaccgcccccaaacuccucaucuacgacaacaacaaacgccccuccggcauccccgaccgcuucuccggcuccaaauccggcaccuccgccacccucggcaucaccggccuccaaaccggcgacgaagccgacuacuacugcggcaccuggcacuccucccucuccgccggcggcgucuucggcaccggcaccaaagucaccguccuc

SEQ ID NO: 54992 - RNA, 333 nt, Artificial Sequence
  derived and/or modified sequence opt11 from anti-HIV-1_LightChain
caauccguccucacccaaccccccuccgucucagccgcccccggccaaaaagucaccaucuccugcuccggcuccuccuccaacaucggcaacaacuacgucuccugguaccaacaacuccccggcaccgcccccaaacuacucaucuacggcaacucaaaccgccccuccggcguccccgaccgcuucuccggcuccaaauccggcaccuccgccucccucgccaucaccggccuccaagccgaagacgaagccgacuacuacugcggcaccugggacuccucccucuccgccggcggcgucuucggcaccggcaccaaagucaccguccuc

SEQ ID NO: 54993 - RNA, 333 nt, Artificial Sequence
  derived and/or modified sequence opt11 from anti-HIV-1_LightChain
caauccguccucacccaaccccccuccgucuccgccgcccccggccaaaccgucaccaucuccugcuccggcuccuccuccaacaucggcuccaacaccgucaacugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacaacucccucuccaccggcggcgucuucggcaccggcaccaaagucaccguccuc

SEQ ID NO: 54994 - RNA, 336 nt, Artificial Sequence
  derived and/or modified sequence opt11 from anti-HIV-1_LightChain
caauccguccucacacaaccccccuccgucuccggcgcccccggccaacgcgucaccaucuucugcaccggcuccuccuccaacgucggcggcggcuacgacguccacugguaccaacaacuccccggcaccgcccccaaacuccucaucuacgaaaacaacaaacgccccuccggcauccccgaccgcuucuccggcuccaaauccggcaccuccgccacacucggcaucaccggccuccaaaccggcgacgaagccgacuacuacugcggcaccugggacuccucccucuccgccggcggcgucuucggcaccggcaccaaagucaccguccuc

SEQ ID NO: 54995 - RNA, 333 nt, Artificial Sequence
  derived and/or modified sequence opt11 from anti-HIV-1_LightChain
caauccguccucacccaaccccccuccgucuccgccgcccccggccaaaaagucacccucuccugcuccggcuccuccuccaacaucggaaacaacuccgucuccugguaccaacaauuccccggcaccgcccccaaacuccuaaucuacgacuccgacaaacgccccuccggcauccccgaccgcuucuccggcuccaaaucaggcaccuccgccacccucggcaucaccggccuccaaaccggcgacgaaggcgacuacuacugcggcaccugggaccgcucccucuccgccggcggcgucuucggcaccggcaccaaagucaccguccua

SEQ ID NO: 54996 - RNA, 333 nt, Artificial Sequence
  derived and/or modified sequence opt11 from anti-HIV-1_LightChain
caauccguccucacccaaccccccuccgccuccggcacccccggccaaaaagucaccaucuccugcuccggcuccucaucccaaaucggcuccaacuccgucuacugguaccaacaacuccccggcaccacccccaaacuccucaucuacggcaacaaccaacgccccuccggcauccccgaccgcuucuccggauccaaauccggcaccuccgccacccucggcaucaccggccuccaaaccggcgacgaagccgacuacuacugcggcaccugggacucaucccucuccgccggcggcgucuucggcaccggcaccaaagucaccguccuc

SEQ ID NO: 54997 - RNA, 336 nt, Artificial Sequence
  derived and/or modified sequence opt11 from anti-HIV-1_LightChain
cagagcgcgcucacgcaaccggccucggucucgggcucgcccgggcaaucgaucacgaucucgugcacgggcacgggcucggacguaggcggguacaaucacgugagcugguaccagcaacaucccgggaaagcgcccaagcucuugaucuaugacaauaacaagcgcccgagcgggaucccggacagguucucgggcucgaaaucaggcacgagcgcgaccuugggcauaaccgggcuccagaccggggacgaggccgauuacuauugcgggaccuggcacucgagcuugagcgcgggcggggucuuuggcacgggcacgaaagugaccgugcuc

SEQ ID NO: 54998 - RNA, 333 nt, Artificial Sequence
  derived and/or modified sequence opt11 from anti-HIV-1_LightChain
caauccguccucacccaaccccccuccgucuccgccgcacccggccaacgcgucaccaucuccugcuccggcuccggcuccaacaucggcgaccgcuucgucuccugguaccaacaccuccccggcaccguccccaaacuccucaucuacgacaacgaacaccgacccuccggcauccccgaccgcuucuccggcucaaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 54999 - RNA, 333 nt, Artificial Sequence
  derived and/or modified sequence opt11 from anti-HIV-1_LightChain
caauccguccucacccaaccccccuccgucuccgccgcccccggccaaaaaaucaccaucuccugcuccggcuccuccuccaacaucggcaaauccgucgucuccugguaccgccaauuccccggcaccgcccccaaacuccucaucuacgacaccuacaaacgccccuccggcauccccgaccgcuucuccggcuccaaauccggcaccuccgccacccucggcaucaccggccuccaaaccggcgacgaagccgacuacuacugcggcaccuggcacuccucccucuccgccggcggcgucuucggcaccggcaccaaagucaccguccuc

SEQ ID NO: 55000 - RNA, 333 nt, Artificial Sequence
  derived and/or modified sequence opt11 from anti-HIV-1_LightChain
caacccguccucacccaacccccauccgccuccggcacccccggccaacgcgucaccaucucaugcuccggcuccuccuccaacaucggcggcaacaccgucaacugguaccaacaauuccccggcgccgccccccgccuccucaucuacgaagacaacaaacgacccuccggcauccccgaccgcuucuccggcuccaaaucaggcaccuccgccacccucggcaucaccggccuccaaaccggcgacgaagccgacuacuacugcggcaccugggacuccucccucuccgccggcggcgucuucggcaccggcaccaaaguaaccguccuc

SEQ ID NO: 55001 - RNA, 333 nt, Artificial Sequence
  derived and/or modified sequence opt11 from anti-HIV-1_LightChain
aacuucaugcucacccaaccccacuccgucuccgaaucccccggcaaaaccgucaccaucuccugcacccgcuccuccggcucagucgccuccaacuacguccaaugguaccaacaacuacccggcaccgcccccaaacuccucaucuacgaaaacaacaaacgccccuccggcauccccgaccgcuucuccggcuccaaauccggcaccuccgccacccucggcaucaccggccuccaaacaggcgacgaagccgacuacuacugcggcaccuggcacuccucccucuccgccggcggagucuucggcaccggcaccaaagucaccguccuc

SEQ ID NO: 55002 - RNA, 333 nt, Artificial Sequence
  derived and/or modified sequence opt11 from anti-HIV-1_LightChain
caauccaugcucacacaaccccccuccgucuccgcagcccccggccaacgcgucaccgucuccugcuccggcuccuccuccaacaucggcucccacuucgucuccugguaccaacaacuccccggcaccgcccccaaacuccucaucuacgacaacuccaaccgccccuccgccauccccgaccgcuucuccggcuccaaauccggcaccuccgccacccucggcaucuccggccuccacaccggcgacgaagccgacuacuacugcgccaccugggacaacucccucuccaccggcggcgucuucggcaccggcaccaaagucaccguccuc

SEQ ID NO: 55003 - RNA, 333 nt, Artificial Sequence
  derived and/or modified sequence opt11 from anti-HIV-1_LightChain
caauccguccucacccaacccccauccgucuccgccgcccccggccaaaaagucaucaucuccugcuccggcggcuccuccaacaucggcaacaacuucgucuccugguaccaccaacuccccggcaccgcccccaaacuccucaucuacgaaaacaccaaacgccccuccaaaauccccgcccgauucuccggcuccaaauccggcaccuccgccacccucggcaucaccggccuccaaaccggcgacgaagccgacuacuacugcggcaccugggacuccucccucucagccggaggcgucuucggcaccggcaccaaagucaccguccuc

SEQ ID NO: 55004 - RNA, 315 nt, Artificial Sequence
  derived and/or modified sequence opt11 from anti-HIV-1_LightChain
caaucccuccucacccaaccccccuccgucuccgccgcccccggccaaaaagucaccaucuccugcuccggcuccuccuccaacaucggcaacaacuacgucuccugguaccaacaacuccccggaaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggc

SEQ ID NO: 55005 - RNA, 336 nt, Artificial Sequence
  derived and/or modified sequence opt11 from anti-HIV-1_LightChain
caauccgcccucacccaacccgccuccgucuccggcucccccggccaauccaucaccaucuccugcaccggcaccuccuccgacaucggauccuacuccuucgucuccugguaccaacaacaccccggcaaagcccccaaacucaucaucuacgacgucaacaaacgccccuccggcauccccgaccgcuucuccggcuccaaauccggcaccuccgccacccuaggcaucaccggccuccaaaccggcgacgaagccgacuacuacugcggcaccugggaccgcucccucuccgccggcggcgucuucggcaccggcaccaaagucaccguccuc

SEQ ID NO: 55006 - RNA, 336 nt, Artificial Sequence
  derived and/or modified sequence opt11 from anti-HIV-1_LightChain
cagagcguacucacgcaaccgcccucggucucgggcgcgcccgggcaaagggucacgaucucgugcacgggcaauagcucgaacauaggcgcgggcuuugacgugcacugguacaggcaccuccccgggaccgcgcccaagcuguugaucuaugaaaauaccaagcgcccgagcgggaucccggacagauucucgggcucgaaaucgggcacgagcgcgaccuugggcauaaccgggcuccagaccggggacgaggccgauuacuauugcgggaccugggacaggagcuugagcgcgggcggggucuuuggcacgggcacgaaagugaccgugcuc

SEQ ID NO: 55007 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcggcuccuccaacaucggcaacuacuacgucuccugguaccuccaacuccccggcgccgcccccaaacuccucaucuacgacaccgacaaacgccccuccggcauccccgaccgcuucuccggcuccaaauccggcaccuccgcaacccucggcaucaccggccuccaaaccggcgacgaagccgacuacuacugcggcaccugggaccgcucccucuccgccggcggcgucuucggcaccggcaccaaagucaccguccuc

SEQ ID NO: 55008 - RNA, 333 nt, Artificial Sequence
  derived and/or modified sequence opt11 from anti-HIV-1_LightChain
caauccguccucacccgaccccccuccgucuccgccgcccccggccaaaaaguaaccaucuccugcuccggccgcuccuccaacaucggcaacaacuacgucuccugguaccaacaacuccccggcgccgcccccaaacuccucaucuacgaaaacaacaaacgccccuccggcauccccgaccgcuucucaggcucaaaauccggcaccuccgccacccucggcaucaccggccuccaaaccggcgacgaagccgacuacuacugcggcaccugggacuccucccucuccgccggcggcgucuucggcaccggcaccaaagucaccguacuc

SEQ ID NO: 55009 - RNA, 333 nt, Artificial Sequence
  derived and/or modified sequence opt11 from anti-HIV-1_LightChain
caauccguccucacccaaccccccuccgucuccgcagcccccggccaaaaagucaccaucuccugcuccggcaccaucuccaacaucggcgccaaccucgucuccugguaccgccaacuccccggcaccguccccaccguccucauccacgaaaacaacaaacgccccuccggaauccccgaccgcuucuccggcucaaaauccggcaccuccgccacccucggcaucaccggccuccaaaccggcgacgaagccgacuacuacugcggcaccuggcacuccucccucuccgccggcggcgucuucggcaccggcaccaaagucaccguacuc

SEQ ID NO: 55010 - RNA, 327 nt, Artificial Sequence
  derived and/or modified sequence opt11 from anti-HIV-1_LightChain
caauccguccucacccaaccccccuccgucuccgccgcccccggccaaaaagucaccaucuccugcuccggcuccuccuccaacaucggcaacaacuucgucuccugguaccaacaacuccccggaaccgcccccaaacuccucaucuacgaaaacaccaaacgccccuccggcauccccgaccgcuucuccggcuccaaauccggcaccuccgccacccucggcaucaccggccuccaaaccggcgacgaagccgacuacuacugcggcaccugggaccgcucccucuccgccggcggcgucuucggcaccggcaccaaagucacc

SEQ ID NO: 55011 - RNA, 333 nt, Artificial Sequence
  derived and/or modified sequence opt11 from anti-HIV-1_LightChain
caauccguccucacccaaucccccuccguauccgccgcccccggccaacgcgucaccaucuccugcuccggcggcuccuccaacaucggcuccaacgccgucuccugguaccaacaacuccccggcaccgcccccaaacuccucaucuacggcgacaccaugcgcccauccggcauccccgaccgcuucuccggcucaaaauccggcaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 55012 - RNA, 333 nt, Artificial Sequence
  derived and/or modified sequence opt11 from anti-HIV-1_LightChain
caauccguccucacccaaccccccuccgucucagccgcccccggccaacaagucaccaucuccugcuccggcaccaccuccaacaucggcaccaacuacgucuccugguaccaacaaaugccccccgccgcccccaaacuccucaucuacgacaacaaaaaacgccccuccgacauccccgaccgcuucuccggcuccaaaucaggcaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 55013 - RNA, 333 nt, Artificial Sequence
  derived and/or modified sequence opt11 from anti-HIV-1_LightChain
caauccgucgucacccaaucccccuccgccuccggcacccccggccaacgcgucaucaucuccugcuccggcuccuccuccaacaucggcaacaucuacgucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccuggcacuccucccucuccgccggcggcgucuucggcaccggcaccaaagucaccguccuc

SEQ ID NO: 55014 - RNA, 333 nt, Artificial Sequence
  derived and/or modified sequence opt11 from anti-HIV-1_LightChain
caauccguccucacccaaccacccuccauguccgccgcccccggccaaaaagucaccaucuccugcuccggcuccaccucaaucaucggcaacaacuacaucuccugguaccaacaacuccccggcaccgcccccaaacuccucaucuacgaagacaacaaacgccccuccggcauccccgaccgcuucuccggcuccaaauccggcaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 55015 - RNA, 336 nt, Artificial Sequence
  derived and/or modified sequence opt11 from anti-HIV-1_LightChain
caauccgcccucacccaaccccccuccgccucaggcucccgcggccaauccgucaucaucuccugcaccggcaccuccuccgacgucggcgucuacaaccuagucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccuggcacuccucccucuccgcaggcggcgucuucggcaccggcaccaaagucaccguccuc

SEQ ID NO: 55016 - RNA, 333 nt, Artificial Sequence
  derived and/or modified sequence opt11 from anti-HIV-1_LightChain
caaucaguccucacccaaccccccuccauguccgccgcccccggccaauccgucucuaucuccugcuccggcuccuccgacaacaucgaacgcaaccaagucaucuggcuccgccaaguccccggcgccgcccccaccguccucaucaucuucaacaaccgccgccccuccggcguccccgaccgcuucuccggcucccgcuccggcaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 55017 - RNA, 333 nt, Artificial Sequence
  derived and/or modified sequence opt11 from anti-HIV-1_LightChain
caauccguccucacccaaccccccuccgucuccgccgcccccggccaaaccgucaccaucuccugcuccggcuccuucuccaacaucgaaaccaacuacgucuccugguaccaacaacuccccggcaccgcccccaaacuccuaaucuacgaaaacaccaaacgccccuccggcauccccgaccgcuucuccggcuccaaauccggcaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 55018 - RNA, 333 nt, Artificial Sequence
  derived and/or modified sequence opt11 from anti-HIV-1_LightChain
caaucccuccucacccaaccacccuccgucuccgccgcccccggccaaaaagucaccaucuccugcuccggcucauccuccaacaucggcuccaaauacgucugcugguaccaacaacuccccggcaccgcccccaaacuccucaucuacgaaaacaccaaacgccccuccggcauccccgaccgcuucuccggcuccaaauccggcaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 55019 - RNA, 336 nt, Artificial Sequence
  derived and/or modified sequence opt11 from anti-HIV-1_LightChain
caauccgcccucacccaaccccgcuccgucuccggcucccccggccaauccgucaccaucuccugcaccggcaccaccuccgacgucggcggcuacaacuacgucucaugguaccaacaacuccccggcaccgcccccaaacuacucaucuacgaaaacaacaaacgccccuccggcauccccgaccgcuucuccggauccaaauccggcaccuccgccacccucggcaucaccggccuccaaaccggcgacgaagccgacuacuacugcggcaccugggacaacucccucuccaccggcggcgucuucggcaccggcaccaaagucaccguccuc

SEQ ID NO: 55020 - RNA, 333 nt, Artificial Sequence
  derived and/or modified sequence opt11 from anti-HIV-1_LightChain
caauccguccucacccaaccccccuccgucuccgccgcccccggccaacgcgucaccaucuccugcaccggcuucaccuccaacaucggccucaacuacgucuccugguaccaacaaguccccggcaccacccccaaacucgucaucuucgaaaacgaccgccgcuuccucggcauccccgaccgcuucuccggcuccaaauccggcgccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 55021 - RNA, 333 nt, Artificial Sequence
  derived and/or modified sequence opt11 from anti-HIV-1_LightChain
caauccguccucgcccaaccccccuccgucuccgccgcccccggccaaaaagucaccaucuccugcuccggccgcaccuccaacaucggcaacaacuacgucuccugguaccaacaacuccccggcaccgcccccaaacuccucaucuacgaaaacaacaaacgccccuccggcauccccgaccgcuucuccggcuccaaaucaggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 55022 - RNA, 333 nt, Artificial Sequence
  derived and/or modified sequence opt11 from anti-HIV-1_LightChain
caauccguccucacccaacccaccuccgucuccgccgcccccggccgcugggucaccguauccugcuccggcacccgcuccaacaucggcgaccacuccgucuccugguuccaacaccuccccggcgccgcccccaaacuccucaucuacgaaaacaacaaacgccccuccggcauccccgaccgcuucuccggcuccaaauccggcaccuccgccacccuaggcaucaccggccuccaaaccggagacgaagccgacuacuacugcggcaccugggacuccucccucuccaccggcggcgucuucggcaccggcaccaaagucaccguccuc

SEQ ID NO: 55023 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcuccuccuccaacaucggcgacaacuacgucuccugguaccaacaauuccccggcaccgcccccaaacuccucaucuccgaaaacaacaaacgccccuccggcauccccgaccgcuucuccggcuccaaauccggcaccuccgccacccuaggcaucaccggccuccaaaccggcgacgaagccgacuacuacugcggcaccugggacuccucccucuccgccggcggcgucuucggcaccggcaccaaagucaccguccuc

SEQ ID NO: 55024 - RNA, 333 nt, Artificial Sequence
  derived and/or modified sequence opt11 from anti-HIV-1_LightChain
caagcccuccuaacccaaccccccuccgucuccgccgcccccggccaaaaagucaccaucuccugcuccggcuccuccucaaacaucggcaacaacuacgucuccugguaccaacaacuccccggcaccgcccccaaacuccucaucuccgaaaacaacaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 55025 - RNA, 333 nt, Artificial Sequence
  derived and/or modified sequence opt11 from anti-HIV-1_LightChain
caacucguccucacccaaccccccuccgccuccggcacccccggccaacgcgucaccaucuccugcuccggcuccaccuccaacaucggcaccuacuacgucuacugguaccaacuccuccccggcaccacccccaaaguccuaaucuacgccaacgaccaacgccccuccggcauccccgaccgcuucucaggcuccaaauccggcaccuccgccacccucggcaucaccggccuccaaaccggcgacgaagccgacuacuacugcggcaccugggacuccucccucuccaccggcggcgucuucggaaccggcaccaaagucaccguccuc

SEQ ID NO: 55026 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcaccuccuccaacaucggcaacaacuucgucucaugguaccaacgccuccccggcaccgcccccaaacuccucaucuucgaaaacgacaaacgccccuccggcauccccgaccgauucuccggcuccaaaucaggcaccuccgccacccuaggcaucaccggccuccaaaccggcgacgaagccgacuacuacugcggcaccugggaccgcucccucuccgccggcggcgucuucggcaccggcaccaaagucaccguccuc

SEQ ID NO: 55027 - RNA, 333 nt, Artificial Sequence
  derived and/or modified sequence opt11 from anti-HIV-1_LightChain
caauccguccucacccaaucccccuccgucuccgccacccccggccaacgcgucaccaucuccugcuccggcaacaccuccaacaucggcaaaaacuucgucuccugguaccaacaauuccccggcaccgcccccaaacuccucaucuacgacaacgacaaacgccccucaggcauccccgaccgcuucucaggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 55028 - RNA, 333 nt, Artificial Sequence
  derived and/or modified sequence opt11 from anti-HIV-1_LightChain
caauccguccucacccaaccacccuccgucuccgccgcccccggccgcgaagucaucaucuccugcuccggcuccuccuccaacaucggcaacaaccacgucuccugguaccaacaacuccccggcaccgcccccaaaguccucaucuacgaauccaacaaacgccacuccggcauccccgaccgcuucuccggcuccaaauccggcaccuccgccacccucgccaucaccggccuccaaaccggcgacgaagccgacuacuacugcggcgccugggacuccucccucuccgccggcggcgucuucggcaccggcaccaaagucaccguccuc

SEQ ID NO: 55029 - RNA, 333 nt, Artificial Sequence
  derived and/or modified sequence opt11 from anti-HIV-1_LightChain
caauccguccucacccaaccccccuccgccuccggcacccccggccaacgcgucaccaucuccugcuccggcuccuccuccaacaucggcgacuccaccgucaacugguaccaacaacuacccggcaccgcccccaaacuccucaucuacgaaaacaccaaacgccccuccggcauccccgaccgcuucuccggcuccaaauccggcaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 55030 - RNA, 333 nt, Artificial Sequence
  derived and/or modified sequence opt11 from anti-HIV-1_LightChain
caaucaguccucacccaaccccccuccgucuccgccgcccccggccaaaaagucaccaucuccugcuccggcuccaccuccaacaucggcaacaacuacgucuccugguaccaacaacuccccggcaccgcccccaaacuccucaucuacgaaaacaaccgccaacccuccggcauccccgaccgcuucuccggcuccaaauccggcaccuccgccacccucggcaucaccggccuccaaaccggcgacgaaggcgacuacuacugcggcaccugggaccgcucccucuccgccggcggcgucuucggcaccggcaccaaagucaccguccuc

SEQ ID NO: 55031 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcuccuccuccaacaucggcuccaacuacgucuccugguaccaacaacuccccggcaccgcccccaaacuccucaucuacgaaaacaacaaacgccccuccggcauccccgaccgcuucuccggcucaaaauccggcaccuccgccacccucggcaucaccggccuccaaaccggcgacgaagccgucuacuacugcggcaccugggacuccucccucaccgccggcggcgucuucggcuccggcaccaaagucaccguccuc

SEQ ID NO: 55032 - RNA, 336 nt, Artificial Sequence
  derived and/or modified sequence opt11 from anti-HIV-1_LightChain
caauccguccucacccaaccccccuccgucuccggcgcccccggacaacgcgucaccaucuccugcaucggcuccuccuccaacaucggcgccgacuaccgcguccacugguaccaacaacuccccggcaccgcccccaaacuccucaucuacgaaaacaacaaacgccccuccggcauccccgaccgcuucucaggcuccaaauccggcaccuccgccacccuaggcaucaccggccuccaaaccggcgacgaagccgacuacuacugcggcaccugggacuccucccucuccaccggcggcgucuucggcaccggcaccaaagucaccguccuc

SEQ ID NO: 55033 - RNA, 336 nt, Artificial Sequence
  derived and/or modified sequence opt11 from anti-HIV-1_LightChain
caauccguccucacccaaccccccuccgucuccggcgcccccggccaacgcaucaccgucuccugcaccggcaccuccuccaacaucggcgcccccuacgacgucaacugguaccaacaacuccccggcaccgcccccaaacuccucaucuacgaaaacaccaaacgccccuccggcauccccgaccgcuucuccggcuccaaauccggcaccuccgccacccucggcaucaccggacuccaaaccggcgacgaagccgacuacuacugcggcaccugggaccgcucccucuccgccggaggcgucuucggcaccggcaccaaagucaccguccuc

SEQ ID NO: 55034 - RNA, 333 nt, Artificial Sequence
  derived and/or modified sequence opt11 from anti-HIV-1_LightChain
caaucaguccugacccagcccccggccaugagcgcagccccaggccaaagcguaaccauaagcugcagcggaagcgcauucaacaucgaacgccaccaagugaccuggcucagacaccuacccgggaccgcacccacaagcguaaucauaaugaacaaccaacgcccaagcggagucccggacagauucucaggcucacgcucaggcacaagcgcaacccugggcauaaccggacuccaaaccggagacgaaggcgacuacuacugcggaaccugggacagaagccuaagcgcaggcggagucuucggcacaggcacaaaaguaaccguacuc

SEQ ID NO: 55035 - RNA, 333 nt, Artificial Sequence
  derived and/or modified sequence opt11 from anti-HIV-1_LightChain
caaucaguccucgcccaaccccccuccgccuccggcacccccggccaacgcgucaccaucuccugcuccggcuccgccuccaacaucggcuucaacuccgucaccugguaccaacaacuccccggcaccgcccccaccguccucaucuacggcaacgaccuccgccccuccggcauccccgaccgcuucuccggcuccaaauccggcaccuccgccacccucggcaucaccggccuccaaaccggagacgaaggcgacuacuacugcggcaccugggaccgcucccucuccgccggcggcgucuucggcaccggcaccaaagucaccguccuc

SEQ ID NO: 55036 - RNA, 336 nt, Artificial Sequence
  derived and/or modified sequence opt11 from anti-HIV-1_LightChain
cagagcgcgcucacgcaaccggccucggucucgggcucgcccggggaaucgaucacgaucucgugcacgggcacgcgcucggacauaggcaauuacgcguacgugagcugguaccagcaauuacccgggaccgcgcccaagcucuugaucucggaaaauaacaagcgcccgagcgggaucccggacagguucucaggaucgaaaucgggcacgagcgcgaccuugggcauaaccgggcuccagaccggggacgaggccgauuacuauugcgggaccugggacucgagcuugagcgcgggcggggucuuuggcacgggcacgaaagugaccgugcuc

SEQ ID NO: 55037 - RNA, 333 nt, Artificial Sequence
  derived and/or modified sequence opt11 from anti-HIV-1_LightChain
caauccguccucacccaaccccccuccgucuccgccccccccggccaaaaagucaccaucuccugcuccggcaccaccuccaacaucggcuccaacuacgucgccugguaccaacaacuccccggcaccgcccccaaacuccucaucuacgacaacgacaaacgccccuccggcauccccgaccgcuucuccggcuccaaauccggcaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 55038 - RNA, 333 nt, Artificial Sequence
  derived and/or modified sequence opt11 from anti-HIV-1_LightChain
caauccguccucacccaaucccccuccgucuccggcacccccggccaacgcgucaccaucuucugcuccggcuccgacuccgacaucggcaucaacuccgucuccugguaccaacaacuccccggcaccgcccccaaacuccucaucuacgacaacaacaaacgccccuccggcauccccgaccgcuucucaggcuccaaauccggcaccuccgccacccucggcaucaccggccuccaaaccggcgacgaagccgacuacuacugcggcaccugggaccgcucccucuccgccggcggcgucuucggcaccggcacaaaagucaccguccuc

SEQ ID NO: 55039 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcaacuccuccaacaucggcaacaacuacgucuccugguaccaacaccuccccggcaccgcccccaaacuccucaucuacgaaaacaccaaacgccccuccggcauccccgaccgcuucuccggcuccaaauccggaaccuccgccacccucggcaucaccggccuacaaaccggcgacgaagccgacuacuacugcggcaccugggaccgcucccucuccgccggcggcgucuucggcaccggcaccaaagucaccguccuc

SEQ ID NO: 55040 - RNA, 333 nt, Artificial Sequence
  derived and/or modified sequence opt11 from anti-HIV-1_LightChain
caaucccuccucacccaaccccccuccgucuccgccgcacccggccaaaaagucaccaucuccugcuccggcggcaacuccgacaucggcaaaaacuucgucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacaacucccucuccaccggcggcgucuucggcaccggcaccaaagucaccguccuc

SEQ ID NO: 55041 - RNA, 333 nt, Artificial Sequence
  derived and/or modified sequence opt11 from anti-HIV-1_LightChain
caauccguccucacccaaccccccuccgucuccgccgcccccggccaaaaagucaucaucuccugcuccggcuccucauccaacaucggcaaaaacuacgucgccugguaccaacaacuccccggcaccgcccccaaacuccucgucuacgaaaacaccaaccgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 55042 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcuccauguccgacaucggccucaaccccgucuccugguaccgccaacuccccgaagcccccccccaccuccucaucuucgacaacgacgaacgccccuccggcaccgccggccgcuucuccgccuccaaauccggcaccuccgccacccucgacaucaccggccuccaaaccggcgacgaagccgacuacuacugcggcaccugggacuccucccucuccgccggcggcgucuucggcaccggcaccaaagucaccguccuc

SEQ ID NO: 55043 - RNA, 336 nt, Artificial Sequence
  derived and/or modified sequence opt11 from anti-HIV-1_LightChain
cagagcgcgcucacgcaaccggccucggucucgggcucgcccgggcaaucgaucacgaucucgugcacgggcacgagcucggacgugggcucguacaaucucgugagcugguaccagcaauaucccgggcgagcgcccaagcuccugaucuaugaaaauaacaagcgcccgagcgggaucccggacagguucucgggcucgaaaucgggcacgagcgcgaccuugggcauaaccgggcuccagaccggggacgaggccgauuacuauugcgggaccugggacaauagccugagcacgggcggggucuuuggcacgggcacgaaagugaccgugcuc

SEQ ID NO: 55044 - RNA, 333 nt, Artificial Sequence
  derived and/or modified sequence opt11 from anti-HIV-1_LightChain
caaucccuccucacccaaccccccuccgucuccgccucccccggccaaaaagucaccaucuccugcuccggaaccuccuccaacaucggcaacaacuacgucuccugguaccaacaauuccccggcaccgcccccaaacuccuaaucuacgaaaacaacaaacgcuccuccggcauccccgaccgcuucuccggcuccaaauccgacaccuccgccacccucggcaucaccggacuccaaaccggcgacgaagccgacuacuacugcggcaccugggaccgcucccucuccgccggcggcgucuucggcaccggcaccaaagucaccguccuc

SEQ ID NO: 55045 - RNA, 336 nt, Artificial Sequence
  derived and/or modified sequence opt11 from anti-HIV-1_LightChain
cagagcgugcucacgcaaccgcccucggucucgggcgcgcccgggcaaagggucacgaucucgugcacgggcaggcgcucgaacauaggcgcgggcuaugacgugcacugguaccagcaauugcccgggaccgcgcccaagcucuugaucuaugaaaauaacaagcgcccgagcgggaucccggacagguucucgggcucgaaaucgggcacgagcgcgaccuugggcauaaccgggcuccagaccggggacgaggccgauuacuauugcgggaccugggacacgagcuugagcgcgggcggggucuuuggcacgggcacgaaagugaccgugcuc

SEQ ID NO: 55046 - RNA, 333 nt, Artificial Sequence
  derived and/or modified sequence opt11 from anti-HIV-1_LightChain
caauccguccucacccaaccccccuccgucuccgccgcccccggccaacgcgucaccaucuccugcuccggcuccuccuccaacaucggcaacaacuucgucuccugguaccaauucuuccccggcaccgcccccaaacucgucaucuacgaaaacgacaaacgccccuccggcacccccgaccgcuucucaggcuccaaauccggcaccuccgccacccucgccaucaucggccuccaaaccggcgacgaaggcgacuacuacugcggcaccugggacaacucccucuccaccggcggcgucuucggcaccggcaccaaagucaccguccuc

SEQ ID NO: 55047 - RNA, 333 nt, Artificial Sequence
  derived and/or modified sequence opt11 from anti-HIV-1_LightChain
caauccguccucacccaaccccccuccgucuccgccgcccccggccaacgcgucaccaucuccugcuccggcggcuccuccaacaucggcaacaaccacgucuccugguaccaacaacuccccggcaccgcccccaaacuccucaucuccgaaaacaacaaacgccccuccggcauccccgaccgcuucuccggcucaaaauccggcaccuccgccacccucggcaucaccggccuccaaaccggcgacgaagccgacuacuacugcggcaccugggacuccucccuauccgccggcggagucuucggcaccggcaccaaagucaccguccuc

SEQ ID NO: 55048 - RNA, 333 nt, Artificial Sequence
  derived and/or modified sequence opt11 from anti-HIV-1_LightChain
caauccguccuaacccaaccccccuccgucuccgccgcccccggccaaaaagucaccaucuccugcuccggcuccuccucaaacaucggccgcgacuucgucuccugguaccaacaaguccccggcaccgcccccaaacuccucaucuacgacaacgacaaacgccccuccggcauccccgaccgcuucuccggcuccaaauccggcaccuccgccacacucggcaucaccggacuccaaaccggcgacgaagccgacuacuacugcggcaccugggacuccucccucuccgccggcggcgucuucggcaccggcaccaaagucaccguccuc

SEQ ID NO: 55049 - RNA, 336 nt, Artificial Sequence
  derived and/or modified sequence opt11 from anti-HIV-1_LightChain
cagaccgugguaacgcaaccgcccucggucucgggcgcgcccgggcaaacggccacgaucucgugcacgggcucgagcucgaacauaggcgcggacuaugacgugcacugguaccagcaacugcccgggaccgcgcccaagcucuugaucuaugacaauaacaagcgcccaagcgggaucccggacagguucucgggcucgaaaucgggcacgagcgcaaccuugggcauaaccgggcuccagaccggggacgaggccgauuacuauugcgggaccugggacaggagcuugagcgcgggcggggucuuuggcacgggcacgaaagugaccgugcuc

SEQ ID NO: 55050 - RNA, 333 nt, Artificial Sequence
  derived and/or modified sequence opt11 from anti-HIV-1_LightChain
aacuucaugcucacccaaccccccuccgccuccggcacccccggccaacgcgucaccaucuccugcuccggcuccuccucaaacaucggcuccaacuacgucuacugguaccaacaacuccccggcaccacccccaaacuccucaucuaccgcaacaaccaacgccccuccggaauccccgaccgauucuccggcuccaaauccggcaccuccgccacccucggcaucaccggccuccaaaccggcgacgaagccgacuacuacugcggcaccugggacuccucccucuccgccggcggcguauucggcaccggcaccaaagucaccguccuc

SEQ ID NO: 55051 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcuccucccccaacaucggcaacaacuuccucuccugguaccaacaacuccccggcaccgcccccaaacuccucaucuacgaaaacaccaaacgccccuccggcauccccgaccgcuucuccggcuccaaauccggcaccuccgccacccucggcaucacaggccuccaaaccggcgacgaagccgacuacuacugcggcaccugggaccgcucccucuccgccggcggcgucuucggcaccggcaccaaagucaccguccuc

SEQ ID NO: 55052 - RNA, 333 nt, Artificial Sequence
  derived and/or modified sequence opt11 from anti-HIV-1_LightChain
caauccguccucacccaaucccccuccguauccgccgcacccggccaaaaagucaccaucuccugcuccggcuccuccuccgacaucggcaacaacuucguauccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacucaucccucuccgccggcggcgucuucggcaccggcaccaaagucaccguccuc

SEQ ID NO: 55053 - RNA, 333 nt, Artificial Sequence
  derived and/or modified sequence opt11 from anti-HIV-1_LightChain
caauucuuccucacccaaccccccucccucuccgccacccccggccaacgcgucuccaucuccugcuccggcggcggcuccaacaucgccaacaacgacgucuucugguuccaacaauuccccggcgccggcccccgccuccucaucuacgacaaccucaaacgccacuacggcacccccgaccgcuucuccggcuccaaauccggcaccuccgccacccucggcaucaccggccuccaaaccggcgacgaagccgacuacuacugcggcaccugggacaacucccucucaaccggcggcgucuucggcaccggcaccaaagucaccguccuc

SEQ ID NO: 55054 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcuccggacccaacaucggcuccaacuccgucuccugguaccaacacuuccccggcaccgcccccaaacuccuaaucuacgacaacaacaaacgccccuccggcauccccgaccgcuucuccggcuccaaauccggcaccuccgccacccucggcaucaccggccuccaaaccggcgacgaagccgacuacuacugcggaaccugggaccgcucccucuccgccggcggcgucuucggcaccggcaccaaagucaccguccuc

SEQ ID NO: 55055 - RNA, 333 nt, Artificial Sequence
  derived and/or modified sequence opt11 from anti-HIV-1_LightChain
caauccguccucacacaaucccccuccgccuccggcacccccggccaacgcgucaccaucuccugcuccggcuccuccuccaacaucggcuccaacaccgucuccugguuccaacaccuacccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccuggcacuccucccuauccgccggcggcgucuucggcaccggcaccaaagucaccguccuc

SEQ ID NO: 55056 - RNA, 333 nt, Artificial Sequence
  derived and/or modified sequence opt11 from anti-HIV-1_LightChain
caauccguccucacccaaccccccuccgucuccggcgcccccggccaaaacgucaucaucuccugcuccggcuccuccuccaacaucggcaaaaacuacguagccugguaccaacaacuccccggcaccgcccccaaaaucgucaucuacgaaaccaccaaccgccccuccggcauccccgcccgcuucuccggcuccaaauccggcaccuccgccacccucggcaucaccggccuccaagccggcgacgaagccgacuacuacugcggcaccugggacucaucccucaacgccggcggcgucuucggcaccggcaccaaagucaccguccuc

SEQ ID NO: 55057 - RNA, 333 nt, Artificial Sequence
  derived and/or modified sequence opt11 from anti-HIV-1_LightChain
caauccguccucacccaaccacccuccgucuccgccgcccccggccaaaaagucaccaucuccugcuccggcuccuccuccaacaucggcaacaacuuccucuccugguaccaacaccuccccggcaccgccccccgccuacucaucuacgacaacgaccaacgccccuccggcauccccgaccgcuucuccggcuccaaauccggcaccuccgccacccucggcaucaccggccuccaaaccggcgacgaagccgacuacuacugcggcaccuggcacuccucccucuccgccggcggcgucuucggcaccggcaccaaagucaccguccuc

SEQ ID NO: 55058 - RNA, 333 nt, Artificial Sequence
  derived and/or modified sequence opt11 from anti-HIV-1_LightChain
caauccguccucacccaaccccccuccgccuccggcacccccggccaaaaagucaccaucuccugcuccggcuccuccuccaacaucggcaacaacuacgucuccugguaccaacaacuccccggcaccgcccccaaacuccucaucuacgaaaacaacaaacgccccuccggcauccccgaccgcuucuccggcuccaaauccggcaccuccgccacccucggcaucacaggccuccaaaccggcgacgaagccgacuacuacugcggcaccugggacuccucccucuccaccggcggcgucuucggcaccggcaccaaagucaccguccuc

SEQ ID NO: 55059 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcaccaccuccaacaucggcaaccacuacgucucaugguaccaacaauuccccggcaccgcccccaaacucaucaucuacgaaaccgaccgccgccccuccggcauccccgcccgcuucuccggcuccaaauccggcaccuccgccacccucgccaucgccggccuccaaaccggcgacgaagccgacuacuacugcggcaccugggacuccucccucuccaccggcggcgucuucggcaccggcaccaaaguaaccguacuc

SEQ ID NO: 55060 - RNA, 333 nt, Artificial Sequence
  derived and/or modified sequence opt11 from anti-HIV-1_LightChain
caacucguccucacccaaccccccuccgucuccgcagcccccggccaaaaagucaccaucuccugcuccggcuccuccuccaacaucggcaacaacuacgucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacuccucccucucaaccggcggcgucuucggcaccggcaccaaagucaccguccua

SEQ ID NO: 55061 - RNA, 333 nt, Artificial Sequence
  derived and/or modified sequence opt11 from anti-HIV-1_LightChain
caauccguccucacccaacccccauccgucuccgccgcccccggccaacgcgucaccaucucaugcuccggcggcuccuccaacaucggcaacaaccacgucuccugguaccaacaccuccccggccgcgccccccaacuccucaucuacgacaccacccaacgccccucccgcauccccgaccgcuucuccggcuccaaauccggcaccuccgccacccucggcaucaccggccuccaaaccggcgacgaagccgacuacuacugcggcaccugggacaacucccucuccaccggcggcgucuucggcaccggcaccaaagucaccguccuc

SEQ ID NO: 55062 - RNA, 333 nt, Artificial Sequence
  derived and/or modified sequence opt11 from anti-HIV-1_LightChain
caauccguccucacccaaccccccuccgucuccgccgcccccggccaaaaaaucaccaucuccugcuccggcucccgcuccaacaucggcaacaacuacgucuccugguaccaacaauuccccggcaccgcccccaaacuccucaucuacgacaacaaccaacgcccaucccgcauccccgaccgcuucuccggcucaaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 55063 - RNA, 321 nt, Artificial Sequence
  derived and/or modified sequence opt11 from anti-HIV-1_LightChain
caauccguccucacccaaccccccuccgucuccgccgcccccggccaacgcgucaccaucuccugcuucggcucccgcuucuccuccgucuccugguaccaacaacuccccggcaccgcccccaaacuccucaucuaccccaacggcgaacgccccuccggcauccccgaccgcuucuucggcuccgaauccggcaccuccgccacccucggcaucaccggccuccaaaccggcgacgaagccgacuacuacugcgccaccugggacuccucccucuccgccggcggcgucuucggcaccggcaccaaacucaccguccuc

SEQ ID NO: 55064 - RNA, 333 nt, Artificial Sequence
  derived and/or modified sequence opt11 from anti-HIV-1_LightChain
caauccguccucacccaaccccccucccucuccgccgcccccggccaaaaagucaccaucuccugcuccggcuccucccucaacaucggcaaccacuacgucuccugguaccaacaaguccccggcaccgcccccaaacuccucaucuacgaagacaacaaacgccccuccggcauccccgaccgcuucuccggcuccaaauccggcaccuccgccacccucggaaucaccggccuccaaaccggcgacgaagccgacuacuacugcggcaccuggcacucaucccucuccgccggcggcgucuucggcaccggcaccaaagucaccguacuc

SEQ ID NO: 55065 - RNA, 333 nt, Artificial Sequence
  derived and/or modified sequence opt11 from anti-HIV-1_LightChain
caauucguccucacccaaccccccuccgucuccgccgcccccggccaaaaagucaccgucuccugcuccggcaccaccuccgacaucggcgaaaacuacgucuccugguaccaaaaauuccccgaagccgcccccaaacuccucaucuacgacaacgacaaacgccccucaggcauccccgaccgcuucuccggcuccaaauccggcaccuccgccacccucggcaucaccggccuccaaaccggcgacgaagccgacuacuacugcggcaccugggaccgaucccucuccgccggcggcgucuucggcaccggcaccaaagucaccguccuc

SEQ ID NO: 55066 - RNA, 333 nt, Artificial Sequence
  derived and/or modified sequence opt11 from anti-HIV-1_LightChain
cucuccguccucacccaaccccccuccgucuccgccgcccccggccaacaagucaccaucuccugcuccggcaccaccuccaacaucggcaccaacuacgucuccugguaccaacaaaugccccccaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 55067 - RNA, 336 nt, Artificial Sequence
  derived and/or modified sequence opt11 from anti-HIV-1_LightChain
caaucaaugcucacccaaccacccuccgucuccggcgcccccggccaacgcgucaccaucuccugcaccggcucccgcuccaacaucggcgccggcuacgacguccacugguaccuccaacuccccggcaccgcccccaaacuacucaucuacgaaaacaacaaacgccccuccggcauccccgaccgcuucuccggcuccaaauccggcaccuccgccacccucggcaucaccggccuccaaaccggagacgaagccgacuacuacugcggcaccugggacaacucccuauccaccggcggcgucuucggcaccggcaccaaagucaccguccuc

SEQ ID NO: 55068 - RNA, 333 nt, Artificial Sequence
  derived and/or modified sequence opt11 from anti-HIV-1_LightChain
caaucaguccucacccaaccacccuccgucuccgccacccccggccaaaaagucaccaucuccugcuccggcucccgcuccaacaucggcucccacuacgucuccugguaccaacaauuccccgaauccgcccccacccuccucaucuacgaaaacgucgaacgccccuccggcauccccgaccgcuucuccggcuccaaauccggcaccuccgccacccucggcaucaccggccuccaaaccggcgacgaagccgacuacuacugcggcaccugggacuccucacucuccgccggcggcgucuucggcaccggcaccaaagucaccguccuc

SEQ ID NO: 55069 - RNA, 333 nt, Artificial Sequence
  derived and/or modified sequence opt11 from anti-HIV-1_LightChain
caauucuuccucacccaaccccccucccucuccgccacccccggccaacgcgucuccaucuccugcuccggcggcggcuccaacaucgccaacaacgacgucuucugguuccaacaauuccccggcgccggcccccgccuccucaucuacgacaaccucaaacgccacuacggcacccccgaccgcuucuccggcuccaaauccggcgccaccggaacccucgaaaucaccgaaguccaaaccgccgacgaagccgacuacuacugcggcaccugggacuccucccucuccgccggcggcgucuucggcaccggcaccaaagucaccguccuc

SEQ ID NO: 55070 - RNA, 333 nt, Artificial Sequence
  derived and/or modified sequence opt11 from anti-HIV-1_LightChain
caauccguccucacccaaccccccucagucuccgccgcccccggccaaaaagucaccaucuccugcuccggcggcuccuccaacaucggcgacaacuccgucuccugguaccaacaacuccccggcaccgcccccaaacuccucaucuacgaaaacaacaaacgccccuccggcauccccgaccgauucuccggcuccaaauccggcaccuccgccacccucggcaucaccggccuccaaaccggcgacgaagccgacuacuacugcggcaccugggacuccucccucuccaccggcggcgucuucggcaccggcaccaaagucaccguccuc

SEQ ID NO: 55071 - RNA, 333 nt, Artificial Sequence
  derived and/or modified sequence opt11 from anti-HIV-1_LightChain
caaucggucuugacccagcccccgagcgugagcgcggccccgggccagaccgugaccauaagcuguagcgggagcgcgagcaauaucgggcgcaauagcgugagcugguaccaguacgugcccggggccgcgcccaagcgcuugaucuaugaaaauaacaagcgcccgagcgggaucccggacagguucucgggcucgaaaucaggcacgagcgcgaccuugggcauaaccgggcuccagaccggggacgaggccgauuacuauugcgggaccugggacacgagcuugagcgcgggcgggguauuuggcacgggcacgaaagugaccgugcuc

SEQ ID NO: 55072 - RNA, 333 nt, Artificial Sequence
  derived and/or modified sequence opt11 from anti-HIV-1_LightChain
caauccguccucgcccaaccccccuccgucuccgccgcccccggccaaaaagucaccaucuccugcuccggccgcaccuccaacaucggcaacuacuucgucuccugguaccaacaauuccccggcaccgccccccgccuccucaucuacgacaacgaccaacgccccuccggcauccccgaccgcuucuccggcuccaaauccggcaccuccgccacccucggcaucaccggccuccaaaccggcgacgaagccgacuacuacugcggcaccugggacuccucccucucagccggcggcgucuucggcaccggcaccaaagucaccguccuc

SEQ ID NO: 55073 - RNA, 333 nt, Artificial Sequence
  derived and/or modified sequence opt11 from anti-HIV-1_LightChain
caauccgcccucacccaacccgccuccgucuccgccgcccccggccaaaaagucaccaucuccugcuccggcuccuccuccaacaucggcaacaucuacgucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccuggcacuccucccucuccgccggcggcgucuucggcaccggcacaaaagucaccguccuc

SEQ ID NO: 55074 - RNA, 333 nt, Artificial Sequence
  derived and/or modified sequence opt11 from anti-HIV-1_LightChain
caauccguccucacccaaccccccuccgucuccgccacccccggccaacgcgucaccgucuccugcuccggcuccuccuccaacaucggcaaccacuacguauccugguaccaacaaguccccggcaccgcccccaaacuccucaucuacgacaacuccaaccgacccucaggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 55075 - RNA, 333 nt, Artificial Sequence
  derived and/or modified sequence opt11 from anti-HIV-1_LightChain
caauccguccucacccaaccccccucccucuccgccgcccccggccaacgcgucacagucuccugcuccggcuccuccuccaacaucggcgacaacuacgucuccugguaccaacaacuccccggcgccgccccccgccuccucaucuacgacaacuccauccgccccuccgccauccccgcccgcuucuccggcuccaaauccggcaccuccgccacccucgcaaucaccggccuccaaaccggcgacgaagccgacuacuacugcggcaccugggacuccucccucuccgccggcggcgucuucggcaccggcaccaaagucaccguccuc

SEQ ID NO: 55076 - RNA, 336 nt, Artificial Sequence
  derived and/or modified sequence opt11 from anti-HIV-1_LightChain
caauccgcccucacccaacccgccuccguaucaggcucccccggccaauccaucaccaucucaugcaccggcaccuccuccgacgucggcggcuacgacuacgucuccugguaccuccaacuccccggcaccgcccccaaacuccucaucuacgaaaacaacaaacgccccuccggcauccccgaccgcuucuccggcuccaaauccggcaccuccgcaacccucggcaucaccggccuccaaaccggcgacgaagccgacuacuacugcggcaccugggacuccucccucuccgccggcggcgucuucggcaccggcaccaaagucaccguccuc

SEQ ID NO: 55077 - RNA, 333 nt, Artificial Sequence
  derived and/or modified sequence opt11 from anti-HIV-1_LightChain
caaucaguccucacacaaccccccuccgucuccgccgcccccggccaacgcgucaccgucuccugcuccggcuccuccuccaacaucggcaacaacuacgucuccugguaccaacaauuccccggcaccgcccccaaacucgucaucuacgacaccgacaaacgccccuccggcauccccgaccgcuucuccggcuccaaauccggcaccuccgccacccucggcaucaccggccuccaaaccggcgacgaagccgacuacuacugcgccaccugggacuccucccuauccgccggcggcgucuucggcaccggcaccaaaguaaccguccuc

SEQ ID NO: 55078 - RNA, 336 nt, Artificial Sequence
  derived and/or modified sequence opt11 from anti-HIV-1_LightChain
cagagcgugcucacgcaaccgcccucggucucgggcgcgcccgggcaaagggucacgaucucgugcacgggcaauagcucgaacauaggcgcgggcuaugacgugcacugguaccagcaauugcccgggaccgcgcccaagcucuugaucucggaaaauaacaagcgcccgagcgggaucccggacagguucucgggcucgaaaucgggcacgagcgcgaccuugggcauaaccgggcuccagaccggggacgaggccgauuacuauugcgggaccugggacucgagcuugagcgcgggcggggucuuuggcacgggaacgaaagugaccgugcuc

SEQ ID NO: 55079 - RNA, 333 nt, Artificial Sequence
  derived and/or modified sequence opt11 from anti-HIV-1_LightChain
caauccguccucacccaaccccccuccgccuccggcacccccggccaacgcgucacaaucuccugcuccggcuccuccucaaacaucggcuccaacuacgucgacugguaccaacaacuccccggcaccgcccccaaacuccucaucuacgaaaacaacaaacgccccuccggcauccccgaccgcuucuccggcuccaaauccggcaccuccgccacccucggcaucaccggccuccaaacaggcgacgaagccgacuacuacugcggcaccuggcacuccucccucuccgccggcggcgucuucggcaccggcaccaaagucacaguccuc

SEQ ID NO: 55080 - RNA, 333 nt, Artificial Sequence
  derived and/or modified sequence opt11 from anti-HIV-1_LightChain
caaucaguccuaacccaaccacccuccgucuccgccacccccggccaaaccgucaccaucuccugcuccggcuccuccucaaacaucggcaacaacuaccucuccugguaccgccaacuaccccgcaccgcccccaaacuccucaucuacgaaaacaaccgccgccccuccggcguccccgcccgcuucuccggcuccaaauccggaaccuccgccacccucgcaaucaccggccuccaaaccggcgacgaagccgacuacuacugcggcaccugggacuccucacuauccgccggcggcgucuucggcaccggcaccaaagucaccguccuc

SEQ ID NO: 55081 - RNA, 321 nt, Artificial Sequence
  derived and/or modified sequence opt11 from anti-HIV-1_LightChain
caauccguccucacccaaccccccuccgucuccgccgcccccggccaacgcgucaccaucuccugcuucggcucccgcuucuccuccgucuccugguaccaacaacuccccggcaccgcccccaaacuccucaucuaccccaacggcgaacgccccuccggcauccccgaccgcuucuucggcuccgaauccggcaccuccgccacccucggcaucaccgccguccaaaccggcgacgaagccgacuacuacugcggcaccugggacgacucccucuccaccggcggcgucuucggcaccggcaccaaagucaccguccuc

SEQ ID NO: 55082 - RNA, 333 nt, Artificial Sequence
  derived and/or modified sequence opt11 from anti-HIV-1_LightChain
caauccguccucacccaaccccccuccgucuccgccgcccccggccaaaaagucacccucuccugcuccggcaccuccuccaacaucggcaacaacuacgucuccugguaccaacaaguccccggcgccgcccccaaaguccucaucuacgaaaacgacaaacgccccuccggcauccccgaccgcuucuccggcuccaaauccggcaccuccgccacccucggcaucaccggccuccaaaccggcgacgaagccgacuacuacugcggcacaugggaccgcucccucuccgccggcggcgucuucggcaccggcaccaaagucaccguccuc

SEQ ID NO: 55083 - RNA, 333 nt, Artificial Sequence
  derived and/or modified sequence opt11 from anti-HIV-1_LightChain
caaucaguccuaacccaacccccaagcguaagcgcagccccaggccaaaaaguaaccauaagcugcagcggaagcaacagcaacaucggaaacaacuacguaagcugguaccaacaacuacccggaaccgcgaccaaacuccuaaucuacgaaaacgacaaacgcccgagcggaaucccagacagauucucaggcucaaaaucaggcacaagcgcaacccuaggcauaaccggacuccaaaccggagacgaagccgacuacuacugcggaaccuggcacucaagccuaagcgcaggcggagucuucggcacaggcacaaaaguaaccguacuc

SEQ ID NO: 55084 - RNA, 333 nt, Artificial Sequence
  derived and/or modified sequence opt11 from anti-HIV-1_LightChain
caauccguccucacccaaccccccucccucuccgccgcccccggccaacaagucuccaucuccugccucggccgcuccuccaacaucggcacaaacuacgucuccugguaccaacaauuccccggcaccgcccccaaacuccucaucuacgaaaacaaaaaacgccccuccgaaauccccgaccgcuucuccggcuccaaauccggcaccuccgccacccucggcaucaccggccuccaacccggcgacgaagccgacuacuacugcggcaccugggacuccucccucuccgccggcggcgucuucggcaccggcaccaaagucaccguccuc

SEQ ID NO: 55085 - RNA, 336 nt, Artificial Sequence
  derived and/or modified sequence opt11 from anti-HIV-1_LightChain
caauccgcccucacccaaccccccuccgccuccggcucccccggccaauccgucaccaucuccugcaccggcaccuccuccgacgucggcgccuacaacuccgucuccugguaccaacaacuccccggcaccgcccccaaacuccucaucuccgaaaacaacaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 55086 - RNA, 333 nt, Artificial Sequence
  derived and/or modified sequence opt11 from anti-HIV-1_LightChain
caauccgcccucacccaaccccccuccgccuccggcucccccggccaauccgucaccaucuccugcuccggcggcuccucaaacaucggcaacaaccacgucuccugguaccaacaccuacccggccgcgccccccaacuccucaucuacgacaccacccaacgccccucccgcauccccgaccgcuucuccggcucccgcuccggcaccuccgccacccucgccaucaccggccuccaaaccggcgacgaagccgucuacuacugcggcaccugggacaacucccucuccaccggcggcgucuucggcaccggcaccaaagucaccguccuc

SEQ ID NO: 55087 - RNA, 333 nt, Artificial Sequence
  derived and/or modified sequence opt11 from anti-HIV-1_LightChain
caauccguccucacccaaccccccuccgucuccgccgcccccggccaacgcgucaccaucuccugcuccggcggcaccuccaacaucggcaacgaauacgucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 55088 - RNA, 333 nt, Artificial Sequence
  derived and/or modified sequence opt11 from anti-HIV-1_LightChain
caaucaguccucacccaaccccccuccgucuccgccgcccccggccaacgcgucaccgucuccugcuccggcuccuccuccaacaucggaaacaacuacgucuccugguaccaacaacuccccggcgccgcccccaaacuccucaucuacgacaccgacaaacgccccuccggcauccccgaccgcuucuccggcuccaaauccggcaccuccgccacccucggcaucaccggccuccaaaccggcgacgaagccgacuacuacugcggcaccugggaccgcucacucuccgccggcggagucuucggcaccggcaccaaagucaccguccuc

SEQ ID NO: 55089 - RNA, 333 nt, Artificial Sequence
  derived and/or modified sequence opt11 from anti-HIV-1_LightChain
caaucccuccucacccaaccccccuccgucuccgccgcccccggccaaaaagucaccaucuccugcuccggcggcaacuccgacaucggcaaaaacuucgucuccugguaccaacaaucccccggcgccgccccccgccuccucaucuacgaaaacgaccgccgccccuccggcauccccgaccgauucuccggcuccaaauccggcaccucagccacccucggcaucaccggccuccaaaccggcgacgaagccgacuacuacugcggcaccugggaccgcucccucuccgccggcggcgucuucggcaccggcaccaaagucaccguccuc

SEQ ID NO: 55090 - RNA, 333 nt, Artificial Sequence
  derived and/or modified sequence opt11 from anti-HIV-1_LightChain
caauccguccucacccaaccccccuccgucuccgccgcccccggccaaaaagucaacaucuccugcuccggauccuccuccaacaucggcaaaaacuacgucuccugguaccaacaaauccccggcaccgcccccaaaguccucaucuacgaaaacaacaaacgacccuccggcauccccgaccgcuucuccggcuccaaauccggcaccuccgccacccucggcaucgccggacuccaaaccggcgacgaagccgacuacuacugcgccaccugggacuccucccucuccgccggcggcgucuucggcaccggcaccaaagucaccguccuc

SEQ ID NO: 55091 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcuccuccuccaacaucggcaaccgccacgucuccugguaccaacaacuccccggcaccguccccaaacuccucaucuacgaaaccaacaaacgccccuccggaauccccgaccgcuucucaggcuccaaauccggcaccuccgccacccucggcaucaccggccuccaaaccggcgacgaagccgacuacuacugcggcaccugggacaacucccuauccaccggcggcgucuucggcaccggcaccaaagucaccguccuc

SEQ ID NO: 55092 - RNA, 336 nt, Artificial Sequence
  derived and/or modified sequence opt11 from anti-HIV-1_LightChain
cagagcgugcucacgcaaccgcccucggucucgggagcgcccgggcaaagggucacgaucucgugcacgggcucgagcucgaacauaggcgcgggcuaugacgugcacugguaccagcaauugcccgggaccgcgcccaagcucuugaucuuuggccaugacaagcgcccgagcgggaucccggacagguucucgggcucgaaaucgggcacgagcgcgaccuugggcauaaccgggcuccagaccggagacgaggccgauuacuauugcgggaccugggacucgagcuugagcgcgggcggggucuuuggcacgggcacgaaagugaccgugcuc

SEQ ID NO: 55093 - RNA, 333 nt, Artificial Sequence
  derived and/or modified sequence opt11 from anti-HIV-1_LightChain
caauccguccucacccaacuccccuccgccuccggccuccccggccaaaccgucaccaucuccugcuccggcuccaccuccuccaucggcuccaaccacgucuacugguaccaacaagucgccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcgccaccugggacuccucccuauccgccggcggcgucuucggcaccggcaccaaagucaccguccuc

SEQ ID NO: 55094 - RNA, 333 nt, Artificial Sequence
  derived and/or modified sequence opt11 from anti-HIV-1_LightChain
caaucggucuugacccagaccccgagcgcgagcggggccccgggccagggcgugaccauaagcuguagcgggagcucgagcaaugucgggcgcaauuacgugagcugguaccagcaauugcccgggaccgcgcccaagcucuugaucuaugaaaauaccaagcgcccgagcgggaucccggacagguucucgggcucgaaaucgggcacgagcgcgacacugggcauaaccgggcuccagaccggggacgaggccgauuacuauugcgggaccugggacaggagcuugagcgcgggcggggucuuuggcacgggcacgaaagugaccgugcuc

SEQ ID NO: 55095 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcucaggcuccuccuccaacaucggcaacaacuacgucuccugguaccaacaauuccccggcaccgcccccaaacuccucaucuccgacaacaacaaacgccccucaggcauccccgaccgcuucuccgucuccaaauccggcaccuccgccacccucggcaucaccggccuccaagccggcgacgaagccgacuacuacugcggcaccugggacuccucccucucagccggcggcgucuucggcaccggcaccaaagucaccguccuc

SEQ ID NO: 55096 - RNA, 333 nt, Artificial Sequence
  derived and/or modified sequence opt11 from anti-HIV-1_LightChain
caauccguccucacccaaccccccuccgucuccgccgcccccggccaaaaagucaccaucuccugcuccggcuccaacuccaacaucggcaacaacuacgucaccugguaccaacaauuccccggcaccgcccccaaaguccucaucuacgacaacucccgccgccccuccggcauccccgaccgcuucuccggcuccaaauccggcaccuccgccacccuaggcaucaccggccuccaaacaggcgacgaagccgacuacuacugcggcaccugggacuccucccucucagccggcggcgucuucggcaccggcaccaaagucaccguccuc

SEQ ID NO: 55097 - RNA, 333 nt, Artificial Sequence
  derived and/or modified sequence opt11 from anti-HIV-1_LightChain
caauccguccucacccaacccccauccgucucaggcgcccccggccaacgcgucaccaucuccugcucaggcucauccuccaacaucggcaacaacuacgucuccugguaccaacaacuccccggcaccgcccccaaacuccucaucuacgaaaacaccaaacgccccuccggcauccccgaccgcuucuccggcuccaaauccggcaccuccgcaacccucggcaucaccggccuccaaaccggcgacgaagccgacuacuacugcggcaccugggaccgcucccucuccgccggcggcgucuucggaaccggcaccaaagucaccguccuc

SEQ ID NO: 55098 - RNA, 333 nt, Artificial Sequence
  derived and/or modified sequence opt11 from anti-HIV-1_LightChain
caauccguccucacccaaccccccuccgucucagccgcccccggccaaaccgucaccaucuccugcuccggcuccaccuccaacaucggccaaaacuuccuauccugguuccaacacguccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccuggcacucaucccucuccgccggcggcgucuucggcaccggcaccaaagucaccguccuc

SEQ ID NO: 55099 - RNA, 333 nt, Artificial Sequence
  derived and/or modified sequence opt11 from anti-HIV-1_LightChain
aacuucaugcucacccaaccccccuccgccuccggcacccccggccaacgcgucaccauauccugcuccggcuccuccuccaacaucggcuccaaauacgucuccugguaccaacaacuucccggcaccgcccccaaacuccucaucuacgaaaacaccaaacgccccuccggcauccccgaccgcuucuccggcucaaaauccggcaccuccgccacccucggcaucaccggccuccaaaccggcgacgaagccgacuacuacugcggaaccugggaccgcucccucuccgccggcggcgucuucggcaccggcaccaaagucaccguccuc

SEQ ID NO: 55100 - RNA, 333 nt, Artificial Sequence
  derived and/or modified sequence opt11 from anti-HIV-1_LightChain
caaucaguccucacccaaccccccuccgucuccgccgcccccggccaaaaagucaccaucuccugcuccggcuccuccuccaacaucggcaacaacuacgucuccugguaccaacuccuccccggaaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacaacucccucuccaccggcggcgucuucggcaccggcaccaaagucaccguccuc

SEQ ID NO: 55101 - RNA, 333 nt, Artificial Sequence
  derived and/or modified sequence opt11 from anti-HIV-1_LightChain
caauccguccucacccaaccacccuccgucuccgccgcccccggccaaaaagucaccaucucaugcuccggcuccuccuccaacaucggcaacaacuacgucuccugguaccaacaacuccccggcaccgcccccaaaaucaucaucuacgacaacaacaaacgccccuccggcauccccgaccgcuucuccggcuccaaauccggcaccuccgccacccucggcaucaccggccuccaaaccggcgacgaagccgacuacuacugcggcaccuggcacuccucccucuccgccggcggcgucuucggcaccggcaccaaagucaccguccuc

SEQ ID NO: 55102 - RNA, 333 nt, Artificial Sequence
  derived and/or modified sequence opt11 from anti-HIV-1_LightChain
caauccguccuaacccaaccacccuccgccuccgccacccccggccaacgcgucaccaucuccugcucaggcuccuccuccaacaucggcuccaaacacgucuacugguaccaaaaacuccccggcaccgcccccaaacuccucaucuacgaaaacaccaaacgccccuccggaauccccgaccgcuucuccggcucaaaauccggaaccuccgccacccucggcaucaccggccuccaaaccggcgacgaagccgacuacuacugcggcaccugggaccgcucccucuccgccggcggcgucuucggcaccggcaccaaagucaccguccuc

SEQ ID NO: 55103 - RNA, 432 nt, Artificial Sequence
  derived and/or modified sequence opt11 from anti-HIV-1_HeavyChain
caagcgcaauuggucgagagcgggggcggggucgugcaaccgggcaggagccugcgauugagcugugcagcgagcggauucacguucucgagcuauggcauacacugggucaggcaagcgcccgggaaagggcuagaguggguggccgugaugucaagcgauggcacguacaaguacuauggcgauagcaugaaagggcgcuuuacaauaagcagggacaauagcaagaacucgcuauaucuccagaugaauagcuugcgcgcggucgauaccgcggucuauuacugugccaaggacuugggcgagggagagaacgaggaaugggccacggacuauuacgauuucucgaucggguacccgggccaggacccgcgagggguagugggcacguucgauaucuggggccagggcacgauggugaccgugagcucg

SEQ ID NO: 55104 - RNA, 426 nt, Artificial Sequence
  derived and/or modified sequence opt11 from anti-HIV-1_HeavyChain
caagugcaauuggucgagagcgggggcggggucgugcaaccgggcaggagcuugcgcuugagcugugccgcgagcggguucacguucucgagcuauggcaugcacugggucaggcaagcgcccgggaaagggcucgaguggguagccgugaucucggacgauggcucgaacaaguacuaugccgauagcgugaaagggcgcuuuaccauaagcagggacaauagcaagaacacgcucuaucuacagaugaauagcuugcgcgcggaagauaccgcggucuauuacugugccaaggacuugggcgagagcgagaacgaggaaugggccucggacuauuacgauuucgggagcgauuacccgggacaggacccgcgcgcggucgugggcgcguucuggggccagggaacgauggugaccgugagcucg

SEQ ID NO: 55105 - RNA, 432 nt, Artificial Sequence
  derived and/or modified sequence opt11 from anti-HIV-1_HeavyChain
caagugcaauuggucgagagcgggggcggggucgugcaaucgggcaggagcuugcgcuugagcugugccgcgagcggguucacguucucggccuaugcccugcacugggucaggcaagcgccagggaaagggcucgaguggguggccgugaucucguacgauggcagggacaaggacuaugcagauagcgugaaagggcgcuuuaccauaagcagggacaauagcaagaacacgcuauaucuccagaugaauagcuugcgcgcggaagauaccgcggucuauuacugugcuaaggacuugggcgagagcgagaacgaggaaugggcaucggacuauuacgauuucgggagcgauuacccgggccaggacccgcgcgcagucgugggcgcguucgauaucuggggccagggcacgauggugaccgugagcucg

SEQ ID NO: 55106 - RNA, 432 nt, Artificial Sequence
  derived and/or modified sequence opt11 from anti-HIV-1_HeavyChain
caagugcaauugguccagagcgggggcgggcucgugcagccgggccgcagcuugagauugagcuguguggcgagcggguucagguucucguuccauggaaugcacugggucaggcaagcgcccgggaaagggcucgaguggguggccguggucucggacgacggaucggaccagaaauaugucgauagcgugaaagggcgcuugaccauaagcagagacaauagcaagaacacgguauaucuacagaugaauagcuugcgcgcggaagauaccgcgguauauuacugugccaaggacuugggcgagagcgagaacgaggaaugggccucggacuauuacgauuucgggagugauuacccgggccaggacccgcgcgcggucgugggagcguucgauaucuggggccagggcacgauggugaccgugagcucg

SEQ ID NO: 55107 - RNA, 432 nt, Artificial Sequence
  derived and/or modified sequence opt11 from anti-HIV-1_HeavyChain
gaagugcacuuggucgagagcgggggcggggucgugcaaccgggcaggagcuugcgcuugagcugugccgcgagcggguucacguucaauagcuaugcaaugaucugggucaggcaagcgcccgggaaagggcucgaguggguggccgugaucucguacgauggcaauaacaaguacuaugccgauagcgugaaaggacgauuuaccauaagcagggaaaauagcaagaacacgcucuaucuccagaugaauagccugcgcgcggaagauaccgcggucuaucacugugccaaggacuugggcgagagcgagaacgaggaaugggccucggacuauuacgauuucgggcgcgauuacccgggccaggacccgcgcggggucgugggcacauucgauaucuggggccauggcacgauggugaccgugagcucg

SEQ ID NO: 55108 - RNA, 432 nt, Artificial Sequence
  derived and/or modified sequence opt11 from anti-HIV-1_HeavyChain
caagugcaauuggucgagagcgggggcggggucgugcgcccgggcgggagcuugcgcuugagcuguacagcgagcggguuccauuucaauaaauauggaaugaacugggucaggcaagcgcccgggaaagggcucgcgcucguggccuuuauccagagcggggccucguacaauuacuaugccgauagcgugaaagggcgcuuuaccauaagccgggacaauagcaagaacacgcuauaucuccagaugaauagcuugcgcgcggaagauaccgcggucuauuacugugcaaaggacuugggcgauagcgagaacgaggaaugggccucggacuauuacgauuucgggagagauuacccgggccaggacccgcgcggggucgugggcgcguucgauaucuggggccauggcacgauggugaccgugagcucg

SEQ ID NO: 55109 - RNA, 432 nt, Artificial Sequence
  derived and/or modified sequence opt11 from anti-HIV-1_HeavyChain
caagugcacuuggucgagagcgggggcggggucgugcaaccgggcaagagcuugaccauauacugugccgugagcgaguucacgcucucgaacuaugccaugcacugggucaggcucacgcccgggaaagggcuccaguggguggccgugaucucguacgauggcucgaacaaguacuaugccgauagcgugaaagggcgcuuuaccauaagcagggacaauagcaagaacacgcuauaucuccagaugaauagcuugcgcgcggaagauaccgcggucuauuacugugccaaggacuugggcgagagcgagaacgaggaaugggccucggacuauuacgauuucgggcgcgauuacccgggccaggacccgcgcggggucgugggcguguucgauaucuggggacagggcacgauggugaccgugagcucg

SEQ ID NO: 55110 - RNA, 432 nt, Artificial Sequence
  derived and/or modified sequence opt11 from anti-HIV-1_HeavyChain
gaagugcaacugcucgagagcgggggcggggucgugcaaccgggcaggagcuugagacugagcugugccgcgagcggguucacguucucgaccuaugccuugcacugggucaggcaagcgcccgggaaagggcucgaguggguggccgugaucucguacgauggcucgaccaaguucuaugccgauagcgugaaagggcgcuuuaccauaagcagggacaauagcaagaacacgcucuaucuccagaugaauagcuugcgcgcggaagauaccgcggucuauuacugugccaaggaccugggcgagagcgagaacgaggaaugggccucggacuauuacgauuucgggagcgauuacccgggccaggacccgcgcgcggucgugggcgcguucgauaucuggggacagggcacgauggugaccgugagcucg

SEQ ID NO: 55111 - RNA, 432 nt, Artificial Sequence
  derived and/or modified sequence opt11 from anti-HIV-1_HeavyChain
caagugcaauuggucgagagcgggggaggggucgugcaaccgggcgggagcuugcgcuugagcugugcagcgagcggguucacguucucgagcuauggcaugcacugggucagacaagcgcccgggaaagggcucgaguggguggccuuuaucagguacgauggcucgaacaaguacuaugccgauagcgugaaagggcgcuuuaccauaagcagggaaaauagcaagaacacgcucuaucuccagaugaauagcuugcgcgcggaagauaccgcagucuaucacugugccaaggacuugggcgagagcgagaucgaggaauggaccucggacuauuacgauuucgggcgcgauuacccgggccaggacccgcgcggggucuuuggcacguucgauaucuggggacauggcacgauggugaccgugagcucg

SEQ ID NO: 55112 - RNA, 432 nt, Artificial Sequence
  derived and/or modified sequence opt11 from anti-HIV-1_HeavyChain
gaagugcaauuggucgagagcgggggcggggucgugaaaccgggcgggagcuugcgcuugagcugugucgugagcggguucacguucucgaacgcguggaugagcugggucaggcaagcgcccgggaaaggacucgaguggguggccgugaucucggacgauggcucgaacaaguacuaugccgauagcgugaaagggcgcuuuaccauaagcagggacaauagcaagaacacgcucuaucuccagaugaauagcuugcgcgcggaagauaccgcggucuauuacugugccaaggacuugggcgagagcgagaacgaggaaugggccucggacuauuacgauuucgggagcgauuacccgggccaggacccgcgagcggucgugggcgcguucgauaucuggggccagggcacgauggugaccgugagcucg

SEQ ID NO: 55113 - RNA, 432 nt, Artificial Sequence
  derived and/or modified sequence opt11 from anti-HIV-1_HeavyChain
caagugcaauuggucgagagcgggggcggggucgugcaaccgggagggagcuugcgcuugagcugugccgcgagcggguucacguucucgaccuauggcaugcacugggucaggcaagcgcccgggaaagggcuagaguggguggcauuuaucagguacgauggcaggaacaagaacuaugccgauagcgugaaagggcgcuuuaccauaagcagggacaauagcaagaacacgcucuaucuccagaugaauagcuugcgcgcggaagauaccgcggucuauuacugugcaaaggacuugggcgagagcgagaacgaggaaugggccacggacuauuacgauuucucgaucggguacccgggccaggacccgcgcggggucgugggcauauucgauaucuggggccagggcacgauggugaccgugagcucg

SEQ ID NO: 55114 - RNA, 432 nt, Artificial Sequence
  derived and/or modified sequence opt11 from anti-HIV-1_HeavyChain
caagugcacuugguagagagcgggggcggggucgugcaaccgggcgggagccugcgcuugagcugugccgcgagcggguucucguucucgaucuauggcaugcacugggucaggcaagcgcccgggaaagggcucgagugggugaccuuuaccagguacgauggcucgaacaaguacuauaccgauagcgugaaagggcgcuuuaccauaagcagagacaauagcaagaacacgcucuaucuccagaugaauagcuugcgcacggaagauaccgcggucuauuacugugccaaggacuugggcgagagcgagaacgaggaaugggccucggacuauuacgauuucgggagcgauuacccgggccaggacccgcgcgcggucgugggcgcguucgauaucuggggccagggcacgauggugaccgugagcuca

SEQ ID NO: 55115 - RNA, 432 nt, Artificial Sequence
  derived and/or modified sequence opt11 from anti-HIV-1_HeavyChain
caagugcaauuggucgagagcgggggcggggucgugcaaccgggcgggagcuugcgccugagcugugccgcgagcggguucacguucucgagcuauggcaugcacugggucaggcaagcgcccgggaaagggcucgaguggguggccuuuaucagguacgauggcucgaacaaguacuaugccgaucccgugaaaggacgcuuuaccauaagcagggacaauagcaagaacacgcuauaucuccagaugaauagcuugcgcgcagaagauaccgcggucuauuacugugccaaggacuugggcgagagcgagaacgaggaaugggccucggacuauuacgauuucgggcgcgauuacccgggccaggacccgcgcggggucgugggcguguucgauaucuggggccagggcacgauggugaccgcgagcucg

SEQ ID NO: 55116 - RNA, 432 nt, Artificial Sequence
  derived and/or modified sequence opt11 from anti-HIV-1_HeavyChain
gaaaugcaauuggucgagagcgggggcgggcucgugcaaccgggcgggagcuugcgcuugagcugugcagcgagcggguucacguucucgagcuauuggaugagcugggucaggcaagcgcccgggaaagggcuagaguggguggccgugaucucguacgauggcaauaacaaguacuaugcagauagcguaaaagggcgcuuuaccauaagcagggaaaauagcaagaacacgcucuaucuccagaugaauagcuugcgcgcggaagauaccgcggucuauuacugugccaaggacuugggcgagagcgagaacgaggaaugggccucggacuauuacgauuucgggagcgauuacccgggccaggacccgcgcggggucgugggcacguucgauaucuggggccauggcacgauggugacagugagcucg

SEQ ID NO: 55117 - RNA, 432 nt, Artificial Sequence
  derived and/or modified sequence opt11 from anti-HIV-1_HeavyChain
caagugcaauuggucgagagcgggggcggggucgugcaaccgggcaggagcuugcgcuugagcugugccgcgagcggguucacguucucgagcugugccaugcacugggucaggcaagcgcccgggaaagggcucgaguggguggccgugaucucguacgauggcaauaacaagcacuaugccgauagcguaaaagggcgcuuuaccauaagcagggacaauaguaagaacacgcucuaucuccagaugaauagcuugcgcgcggaagauauggcggucuauuacugugccaaggaccugggcgagagcgagaacgaggaaugggccucggacuauuacgauuucuggcgcgauuacccgggccaggacccgcgcgggugggugggcacguucgauaucuggggccagggcacgauggugaccgugagcucg

SEQ ID NO: 55118 - RNA, 432 nt, Artificial Sequence
  derived and/or modified sequence opt11 from anti-HIV-1_HeavyChain
caagugcaauuggucgagagcgggggcggggucgugcaaccgggcaggagcuugcgauugagcugugccgcgagcggguucacguucucgaacuauggcaugcacugggucaggcaagcgcccgggaaagggcucgagugggugaccgugauaucgagcgauggcucgaaaaaguacuaugcagauagcgugaaagggcgcuuuaccauaagcagggacaauagcaagaacacgcuauaucuccagaugaauggcuugagagcggacgauaccgcggucuauuacugugccaaggacuugggcgauagcgagaacgaggaaugggccucggacuauuacgauuucgggcgagauuacccgggccaggacccgcgcggggucguaggcgcguucgauaucuggggccauggcacgauggugaccgugagcucg

SEQ ID NO: 55119 - RNA, 432 nt, Artificial Sequence
  derived and/or modified sequence opt11 from anti-HIV-1_HeavyChain
caaguacaauuggucgagagcgggggcggggucgugcaaccgggcgggagcuugcgcuugagcugugccgcgagcggguucacguucucgagcuauggcaugcacugggucagacaagcgcccgggaaagggcuagaguggguggccuuuaucagguacgauggcucgaacaaguacuaugccgauagcgugaaagggcgcuuuaccauaagcagggacaauagcaagaacacgcucuaucuccagaugaauagcuugcgagcggucgauaccgcggucuauuacugugccaaggacuugggcgagggcgagaacgaggaaugggccacggacuauuacgauuucucgaucggguacccgggccaggacccgcgcggagucgugggagcguucgauaucuggggccagggcacgauggugaccgugagcucg

SEQ ID NO: 55120 - RNA, 432 nt, Artificial Sequence
  derived and/or modified sequence opt11 from anti-HIV-1_HeavyChain
caagugcaauuggucgagagcgggggcggggucgugcaaccgggcagaucguugcgauugagcugugccgcgagcggguucacauucaggaacuauggcaugcacugggucaggcaaagccccgggaaagggcucgaguggguggccgugaucucguacgauggcaagaucauaaacuauaucgauuucgugaaagggcgcuuuaccauaagcagggaaaauagcaagaacacgcucuaucuccagaugaauagcuugcgcgcggaagauaccgcggucuauuacugugccaaggacuugggcgagagcgagaacgaggaaugggccucggacuauuacgauuucgggagcgauuacccgggccaggacccgcgcggggucgugggcacguucgauaucuggggccauggcacgauggugaccgugagcucg

SEQ ID NO: 55121 - RNA, 432 nt, Artificial Sequence
  derived and/or modified sequence opt11 from anti-HIV-1_HeavyChain
gaagugcaauugcucgagagcgggggcgggcuagugcaaccgggcaggagcuugcgcuugagcugugccgcgagcggguucacguucucgagcuaugucaugcacugggucaggcaagcgcccgggaaagggcucgaguggguggccgugaucucguacgauggcucgaacaagcacuaugccgauagcgugaaagggcgcuuuaccauaagcagggacaauagcaagaacacgcucuaucuccagaugaauagcuugcgcgcggaagauaccgcggucuauuacagggccaaggacuugggcgagagcgagaacgaggaaugggccucggacuauuacgauuucgggcgcgauuacccgggccaggacccgcgcggggucgugggcgugcucuauaucuggggccagggcacgauggugaccgugagcucg

SEQ ID NO: 55122 - RNA, 432 nt, Artificial Sequence
  derived and/or modified sequence opt11 from anti-HIV-1_HeavyChain
gaagugcaauuggucgagagcgggggcgggcuagugaaaccgggcgggagcuugcgcuugagcugugccgcgagcggguucacguucucgaccuauagcaugcacugggucaggcaagcgcccgggaaagggcuagaguggguggccgugaucucguacgauggcaauaacaaguacuaugccgauagcgugaaagggcgcuuuaccauaagcagggaaaauagcaagaacacgcucuaucuccagaugaauagcuugcgcgcggaagauacagcggucuaucacugugccaaggacuugggcgagagcgagaacgaggaaugggccucggacuauuacgauuucgggcgcgauuacccgggccaggacccgcgcggggucgugggcacguucgauaucuggggccauggcacgauggugaccgugagcucg

SEQ ID NO: 55123 - RNA, 432 nt, Artificial Sequence
  derived and/or modified sequence opt11 from anti-HIV-1_HeavyChain
caagugcaauuggucgauagcgggggcggggucgugcaaccgggaaggagcuugcgcuuguucugugccgugagcggguucacguucucgaccuauaccaugcacugggucaggcaagcgcccgggcgcgggcucgaguggguggccgugaucucguacgauggcucgaccaaguacuaugccgauagcgugcaagggcgcuuuaccauaagcagggacaauagcaagaacacgcucuaucuccagaugaauagcuugcgcgcggaagauaccgcgguauauuacugugccaaggacuugggcgagagcgagaacgaggaaugggccucggacuauuacgauuucgggagcgauuacccgggccaggacccgcgcgcggucgugggcgcguucgauaucuggggccagggcacgauggugacagugagcucg

SEQ ID NO: 55124 - RNA, 426 nt, Artificial Sequence
  derived and/or modified sequence opt11 from anti-HIV-1_HeavyChain
caagugcaauuggucgagagcgggggcggggucgugcaaccgggccgcagcuugagauugagcugugccgcgagcggguucacauucucgagcuuuggcaugcacugggucaggcaagcgcccgggaaagggcucgaguggguggccgugaucucguacgauggcaauaacaaguacuaugccgauagcgugaaagggagauuuaccauaagcagggaaaauagcaagaacacacucuaucuacagaugaauagcuugcgcccggaagauaccgcggucuauuacugugccaaggacuugggcgagagcgagaacgaggaaugggccucggacuauuacgauuucgggcgcgauuacccgggacaggacccgcgcggggucgugggcacguucgauaucuggggccauggcacgauggugaccgug

SEQ ID NO: 55125 - RNA, 432 nt, Artificial Sequence
  derived and/or modified sequence opt11 from anti-HIV-1_HeavyChain
caagugcaauugguagagagcgggggcggggucgugcaaccgggcaggagcuugcgcuugagcugugccgcgagcggguucauguucucgcgcuauggcaugcacugggucaggcaagcgcccgggaaagggcucgaguggguggccgugaucucgcacgauggcucgaacaaguacuaugccgauagcgugaaagggcgcuuuaucauaagcagggacaauagcaagaacacgcucuaucuccagaugaauagcuugcgcgcggacgauaccgcggucuauuacugugccaaggaccugggcgagagcgagaacgaggaaugggccucggacuauuacgauuucuggaucggguacccgggccaggacccgcgcggggucgugggcgcguucgauaucuggggccagggcacgauggugaccgugagcucg

SEQ ID NO: 55126 - RNA, 432 nt, Artificial Sequence
  derived and/or modified sequence opt11 from anti-HIV-1_HeavyChain
caagugcaacuggucgagagcgggggcggggucgugcaaccgggcgggagcuugcgcuugaguugugccgcgagcgcguucacguucucgagcuauggcaugcacugggucagacaagcgccagggaaagggcucgaguggguggccuuuaucagguacgauggcucgaacaaguacuaugccgauagcgugaaagggcgcuuuaccauaagcagggacaauagcaagaacacgcuauuucuccagaugaauagcuugcgcgcggaagauauggcggucuauuacugugcaaaggacuugggcgagagcgagaacgaggaaugggccucggacuauuacgauuucuggcgcgauuacccgggccaggacccgcgcgggugggugggcacguucgauaucuggggccagggcacgauggugacagugagcucg

SEQ ID NO: 55127 - RNA, 426 nt, Artificial Sequence
  derived and/or modified sequence opt11 from anti-HIV-1_HeavyChain
caagugcaauuggucgagagcgggggcggggucgugcaaccgggcaggagcuugcgcuugagcugugccgcgagcggguucacguucucgagcuuuggcaugcacugggucaggcaagcgcccgggaaagggcucgaguggguggccgugaucucguacgauggcucgaacaaguacuaugucgauagcguaaaagggcgcuuuaccauaagcagagacaauagcaagaacacgcucuaucuccagaugaauagccugcgcgcggaagauaccgcggucuaugccaaggacuugggcgagagcgagaacgaggaaugggccucggacuauuacgauuucgggagcgauuacccgggccaggacccgcgaggggucgugggcacguucgauaucuggagccagggcacgauggugaccgugagcucg

SEQ ID NO: 55128 - RNA, 432 nt, Artificial Sequence
  derived and/or modified sequence opt11 from anti-HIV-1_HeavyChain
caagugcaauuggucgagagcgggggcggggucgugcaaccgggcgggagcuugcgccugagcugugccgcgagcggguucacguucucgaccuauggcaugcacugggucaggcaagcgcccgggaaagggcucgauuggguggccuuuaucagguacgauggcucgcacaaguacuaugccgauagcgugaaagggcgcuuuaccauaagcagggaaaauagcaagaacacgcucuaucuccagaugaacagccugcgcccggaagauaccgcggucuauuacugugccaaggacuugggcgagagcgagaacgaggaaugggccucggacuauuacgacuucgggcgcgauuacccgggccaggacccgcgcggggucgugggcacguucgauaucuggggacauggcacgauggugaccgugagcucg

SEQ ID NO: 55129 - RNA, 432 nt, Artificial Sequence
  derived and/or modified sequence opt11 from anti-HIV-1_HeavyChain
caagugcaauuggucgagagcggaggcgggguagugcaaccgggcaggagcuugcgauugagcugugccgcgagcggguucacguucucgagcuacgccaugcacugggucaggcaagcgcccgggaaagggcucgaguggguggccgugaucucguacgauggcucgggagauuacuaugccgauagcgugaaagggcgcuuuacaauaagcagggacaauagcaagagcacgcucuaucuccagaugaauagcuugcgcccggaagauaccgcggucuauuacugugccaaggacuugggcgagagcgagaacgaggaaugggccucggacuauuacgauuucgggcgcgauuacccgggccaggacccgcgcggggucgugggcacguucgauaucuggggccauggcacgauggugaccgugagcucg

SEQ ID NO: 55130 - RNA, 432 nt, Artificial Sequence
  derived and/or modified sequence opt11 from anti-HIV-1_HeavyChain
caagugcacuuagucgagagcgggggcggggucgugcaaccgggcgggagcuugcgcuugagcugugccgcgagcggguucacguucucgaccuauggcaugcaaugggucaggcaagcgcccgggaaagggcucgaguggguggccuuuaucaagaacgauggcacgaacgaguucuauggcgauagcgugaaagggcgauuuaccauaagcagggacaauagcaagaacacggucucgcuccauauggauagcuugcgcccggaagauaccgcgcucuauuacugugccaaggacuugggcgagagcgagaacgaggaaugggccucggacuauuacgauuucgggagcgauuacccgggccaggacccgcgcgcggucgugggcgcguucgauaucuggggccagggcacgauggugaccgugagcucg

SEQ ID NO: 55131 - RNA, 432 nt, Artificial Sequence
  derived and/or modified sequence opt11 from anti-HIV-1_HeavyChain
caagugcaauuggucgagagcgggggcggggucgugcaaccgggcgggagcuugcgauugagcuguguagcgagcggguucacguucucgaguuauggaaugcacugggucaggcaagcgcccgggaaagggcuugaguggguggccuuuaucagguacgauggcaggaacaaguacuaugccgauagcgugaaagggcgcuuuacaauaagcagggacaagagcaagaacacgcuaugucuccagaugaauagcuugcgaguggaagauaccgcggucuauuacugugccaaggacuugggcgauagcgagaacgaggaaugggcaucggacuauuacgauuucgggcgcgauuacccgggccaggacccgcgcgggguagugggcgcguucgauaucuggggccauggcacgauggugacagugagcucg

SEQ ID NO: 55132 - RNA, 432 nt, Artificial Sequence
  derived and/or modified sequence opt11 from anti-HIV-1_HeavyChain
caagugcaauuggucgagagcggaggcggggucgugcaaccgggcaggagcuugcgcuugagcugugccgcgagcggguucacguucucaagcuauggcaugcacugggucaggcaagcgccagggaaagggcucgaguggguggccgugaucucguacgauggcucgaacaaguacuaucgcgauagcgugaaagggcgcuuuaccauaagcagagacaauagcaagaacacggucuaccuccagaugaauagccugcgcgcggaagauaccgcggucuauuacugugcaaaggaccugggcgagagcgagagcgaggaaugggccucggacuauuacgauuucgggcgagauuacccaggccaggacccgcgcggggucgugggcgcgcuagauaucuggggccagggcauaauggugaccgugagcucg

SEQ ID NO: 55133 - RNA, 432 nt, Artificial Sequence
  derived and/or modified sequence opt11 from anti-HIV-1_HeavyChain
gaagugcaauuggucgagagcgggggcggaauggugcaaccgggcaggcccuugcgauugagcugugccgcgagcggguucauauucucgggcuuuggcuugcacugggucaggcaagcgcccgggaaagggcucgaguggguggccucgaucucguacgauggcgggaacaaguacuaugccgauagcgugcgcgggcgcuuuaccauaagcagagacaauagcaagaacacgcucuaucuccagaugaauagccugcgcgcggaagauaccgcgguauauuacugugccaaggacuugggcgagagcgagaacgaggaaugggccucggacuauuacgauuucgggagcgauuacccgggccaggacccgcgcgcggucgugggagcguucgauaucuggggccagggaacgauggugaccgugagcucg

SEQ ID NO: 55134 - RNA, 432 nt, Artificial Sequence
  derived and/or modified sequence opt11 from anti-HIV-1_HeavyChain
gaagugcaauuggucgagagcgggggcggggucgugcgaccgggcgggagcuugcgauugagcugugccgcgagcggguucacguucaaugacuauggcauggccugggucaggcaagcgcccgggaaagggcucgaguggguggccgauaucucguacgauggcucgaacaaguacuaugccgauagcgugaaaggacgcuuuaccauaagcagggacaauagcaagaacacgcucuaucuccagaugaauagcuugcgcgcggaagauaccgcggucuauuacugugccaaggacuugggcgagagcgagaacgaggaaugggccucggacuauuacgauuucgggcgcgauuacccgggccaggacccgcgcggggucgugggcgcguucgauauauggggacagggcacgauggugaccgugagcuca

SEQ ID NO: 55135 - RNA, 429 nt, Artificial Sequence
  derived and/or modified sequence opt11 from anti-HIV-1_HeavyChain
caagugcaacuggucgagagcgggggcggggucgugcaaccgggcaggagcuugcgacugagcugugcagcgagcggguucacguucucgagcuauggcaugcacugggucaggcaagcgcccgggaaagggcucgaguggguggccguggucucguacgaugaaucgaaauauuacgcggacucugucaagggcagguucacgaucucgcgcgauaacucgaaaaauaccuuguacuugcaaaugaacucacucagggccgaggacauggccguguacuauugcgcgaaagaucucggggaaucggaaaaugaagagugggcgagcgauuacuaugaauuuuggagggacuauccagggcaagaucccaggggcugggucgggaccuuugacauaugggggcaagggaccauggucacggucucaagc

SEQ ID NO: 55136 - RNA, 432 nt, Artificial Sequence
  derived and/or modified sequence opt11 from anti-HIV-1_HeavyChain
caagugcaacuggucgagcccgggcgcggggucgugcacccgggcgggagcuugcgcuugagcugugucacgagcggguucacguucgagaacuuucccaugcacugggucaggcaagcacccgggaaagggcucgaguggguggccuugaucucguacgauggcucggacaaguacuauagcgauagcgugaaagggcgcuuuaccauaagcagggacaauagcaagaacacgcucuaucuccagaugaauagcuugcgcgcggaagauaccgcggucuauuacugugccaaggacuugggcgagagcgagaacgaggaaugggccucggacuauuacgauuucggaagcgauuacccgggccaggacccgcgcggggucgugggcacguucgauaucuggggccauggcacgauggugaccgugagcucg

SEQ ID NO: 55137 - RNA, 432 nt, Artificial Sequence
  derived and/or modified sequence opt11 from anti-HIV-1_HeavyChain
caagcgcaauuggucgagagcgggggcggggucgugcaaccgggcaggagcuugcgcuugagcugugccgcgagcggguucucguucgcgacccaugccaugcacugggucaggcgcucgcccgggaaagggcucgaguggguggcaacgaucucguacgggggcaagaacgaguacuaugccgauagcgugaaagggcgcuuuaccauaagcagggaaaauagcaagaacacgcucuaucuccagaugaauagcuugcgcgcggaagauacagcggucuauuacugugccaaggacuugggcgagagcgagaacgaggaaugggccucggacuauuacgauuucgggagcgauuacccgggccaggacccgcgcggggucgugggcacguucgauaucuggggacauggcacgauggugacagugagcucg

SEQ ID NO: 55138 - RNA, 432 nt, Artificial Sequence
  derived and/or modified sequence opt11 from anti-HIV-1_HeavyChain
gccgugcaauuggucgagagcgggggcgggcucgugaaaccgggcgggagcuugcgcuugagcugugccgcgagcggguucacguucuuuaacacguggaugagcugggucaggcaaucgcccgggaaagggcucgaguggguggccgauaucucguacgauggcucgaacaaguacuaugccgauagcgugaaagggcgcuuuaccauaagcagggacaauagcaagaacacgcucuaucuccagaugaauagcuugcgcgcggaagauacagcggucuauuacugugcaaaggacuugggcgagagcgagaacgaggaaugggccucggacuauuacgauuucgggagagauuacccgggccaggacccgcgcggggucgugggcguguucgauaucuggggccagggcacgauggugaccgugagcucg

SEQ ID NO: 55139 - RNA, 432 nt, Artificial Sequence
  derived and/or modified sequence opt11 from anti-HIV-1_HeavyChain
caagugcaacuggucgagagcgggggcggggucgugcaaccgggcaggagcuugagacugagcugugccgcgagcggguucacauucucgagcuauggcaugcacugggucaggcaagcgcccgggaaagggcucgaguggguggccgugaucucguacgauggcucgaacaaguacuaugccgauagcgugaaagggcgauuuaccauaagcagggacaauagcaagaacacgcucuaucuccagaugaauagcuugcgcgcggaagauaccgcggucuauuacugugccaaggacuugggcgagagcgagaacgaggaaugggccucggacuauuacgauuucgggagcgauuacccgggccaggacccgcgcgcggucgugggcgcguucgauaucuggggccagggcacgauggugaccgugagcucg

SEQ ID NO: 55140 - RNA, 432 nt, Artificial Sequence
  derived and/or modified sequence opt11 from anti-HIV-1_HeavyChain
caagugcgcuuggucgagagcgggggcagggucgugcaaccgggcgggagcuugcgauugagcugugucgcgagcggauucacguucucgagcuauggcauacacugggucaggcaagcgcccgggaaagggcucgagugggugaccuuuaucuggcacgauggcagggacacguacuaugccgaugccgugaaagggcgcuuuaccauaagcagggacaauagcaagaacacgcuauaucuacagaugaauagcuugcgagcggaagauacagcggucuauuacugugccaaggacuugggcgagagcgagaacgaggaaugggccacggacuauuacgacuucuggaccggguacccgggccaggacccgcgcgcggucgugggcgcguucgauaucuggggccagggcacgauggugaccgugagcucg

SEQ ID NO: 55141 - RNA, 432 nt, Artificial Sequence
  derived and/or modified sequence opt11 from anti-HIV-1_HeavyChain
caagugcacuuggucgagagcgggggcggggucgugcaaccgggcaggagccugcgaauauacugugccgugagcgaguucacguucaggaacuaugccaugcacugggucaggcucgcgcccgggaaagggcuccaguggguggccgugaucucguacgauggcucgaacaaguacuauggcgauagcgugaaagggcgcuuuacaauaagcagggacaauagcaagaacacacuauaucuccagauggauagcuugcgagcggaagauacagcggucuauuacugugccaaggacuugggcgagagcgagaacgaggaaugggccucggacuauuacgauuucgggcgcgauuacccgggccaggacccgcgcggggucgugggcacguucgauaucuggggccauggcacgauggugaccgugagcucg

SEQ ID NO: 55142 - RNA, 432 nt, Artificial Sequence
  derived and/or modified sequence opt11 from anti-HIV-1_HeavyChain
gaagugcaauuggucgagagcgggggcgggcuagugaaaccgggcgggagcuugcgccugagcugugcagcgagcggguucacguucucggacgcguggaugagcugggucaggcaagcgcccgggaaagggauggaguggguggccgugaucucguacgauggcucgaacaaguacuaugccgauagcgugaaagggcgcuuuaccauaagcagggacaauagcaagaacacgcuauaucuccagaugaauagcuugcgcgcggucgauaccgcggucuauuacugugccaaggacuugggcgagggagagaacgaggaaugggccacggacuauuacgauuucucgaucggguacccgggccaggacccgcgcggggucgugggcgcguucgacaucuggggccagggcacgauggugaccgugagcuca

SEQ ID NO: 55143 - RNA, 432 nt, Artificial Sequence
  derived and/or modified sequence opt11 from anti-HIV-1_HeavyChain
gaagugcaaguggucgagagcgggggcgggcucgugaaaccgggcgggagcuugcgcuugagcugugaagcgagcggguucacguucucgaacgcguggaugagcugggucaggcaagcgcccgggaaagggcucgaguggguggccguaaucucguacgauggcaauaacaaguacuaugccgauagcgugaaagggagauuuaccauaagcagggaaaauagcaagaacacgcucuaucuccagaugaauagccugcgcgcggaagauacagcgguauaucacugugccaaggacuugggcgagagcgagaacgaggaaugggccucggacuauuacgauuucgggcgcgauuacccgggccaggacccgcgcggggucgugggcacguucgauaucuggggccauggcacgauggugaccgugagcucg

SEQ ID NO: 55144 - RNA, 432 nt, Artificial Sequence
  derived and/or modified sequence opt11 from anti-HIV-1_HeavyChain
caagugcaacuggucgagagcgggggcggggucgugcaaccgggcgggagcuugcgccugagcugugccgcgagcggguucacguucucgagcuauggcauacacugggucaggcaagcgcccgggaaagggcucgaguggguggccuuuaucaggagcgaugccacgaacaaguacuaugccgauagcgugaaagggcgcuuuaccauaagcagggaaaauagcaagaacacgcuauaucuccagaugaauagcuugcgcgcggaagauaccgcggucuauuacugugccaaggacuuaggcgagagcgagaacgaggaaugggccucggacuauuacgacuucgggagcgauuacccgggccaggacccgcgcggggucgugggcacguucgauaucuggggccauggcacgauggugaccgugagcucg

SEQ ID NO: 55145 - RNA, 432 nt, Artificial Sequence
  derived and/or modified sequence opt11 from anti-HIV-1_HeavyChain
caagugcaauuggucgagagcgggggcgggguagugcaaccgggcaggagccugcgcuugagcugugccgcgagcggguucacguucucgagcuuuggcaugcacugggucaggcaagcgcccgggaaaggacucgaguggguggccgugaucucguacgacggcaauaacaaguacuaugcagauagcgugaaagggcgcuuuaccauaagcagggaaaacagcaagaacacgcuauaccuacagaugaauagcuugcgcgcggaagauaccgcgguauauuacugugccaaggacuugggcgagagcgagaacgaggaaugggccucggacuauuacgauuucgggagcgauuacccgggccaggacccgcgaggggucgugggcacguucgauaucuggggccauggcacgauggugaccgugagcucg

SEQ ID NO: 55146 - RNA, 432 nt, Artificial Sequence
  derived and/or modified sequence opt11 from anti-HIV-1_HeavyChain
caagugcaauuggucgagagcgggggcggggucgugcaaccgggcaggagcuugcgcuugagcugugccgcgagcggguucacguucucgaacuaugccauggacugggucaggcaagcgcccgggaaagggcucgaguggguggccgugaucucguacgauggcucgaacaaguacuaugccgauagcguaaaagggcgcuuuaccauaagcagggacaauagcaagaacacgcuauaucuccagaugaauagcuugcgcgcggaagauaccgcggucuauuacugugccaaggacuugggcgagagugagaacgaggaaugggccacggacuauuacgauuucuggaccggguacccgggccaggacccgcgcgcggucgugggcgcguucgauaucuggggccagggcacgauggugaccgugagcucg

SEQ ID NO: 55147 - RNA, 432 nt, Artificial Sequence
  derived and/or modified sequence opt11 from anti-HIV-1_HeavyChain
caagugcaauuggucgagagcgggggcggggucgugcaaccgggcaggagcuugcgccugagcugugccgcgagcggguucacguucucgagcuauggcaugcacugggucaggcaagcgcccgggaaagggcuagaguggguggccguggucucguacgaugaaucgaacaaguacuaugcagggagcguaaaagggcgcuuuaccauaagcagggacaauagcaagaacacgcucuaucuccagaugaauagcuugcgcacggaagauauggcgguauauuacugugccaaggaccugggcgagagcgagaacgaggaaugggccucggacuauuacgauuucgggcgcgaguacccgggccaggacccgcgcgggugggugggcacguucgauaucuggggccagggcacgaugguaaccgugagcucg

SEQ ID NO: 55148 - RNA, 432 nt, Artificial Sequence
  derived and/or modified sequence opt11 from anti-HIV-1_HeavyChain
caagugcaacuggucgagagcgggggaggagucgugcaaccgggcaggagcuugcgauugagcugugccgcgagcggguucacguucucgagcuauggcaugcacugggucaggcaagcgcccgggaaaggacucgaguggguggccgugaucucguacgauggcucgaacaaguacuaugucgauagcgugaaagggcgcuuuaccauaagcagggacaauagcaagaacacgcuauaucuccagaugaauagcuugcgcgcggaagauaccgcgguauauuacugugccaaggacuugggcgagagcgagaacgaggaaugggccacggacuauuacgauuucucgaucggguacccgggccaggacccgcgcggggucgugggcauauucgauaucuggggccagggcacgauggugaccgugagcucg

SEQ ID NO: 55149 - RNA, 432 nt, Artificial Sequence
  derived and/or modified sequence opt11 from anti-HIV-1_HeavyChain
caagugcaauuggucgagagcgggggcgggguagugcaaccgggcaggagcuugcgcuugagcugugcagcgagcggguucacguucucgaccucgggcaugcacugggucaggcaagcgcccgggaaagggauggaguggguggccgugaucucguacgauggcucgaacaaguacuaugccgauagcgugaaagggcgauuuaccauaagcagggacaauagcaagaacacgcuuuaucuccagaugaauagcuugcgcgcggucgauaccgcggucuauuacugugccaaggacuugggcgagggcgagaacgaggaaugggccacggacuauuacgauuucucgaucggguacccgggccaggacccgcgcggggucgugggcgcguucgauaucuggggccagggcacgauggugaccgugagcucg

SEQ ID NO: 55150 - RNA, 363 nt, Artificial Sequence
  derived and/or modified sequence opt11 from anti-HIV_C38-VRC18.02_HeavyChain
caggucaggcucgugcaaucgggcaaucaagugcgcaagcccggggccucggucaggaucucgugcgaggccucgggcuauaaauuuaucgaucacuuuauccauugggugcgacaggucccgggacauggcuuggaauggcucggguggauaaacccgcgcgggggcggggucaauuacucgcgcucguuccagggcaagcucucgaugacgaugacgcgcgauaacuuugaagagaccgcguacuuggacuugagcaagcucaaucccggggacacggccguguacuuuugcgcgcgcggguucgcgggcuaugaauggagcuuuaucuggggccagggcacgcuagugaucgugagcucg

SEQ ID NO: 55151 - RNA, 396 nt, Artificial Sequence
  derived and/or modified sequence opt11 from anti-HIV_44-VRC13.02_HeavyChain
caaguccaacucguccaauccggcaccgcccucaaaucccccggcuccuccgccaaacucuccugcacaguccuaggcgacgaauucggcaccuacuucaucuccuggauccgccaagcccccggccaaggccucgaaugggucggcggcaucgucccccacucccaacuccaauccuccgcccaaaaauuccacggccgcaucaucaucuccgccggcgccggcguaaccccccccgucgucucccuccaacucaccaaccucaccuucgaagacaccggcaccuacuucugcgcccgagaacgcggccgccaccgcgaccccaaaaccggcgacgcccuccgcggccgcuacuucgacuucuggggccgcggcaccggccuccgcgucucaacc

SEQ ID NO: 55152 - RNA, 321 nt, Artificial Sequence
  derived and/or modified sequence opt11 from anti-HIV-1_LightChain
gauaucaagcucacgcaaucgcccgcguucuugagcgcgagcgugggcgagcgcgugaccuuuaccugucgcgcgagccaggacauaagccaugacuuggucugguuccagcaaaaggccgggcgcgcgcccucgcucuugauguuuuacgggagcacgcucgagcgcggggucccgcccagguucucgggcaggcgcucgggcacggaauuuaccgugaccauagacucgcuccagcccgaggacgugggcacguacuauugccagcaauugagcgcguucccgcucacguucgggggcgggaccacggucgauaucaag

SEQ ID NO: 55153 - RNA, 321 nt, Artificial Sequence
  derived and/or modified sequence opt11 from anti-HIV-1_LightChain
gacaucaaaaugacccaaucccccgccuuccucuccgccuccgucggcgaacgcgucaccuucaccugccgcgccucccaagacaucucccacgacgucgucugguuccaacaaaaauccggcuccgcccccaaacuccucauguucuacggcuccacccucgaacgcggcguccccccccgcuucuccggccgccgcuccggcaccgaauucaccgucaccaucgacggccuccaacccgaagacgucggcaccuacuacugccaacaacucuccgccuucccccucaccuucggcggcggcaccaccgucgacaucaaa

SEQ ID NO: 55154 - RNA, 321 nt, Artificial Sequence
  derived and/or modified sequence opt11 from anti-HIV-1_LightChain
gauaucaagcucacgcaaucgcccgcguucuugagcgcgagcgugggcgagcgcgugaccuuuaccugucgcgcgagccaggacauacgccaugaacuggucugguaccagcaaaagcccgggcgcgggcccaagcucuugaucuauuacgggagcacgcucgagggcggggucccgagcagguucucgggcaggcgcucgggcacggaauuuaccgugaccauaagcucgcuccagcccgaggacgugggcacguacuauugccagcaauugaacucguucccgcucacguucgggggcgggaccacggucgauaucagg

SEQ ID NO: 55155 - RNA, 321 nt, Artificial Sequence
  derived and/or modified sequence opt11 from anti-HIV-1_LightChain
gacauccaacucacccaaucccccuccuuccucuccgccuccgucggcgaccgcgucuccaucaccugccgcgccucccaaggcaucaaacacgaacucgccugguaccaacaaaaacccggccgcgcccccucccuccucaucuacuacgccuccacccucgcccgcggcguccccucccgcuucuccgccuccugguccggcacccucuucacccucaccaucaacggccuccaaccagaagacuucgccaccuacuucugccaacaaaugaacucccucccacucaccuucggcggcggcaccaaaauggacguccgc

SEQ ID NO: 55156 - RNA, 321 nt, Artificial Sequence
  derived and/or modified sequence opt11 from anti-HIV-1_LightChain
gacauccaacucacccaaucccccuccuuccucuccgccuccgucggcgacaaagucaccaucaccugccgcgccucccacggcguccgcaacgaacucgccugguaccaacaaaaacccggcaaagcccccaaccuccucaucuacuacgccuccacccuccaauccggcguccccucccgcuucuccgccaccggcuccggcacccacuucacccucaccgucuccucccuccaacccgaagacuucgccaccuacuucugccaacacauguccuccuacccccucaccuucggcggcggcaccaaagucgaaaucaaa

SEQ ID NO: 55157 - RNA, 321 nt, Artificial Sequence
  derived and/or modified sequence opt11 from anti-HIV-1_LightChain
gacauccaacucacccaaucccccuccuuccucuccgccuccgucggcgacaaagucaccuucaccugccgcgccucccaaggcguccgcaacgaacucgccugguaccaacaaaaacccggcaaagcccccaaccuccucaucuacuacgccuccacccuccaauccggcguccccucccgcuucuccgccaccggcucaggcacccacuucucccucaccgucuccucccuccaacccgaagacuucgccaccuacuucugccaacacauguccuccuacccccucaccuucggcggcggcaccaaagucgaaaucaaa

SEQ ID NO: 55158 - RNA, 321 nt, Artificial Sequence
  derived and/or modified sequence opt11 from anti-HIV-1_LightChain
gacauccaacucacccaaucccccuccuuccucuccgccuccgucggcgacaaagucaccaucacaugccgcgccucccaaggcguccgcaacgaacucgccugguaccaacaaaaacccggcaaagcccccaaccuacucaucuacuacgccuccacccuccaauccggaguccccucccgcuucuccgccaccggcuccggcacccacuucacccucaccgucuccucccuccaacccgaagacuucgccaccuacuucugccaacacauguccuccuacccccucaccuucggcggcggcaccaaagucgaaaucaaa

SEQ ID NO: 55159 - RNA, 366 nt, Artificial Sequence
  derived and/or modified sequence opt11 from anti-HIV-1_HeavyChain
ucccaauaccucgcccaacccggcgccgaagucgccaaacccggcgccuccgucaaagucuccugcaaaguccacggcgacaacuuccgcggccacuaccuccacuggguacgccaagcccccggccaaggccuccaauggaucggcggcaucaaccccuucuccggcgaagccgccuacggaaaacgcuucgaaggccgccuccgccucacccgcgacaccuccgucaacaccgccuacauggaacucgccaaacucacccccgacgacaccgccgucuacuucugcgcccgcgacaaaaccuacaacgacgaauucaccgccauggacaucuggggccacggcaccaccgucaucgucuccucc

SEQ ID NO: 55160 - RNA, 366 nt, Artificial Sequence
  derived and/or modified sequence opt11 from anti-HIV-1_HeavyChain
agccaguaccuggcccagcccggagccgaagucgcaaaaccgugggcaagcguaaaaguaagcugccgcguacacggagacaacuucagaggcuucuaccugcacugggucagacaagcgcccggacaaggacucgaauggauaggcggaaucaaccccuucagcggagaagcggccuacggcagacgcuucgaaggacgccugcgccugaccagagacacaagcauaaacacagccuacauggaagucacaaaacugaccucggacgacaccgcggucuacuucugcgccagagacaaaaccuacaacgacgaauucaccgcaauggacaucuggggccagggcacaaccgugaucguaagcuca

SEQ ID NO: 55161 - RNA, 366 nt, Artificial Sequence
  derived and/or modified sequence opt11 from anti-HIV-1_HeavyChain
agccaauaccuagcccaaagcggcagcgaagucaaaaaaccaggcgccagcguaaaagucagcugccgccuacacggagacaaauucggagcccacuacauacacugggucagacaagcaccaggccaaggacuagaauggcucggcuucuuccaccccggcaccggcgacgcagucucagcccaaaaauuccaaggacgcauaagccuaaccagagacacaagcauaagcaccggcuaccucgaagucagacgccuaagcucagacgacaccgcagucuacuacugcgccagagacaaaaccuacagcgacgaagcaaccggaauggacaucuggggccaaggcacaaccguaaucgucagcuca

SEQ ID NO: 55162 - RNA, 366 nt, Artificial Sequence
  derived and/or modified sequence opt11 from anti-HIV-1_HeavyChain
agcuuggaauugguccagagcgggaccgaggucaagaaaccgggcgcgagcgugaaagugagcuguaaauuguucggggacacgaucacgagcgggcccauacacugggucaggcaagcgccagggcaagggcucgaguggaugggcuggaccaauccccauagcggggacacggccacggccccgaaauuucaagggcgcguguacaugaccaaugacaagaaaauaaacacggccuuucucgaugucacgcgacuggccucggacgauaccgcgaucuauuucugugccagggacauguacuauagcaaugaagcggucgggauggaugucuggggccagggcacgaccgugagcgugagcucg

SEQ ID NO: 55163 - RNA, 366 nt, Artificial Sequence
  derived and/or modified sequence opt11 from anti-HIV-1_HeavyChain
caagaaguccucguccaauccggcgccgaagucaaaaaacccggcgccuccgucaaagucuccugccgcgccuucggcuacaccuucaccgcccacgcccuccacuggguccgccaagcccccggccaaggccucgaauggcuaggcuggaucaacccccacuccggcgacaccaccaccucccaaaaauuccaaggccgagucuacaugacacgcgacaaauccaucaacaccgccuaccuagaagucacccgccucaccuccgacgacaccgccaucuucuacugcgcccgcgacaaauacuacggcgacgaagccgucggcauggacgucuggggccaaggcaccuccgucaccgucuccucc

SEQ ID NO: 55164 - RNA, 366 nt, Artificial Sequence
  derived and/or modified sequence opt11 from anti-HIV-1_HeavyChain
caagaaguccuaguccaaagcggcgccgaagucaaaaaaccaggcgccagcgucaaagucagcugccgcgccuucggcuacaccuucaccggcaacgcccuccacuggguccgccaagcacccggccaaggccuagaauggcuaggcuggaucaacccccacuccggcgacaccaccaccagccaaaaauuccaaggccgcgucuacaugacccgagacaaagccaucaacacagccuaccucgacgucacacgccuaaccuccgacgacaccgccauauacuacugcgcccgagacaaauacuacggcaacgaagcagucggcauggacgucuggggccaaggcaccagcgucaccgucagcucc

SEQ ID NO: 55165 - RNA, 366 nt, Artificial Sequence
  derived and/or modified sequence opt11 from anti-HIV-1_HeavyChain
caggaagugcucgugcaaucgggcgcggaagugaaaaagcccggggccucggucaaggucucaugcagggccuuuggcuauaccuuuaccgggaacgcgcuccauugggugcgccaggccccgggccagggccuggaauggcucggguggauaaacccgcacucgggcgauaccacgaccucgcaaaaguuccagggcagggucuauaugacgcgcgauaaaucgaucaauaccgcguucuuggacgugaccaggcucacgagcgaugacacgggcauauacuauugcgcgcgcgauaaauauuacgggaacgaggccgugggcauggacgugugggggcaagggaccucggucacggucucgagc

SEQ ID NO: 55166 - RNA, 303 nt, Artificial Sequence
  derived and/or modified sequence opt11 from anti-HIV_45_LightChain
ucccucacccaaucccccggcacccucucccucucccccggcgaaaccgccaucaucuccugccgcaccucccaauacggcucccucgccugguaccaacaacgccccggccaagccccccgccucgucaucuacuccggcuccacccgcgccgccggcauccccgaccgcuucuccggcucccgcuggggccccgacuacaaccucaccaucuccaaccucgaauccggcgacuucggcgucuacuacugccaacaauacgaauucuucggccaaggcaccaaaguccaaguagacaucaaa

SEQ ID NO: 55167 - RNA, 303 nt, Artificial Sequence
  derived and/or modified sequence opt11 from anti-HIV_45_LightChain
guccucacccaaucccccggcacccucucccucucccccggagaaaccgccaccaucuccugccgcaccucccaauacggcucccucgccugguaccaacaacgccccggccaagccccccgccucgucaucuacuccggcuccacccgcgccgccggcauccccgaccgcuucuccggcucccgcuccggccccgacuacacccucaccaucuccaaccucgaauccggcgacuucggcgucuacuacugccaacaauacgaauucuucggccaaggcaccaaaguccaacaagacaacaaa

SEQ ID NO: 55168 - RNA, 303 nt, Artificial Sequence
  derived and/or modified sequence opt11 from anti-HIV_45_LightChain
guccucacccaaucccccggaacccucucccucucccccggcgaaaccgccaucaucuccugccgcaccucccaauacggcucccucgccugguaccaacaacgccccggccaagccccccgccucgucaucuacuccggcuccacccgcgccgccggcauccccgaccgcuucuccggcucccgcuggggccccgacuacaaccucaccaucuccaaccucgaauccggcgacuucggcgucuacuacugccaacaauacgaauucuucggccaaggcaccaaaguccaagucgacaucaaa

SEQ ID NO: 55169 - RNA, 363 nt, Artificial Sequence
  derived and/or modified sequence opt11 from anti-HIV_45_HeavyChain
caggucaggcucucgcaaucgggcgggcaaaugaaaaagcccggggaaucgaugaggaucucgugcagggccucgggauaugaauuuaucgauugcacgcucaauuggauacgcuuggccccgggcaggcgcccggaauggauggggugguugaaaccgcgcgggggcgcggucaauuacgcgcgcguguuccagggcagggucacgaugacgcgcgaugucuauagcgauaccgcguucuuggaauugcgcucgcucacggccgaugacacggccguguacuuuugcacacgcgggaaaacggucgauuacaauugggauuucgagcacgugggcccgggcacgcccgugaccgugagcucg

SEQ ID NO: 55170 - RNA, 363 nt, Artificial Sequence
  derived and/or modified sequence opt11 from anti-HIV_45_HeavyChain
caggucaggcucucgcaaucgggcgggcaaaugaaaaagcccggggaaucgaugaggaucucgugccaggccucgggcuaugaauuuaucgauugcacgcucaauugggugcgcuuggccccgggcaggcgcccggaauggauggggugguugaaaccgcgcgggggcgcggucaauuacgcgcgcauauuccagggcagggucacgaugacgcgcgaugucuauagcgauaccgcguucuuggaauugcgcucgcucacggccgaugacacggccguguacuuuugcacgcgcgggaaaaauugcgauuacaauugggauuucgagcacgugggcccgggcuaucccgugaccgugagcccg

SEQ ID NO: 55171 - RNA, 375 nt, Artificial Sequence
  derived and/or modified sequence opt11 from anti-HIV_45_HeavyChain
caaguccgccucucccaauccggcggccaaaugaaaaaacccggcgacuccaugcgcaucucaugccgcgccuccggcuacgaauucaucaacugccccaucaacuggauccgccucgcccccggcaaacgccccgaauggaugggcuggaugaaaccccgcggcggcgccgucuccuacgcccgccaacuccaaggccgcgucaccaugacccgagacauguacuccgaaaccgccuuccucgaacuccgcucacucaccuccgacgacaccgccgucuacuucugcacccgcggcaaauacugcaccgcccgcgacuacuacaacugggacuucgaacacuggggccaaggcacccccgucaccgucucaucc

SEQ ID NO: 55172 - RNA, 435 nt, Artificial Sequence
  derived and/or modified sequence opt11 from anti-HIV_cap256-206-252885_VR-Chain
caggaacagcucguggaaucgggcgggggcguggucccgcccgggagcucgcucacgcucucgugcguggccucgcgcuuuaccuuuagcgcguucgggaugcauugggugcgccaggccccgggcaagggcuuggaaugggucgcgggcgugagcuucgucgggauaaagaaauauuacgcggacucggucaagggcagguucacgaucucgcgcgauaacucgaaaaauaccuuguucuugcaaaugaacgggcucaggggcgaggacacgggcuuguacuauugcgugaaagauaugagguacuuggaaugugaagagugggcgagcgauuacuaugacuuuggcaagcccaaucaaccgugcuuggacaggcgcggggucucgggcauaagcgcguucuggggccagggcacgaccgugaccgugagcucg

SEQ ID NO: 55173 - RNA, 438 nt, Artificial Sequence
  derived and/or modified sequence opt11 from anti-HIV_cap256-206-249183_VR-Chain
caagugcuccuggucgagagcgggggcggggucguggaaccgggcacgagcuugacccugagcugugccgcgagcagguucacguucucgaacuucggcaugcacugggucaggcaaacgcccgggggcgggcucgaguggguggccucgaucucgaacgagggcaauaaaaaguaccaugccgagagcgugugggggcgcuuuaucauaagcagggacaauagcaagaacacggucuuucuccauaugucgagcuugcgcccggacgauagcgcgcucuauuucugugucagggacaggcaagaggacgauugcgaggucugguggucggacuaugaagcguucgggcgagagaucccgugcaggcaauaucgagggcaagggcuagcaggcauauucgauaucuggggcaggggaacgauggugaccgugagcucg

SEQ ID NO: 55174 - RNA, 438 nt, Artificial Sequence
  derived and/or modified sequence opt11 from anti-HIV_cap256-206-220956_VR-Chain
caaaugauguuggucgagagcgggggcgaugucguggaaccgggcaggagcuugacauugagcugugcaacgagccaguucacguucucgaacuauggaaugcacugggucaggcaagcgcccgggcgcgggcucgaguggguggccucgaucucgaacgagggcaauaaaaaguaccaugccgagagcgugugggggcgcuugaucauaagcagggacaauagcaagaacacgcuauuucuccauaugucgagcuugcgcgcggacgauagcgcgcucuauuucuguguaagggacaggcaagaggacgagugcgaggaaugguggucaaacuauuacgcguucgggcgcgggggcccgugcaggaaauaucgcgggcaagggcucgcgggcauauucgaugucuggggaaggggcacgauggugaccgugagcucg

SEQ ID NO: 55175 - RNA, 432 nt, Artificial Sequence
  derived and/or modified sequence opt11 from anti-HIV_cap256-206-220629_VR-Chain
caagagcaauuggucgagagcgggggcggggucgugccaccgggcaagaguuugaaauugagcugugucgcgagcagguucucguucggggccuuuggcaugcacugggucaggcaagcgcccgggaaagggcucgaguggguggccgggauaucguucgcgggcaucaaaaaguacuauggcgauagcgugaaagggcgcuuuuacauaagcagagacaauagccagaacacgcucuuucucgagaugaauggcuugcgaggggacgauaccgcgcgauauuacuguguaaaggacuugcgcgagcucgagugcgaggaaugggccucggacuauuacgauuucgggaaaccgcaaccgugcuuggacucgcgcggggucucgggcauaagcgcgauguggggcccgggcacgauggugaccgugagcucg

SEQ ID NO: 55176 - RNA, 381 nt, Artificial Sequence
  derived and/or modified sequence opt11 from anti-HIV_cap256-206-200599_VR-Chain
caagagaaauuggucgagagcgggggcggggccgugcaaccgggcgggagcuugagacugagcugugucgcgagcggguucacguucaauggcuuuggcaugcacugggucaggcaagcgcccgggaaagggcucgaguggguggccacgaucucguucucgggcguguacauaagcagggaaaauagcaagaacacgcucuaucuccagaugaauggcuugcgaggggaagauaccgcgcucuauuacugugccaaggacuugcgcuaccucgagugcggggaauggagcacguacuauccccagcccugucucgauaccaggggcgugagcgggaucucgaacgugugggggcccgggaccagggucacggucucgagc

SEQ ID NO: 55177 - RNA, 432 nt, Artificial Sequence
  derived and/or modified sequence opt11 from anti-HIV_cap256-206-186347_VR-Chain
caagagcucuuggucgagagcgggggcggggucgugcccccgggcaagagcuugaccauaagcugugucgcgagcagguucacguucucggccuuuggcaugcacugggucaggcaagcgcccgggaaagggcuacaguggguggccucgaucucguucgcgggcacgaaaaaguacuaugccgacuucgugaaagggcgcuuuaccauaagcagggacaauagcaagaacacgaucuuucuccagaugaauggcuugcgcggggaagauaccgcgcucuaucacugugucaaggacaugcgacagcuagagugcgaggaauggaccucggacuauuacgauuucgggcgcccgcaaccgugcauagacaggcgcggggucucgggcauaagcgcgauguggggcccgggcacgauggugaccgugagcucg

SEQ ID NO: 55178 - RNA, 438 nt, Artificial Sequence
  derived and/or modified sequence opt11 from anti-HIV_cap256-206-186226_VR-Chain
caaaugcucuuggucgagagcgggggcggggucguggaaccgggcaggaguuugaccuugagcugugccacgagccaguucacguucucgaacuauggcaugcacugggucaggcaaacgcccgggacagggcucgaguggguggccucgaucucgaacgagggcaauaaaaaguaccauggcgaggccgugugggggcgcuuuaucauaagcagggacaauagcaagaaaacgcucuuucuccauaugucgaacuugcgcgcggacgauagcgggcucuauuucugugucagggacaggcaagaggacgagugcgaggaaugguggucggacuauuacucguucgggcgcgggggcccgugcaggaaauaucacgggcaaggacucgcgggcauauucgauauauggggcaggggcacgcucgugaccgugagcucg

SEQ ID NO: 55179 - RNA, 435 nt, Artificial Sequence
  derived and/or modified sequence opt11 from anti-HIV_cap256-206-179686_VR-Chain
caagagcaauugguagagagcgggggcggggucgugcccccguggaaaagccugaccuugagcugugaagcgagcagauucacguucucggccuuuggcaugcacugggucaggcaagcgcccgggaaagggcucgaguggguggccgggaucucguucgcgggcauaaagaaguacuaugccgauagcgugaaagggcgauuuuucauaagcagggacaauagcaagaacagggucuugcucgagaugaauggcuugcgcagggaagauaccgcgcgcuauuucugugucaaggacuugcgcgagcucgagugcgaggaaugggccucggacuauuacgauuucgggaaaccgaaccagcccugucucgauagaaggggcgugagcgggaucucggccaugugggggcaagggaccauggucacggucucgagc

SEQ ID NO: 55180 - RNA, 417 nt, Artificial Sequence
  derived and/or modified sequence opt11 from anti-HIV_cap256-206-173707_VR-Chain
caagagaaauuggucgagagcgggggcggggccgugcaaccgggcgggagccugcgcuugagcugugucgcgagcggguucacguucaagggcuuuggcaugcacugggucagacaagcgcccgggaaagggcucgaguggguggccacgaucucguucucgggagugaaaaaguacuauggcaauagcgcgaaagggcgcuuuuucauaagcagggacaaucucaagaacacggucuaucuagagaugaauggcuugcgcggggaagauaccgcgcucuauuacugugccaaggaccugcgcuaucucgagugcggggaauggagcacguacuauccccagcccugucucgauaccaggggcgugagcgggaucucgaacgugugggggcccgggaccaaggucacggucucgagc

SEQ ID NO: 55181 - RNA, 432 nt, Artificial Sequence
  derived and/or modified sequence opt11 from anti-HIV_cap256-206-173339_VR-Chain
caagagcuccuggucgagagcgggggcggggucgugcccccgggaaagagcuugaaauugagcugugucgcgagcagguucacguucggggccuuuggcaugcacugggucaggcaagcgcccgggaaagggcucgaguggguggccgggaucucguucgcgggcacgaaaaauuacuaugccgauagcgugaaagggcgcuuuaccauaagcagggacaaucccaagaacacgcuauuucuucagaugaauggccugcgcggggacgauaccgggcuauauuacugugucaaggacaugcgagagcucgagugcgagcucuggacaucggacuauuacgauuucgggcgcccgcaaccgugcauagaccagcgcggggucucgggcauaagcgcgauguggggccagggcacgaugguaaccauaagcucg

SEQ ID NO: 55182 - RNA, 438 nt, Artificial Sequence
  derived and/or modified sequence opt11 from anti-HIV_cap256-206-172689_VR-Chain
caaaugauguuggucgagagcgggggcggggucguggaaccgggcaggagcuugaccuugagcugugccacgagccauuucacguucucgaacuauggcaugcacugggucaggcaagcgcccgggggcaggcucgaguggguggccucgaucucgaacgcgggcaauaaaaaguaccauggcgauagcgugugggggcgauugaucauaagcagggacaauagcaagaacacgcucuuucuccauaugucgagcuugcgcguggacgauagcgcgcucuauuucugugucagggacaggcaagaggacgagugcgaggaaugguggucggacuauuacgcguucgggcgagggggaccgugcaggaaauaucgagggcaagggcucgcgggaauauucgauaucuggggcaggggcacgauggugaccgugagcucg

SEQ ID NO: 55183 - RNA, 432 nt, Artificial Sequence
  derived and/or modified sequence opt11 from anti-HIV_cap256-206-162744_VR-Chain
caagagaaauuggucgagagcgggggcggggucgugccaccgggcaagagcuugcgcuugagcugugucgcgagcggguucacguucucagccuuuggcaugcacugggucaggcaagcgccagggaaagggcucgaguggguggccgggauaucguucgcgggcaucaaaaauuacuaugccgauagcgugaaagggcgcuuuaccauaagcagggacaauagcaagaacagccucuuccuccagaugaauggcuugcgcggggacgauaccgcgcgcuauuacugugucaaggacaugcgcgagcucgagugcgaggaauggacaucggacuauuacgacuucgggaaaccgcaaccgugcauagacaggcgcggggucucgggcauaucggcgauguggggccagggaacgauggugaccauaagcuca

SEQ ID NO: 55184 - RNA, 438 nt, Artificial Sequence
  derived and/or modified sequence opt11 from anti-HIV_cap256-206-146057_VR-Chain
caaaugcaauuggucgagagcgggggcggggucgugcaaccgggcacgagcuugaccuugagcugugucgcgagccaguucacguucucgaacuauggaaugcacuggaucaggcaagcgcccgggcaagggcucgaguggguggccucgaucucgaacgauggcgggaaaagguaccauggcgaugccgugugggcgcgcuuuaucauaagcagggacaauagcaagaacacggucuuucuacagaugacgagcuugcgcgcggaagauaccgcgcgcuauuucugugucagggacaggcaagaggacgagugcuuggaaugguggucggacuauuacaauuucgggcgccagcucccgugcgcgaaauuucgcgggcucgggcucgcgggcguguucgauaucuggggccauggcacgauggugaccgugagcucg

SEQ ID NO: 55185 - RNA, 435 nt, Artificial Sequence
  derived and/or modified sequence opt11 from anti-HIV_cap256-206-139519_VR-Chain
caagagcaauuggucgagagcgggggcggggucgugcccccgggcacgagcuugcgccugagcugugucgcgagcagguucucguucgggagcuuuggaaugcacugggucaggcaagcgcccgggaaagggcucgaguggguggccgggaucucguucgugggcaucaaaaaguacuauggcgauagcgugaaagggcgcuuuuucauaagcagggacaauagcaagaacacgcucuuucucgagaugaauggccugcgcggggaagauaccgcgcgcuauuacugugucaaggacaugcgcgagcucgagugcgaggaaugggccucggacuauuacgauuucgggaaaccgaaccagcccugucucgauagaaggggcgugagcgggauaucggccaugugggggcccgggaccaugcucacggucucgagc

SEQ ID NO: 55186 - RNA, 432 nt, Artificial Sequence
  derived and/or modified sequence opt11 from anti-HIV_cap256-206-136316_VR-Chain
caagagcaacuggucgagagcgggggcggggucgugcccccgggcaagagcuugaccuugagcuguguagcgagcggguucacguucucggccuuuggcaugcacugggucaggcaagcgcccgggaaagggcucgaguggguggccgggauaucguucgugggcaucaaaaaguacuauggcgauagcgugaaagggcgcuuuaccauaagcagggacaauagcaagaacacgcucuuucuccagaugaauggcuugcgcggggacgauaccgcgcucuaucacugugucaaggacaugcgccagcucgagugcgaggaauggaccucggacuauuacgauuucgggaaaccgcaaccgugcauagacccgcgcggggucucgggcauaagcgcgauguggggacagggcacgauggugaccgugagcucg

SEQ ID NO: 55187 - RNA, 438 nt, Artificial Sequence
  derived and/or modified sequence opt11 from anti-HIV_cap256-206-116098_VR-Chain
caaaugauguuggucgagagcgggggcggggucguggaaccgggcaggagcuugaccuugagcugugccgcgagccaguucacguucucgaacuauggcaugcacugggucaggcaagcgcccggacgcgagcucgaguggguggccucgaucucgaacgcgggcaauaaaaaguaccauggcgaggccgugugggggcgcuugaucauaagcagggacaauagcaagaacacgcuuuuucuccauaugucaaacuugcgcccggacgacagcgcgcuauauuucugugucagggacaggcaagaggacgagugcgaggaaugguggucggacuauuacgcguucgggcgcgggggcccgugcaggaaauaucacgggcaagggcucgcgggcauauucgauaucuggggcaggggcacgauggugaccgugagcucg

SEQ ID NO: 55188 - RNA, 432 nt, Artificial Sequence
  derived and/or modified sequence opt11 from anti-HIV_cap256-206-115862_VR-Chain
caagagcaauuggucgagagcgggggcggggucgugccaccgggcaagagccugcgcuugagcugugucgggagcagguucacguucucggccuuuggcaugcacugggucaggcaagcgccagggaaagggcucgaguggguggccucgaucucguucgcgggcacgaaaaaguacuaugucgauagcgugaaagggcgcuuuuucauaagcagggacaauaguaagaacacggucuuucucgagaugaauggcuugcgcggggaagacaccgggcucuauuacugugucaaggacaugagagagcucgagugcgaggaaugggccucggacuauuacgauuucgggaaaccgcaaccgugcuuggacaggcgcggggucucgggcauaagcgcgauguggggacagggcacgcucgugaucauaagcucg

SEQ ID NO: 55189 - RNA, 435 nt, Artificial Sequence
  derived and/or modified sequence opt11 from anti-HIV_cap256-206-107018_VR-Chain
caagagcaauuggucgagagcgggggcgggguagugcccccgggcaagagcuugaccuugagcugugucgcgagcagguucucguucucggccuuuggcaugcacugggucaggcaagcgcccgggaaagggcuagaguggguggcaucgaucucauucgugggcaucaaaaaguacuauggcgauagcgugaaagggcgauuuuucauaagcagggacaauagcaagaacacggucuuucucgagaugaauggcuugcgcggggaagauaccgggcucuauuacuguguaaaggacaugcgcgagcucgagugcgaggaaugggcaucggacuauuacgauuucgggaaaccgaaccagcccugucucgaucgcaggggcgugagcgggauaucggccaugugggggcaagggaccuuggucauagucucgagc

SEQ ID NO: 55190 - RNA, 438 nt, Artificial Sequence
  derived and/or modified sequence opt11 from anti-HIV_cap256-206-098644_VR-Chain
caaaugcuauuggucgagagcgggggcggggucguggaaccgggcaggagccugaccuugagcugugccgcgagccaguucacguucucgaacuauggcaugcacugggucaggcaagcgcccgggggcgggcucgaguggguggcaucgaucucgaacgagggcaauaaaagguaccauggagagagcgugugggggcgcuuugucauaagcagggacaacaguaagaacacgcuauuucuccauaugucgaccuugcgcccggacgauagcgcgcuauauuucugugucagggacaggcaagaggacgagugcgaggaaugguggucggacuauuacgcguucgggcgagggggaccgugcaggaaauaucacgggcaagggcuagcgggcauauucgaugucuggggcaggggcacgauggugaccgggcucuuu

SEQ ID NO: 55191 - RNA, 417 nt, Artificial Sequence
  derived and/or modified sequence opt11 from anti-HIV_cap256-206-098135_VR-Chain
caagagaaauuggucgagagcgggggcggggccgugcaaccgggcgggagcuugagauugagcugugucgcgagcggguucacguucucgggcuuuggcaugcacugggucaggcaagcgcccgggaaagggcuagaguggguggccacgaucucguucucgggcaugaaaaaguacuauggcacgagcgcgaaagggcgauuuagcauauacagggacaauagcaagaacacgcucuaucuccagauggauggcuugagagagaaagauaccgcgcucuauuacugugccaaggaccugcgcuaucucgagugcggggaauggagcacguacuauccccagcccugucucgaucgcaggggcgugagcgggaucucgaacgugugggggcccgggaccauggucacgguaucgagc

SEQ ID NO: 55192 - RNA, 435 nt, Artificial Sequence
  derived and/or modified sequence opt11 from anti-HIV_cap256-206-096276_VR-Chain
caggagcagcugguggagagcgggggagggguggugccgccggggaguagcuugagguugagcugcguggcgagcagguucacguucagcgcguuugggaugcacugggugaggcaggcgccggggaaagggcuggaguggguggcggggauaaguuucguggggauaaagaaguacuaugcggauagcgugaaagggagguuuacgauaagcagggacaauagcaagaacacgcuguuucugcagaugaauggguugaggggggaggauacggggcuguauuacugcgugaaggacaugagagagcuggagugcgaggaauggaggagugacuauuacgauuucgggaagccgaaccagccguaucuggauaggaggggggugagcgggauaagugcauuuugggggcaggggacgauggugacggugaguagc

SEQ ID NO: 55193 - RNA, 438 nt, Artificial Sequence
  derived and/or modified sequence opt11 from anti-HIV_cap256-206-092794_VR-Chain
caaaugauguuggucgagagcgggggcggggucguggaaccgggcaggagcuugacacugagcugugcaacgagucaguucacauucucgaacuauggcaugcacugggucaggcaagcgcccgggcgcgggcucgaguggguggccucgaucucgaacgagggcaauaaaagguaccauggcgagagcgugugggggcgcuuuaucauaagcagggacaauagcaagaacacgcucuuucuccauaugucgaccuugcgcgcggacgauagcgcgcucuauuucugugucagggacaggcaagaggacgagugcgaggaaugguggucggacuauuacgcguucgggcgcgggggaccgugcaggaaauaucacgggcaagggcucgcgggcauauucgauaucgugggcaggggcacgcucgugaccgugagcucg

SEQ ID NO: 55194 - RNA, 432 nt, Artificial Sequence
  derived and/or modified sequence opt11 from anti-HIV_cap256-206-086817_VR-Chain
caggagcaguugguggagagcgggggggggguggugccgccggggaagagcuugagguugaguugugcggcgaguggguuuaguuuuggggcguuugggaugcauugggugaggcaggcgccggggaaggggcuggaguggguggcggggauaaguuuuguggggauaaaguauuauuaugcggauagugugaaggggagguuuacgauaaguagggacaauaguaagaauacgguguuucuacagaugaauggguugagaggggaugauacggggagguauuauugugugaaggauaugagggaguuggagugugaggaguggacgagcgauuauuaugauuuugggaagccgcagccguguauagauaggaggggggugagugggauaagugcgaugugggggcaggggacgauggugacgauaaguagu

SEQ ID NO: 55195 - RNA, 432 nt, Artificial Sequence
  derived and/or modified sequence opt11 from anti-HIV_cap256-206-086446_VR-Chain
caagagcaauugguagagagcgggggcggggucgugcccccgggaaagagcuugcgcuugagcugugucgcgagcagauucacguucucggccuuuggcaugcacugggucaggcaagcgcccgggaaagggcucgaguggguggccgggauaucguucgugggcaucaaaaaguacuauagcgaugcagugaaagggcgcuuuuacauaagcagggacaauagcaagaacacgcucuuucuagagaugaauggcuugcgcggggacgauaccgcgcgcuauuacugugucaaggacuugcgcgagcucgagugcgaggaaugggccucggacuauuacgauuucgggaaaccgcaaccgugcuuggacucgcgcggggucucgggcauaagcgcgauguggggccagggcacgauggugaccgugagcucg

SEQ ID NO: 55196 - RNA, 432 nt, Artificial Sequence
  derived and/or modified sequence opt11 from anti-HIV_cap256-206-086180_VR-Chain
caagagcaauuggaagagagcgggggcggggucgugcccccgggcaagagcuugcgcuugagcugugucgcgagcagguucacguucucggcauuuggcaugcacugggucagacaagcgcccgggaaagggcucgaguggguggccgggauaucguucgugggcaucaaaaaguacuaugccgacagcgugaaagggcgcuuuaccauaagcagggacaauagcaagaacacgcucuuucuccagaugaauggcuugcgcggggacgauaccgggcucuauuucugugucaaggacaugcgcgagcuagagugcgagcaauggaccucggacuauuacgacuucgggaaaccgcaaccgugcauagacccgcgaggggucucgggcauaagcgcgauguggggccagggaacgauggugaccguaagcucg

SEQ ID NO: 55197 - RNA, 435 nt, Artificial Sequence
  derived and/or modified sequence opt11 from anti-HIV_cap256-206-083708_VR-Chain
caagagcaauugguagagagcgggggcggagucauacccccgggccagagccugcgauugagcugugucgcgagcagguucacguucucggccuuuggcaugcacuggguaaggcaagcgcccgggaaagggcucgagugggugagcucggucucguucgcgggcaucaaaaaguacuaugccgauagcgugaaagggcgcuuuuucauaagcagggacaauagcaagaacacggucuuucucgagaugaauggccugcgcggggaagauaccgggcucuauuacugugucaaggacaugcgagagcucgagugcgaggaaugggccucggacuauuacgauuucgggaaaccggaccagcccugucucgaucgcaggggcgugagcgggauaucggccaugugggggcaagggaccuuggucauagucucgagc

SEQ ID NO: 55198 - RNA, 432 nt, Artificial Sequence
  derived and/or modified sequence opt11 from anti-HIV_cap256-206-079556_VR-Chain
caagagcaauuggucgagagcgggggcggggucgugcccccgggcaagagcuugcgcuugagcugugucgcgagcggguucacguucucgggcuuuggaaugcacuggguaaggcaagcgcccgggaaagggcucgaguggguggccgggaucucguucgugggcauaaaauauuacuaugccgauagcgugaaagggcgcuuuagcauaagcagagacaauagcaagaacacgcucuuucuccagaugaauggcuugcgcggggacgauaccgcgcuauauuacugugucaaggacaugcgcgagcucgagugcgaggaauggaccucggacuauuacgauuucgggaaaccgcaaccgugcauagacaggcgcggggucucgggcauaagcgcaauguggggccagggaacgauggugaccguaagcucg

SEQ ID NO: 55199 - RNA, 438 nt, Artificial Sequence
  derived and/or modified sequence opt11 from anti-HIV_cap256-206-078657_VR-Chain
caaaugcucuuggucgagagcgggggcggggucguggaaccgggcaggagcuugaccuugagcugugccacgagucaguucacguucucgaacuauggcaugcacugggucaggcaagcgcccgggcgcgggcucgaguggguggccucgaucucgaacgagggcucgaaaaaguaccauggagagcccgugugggggcgcuuuaucauaagcagggacaauagcaagaaaacgcucuuucuccauaugucgaacuugcgcguggacgauagcgcgcucuauuucugugucagggacaggcaagaggacgagugcgaggaaugguggucggacuauuacgcguucgggcgcgggggcccgugcaggaaauaucacgggcaagggcucgcgggcauauucgauaucuggggcaggggcacgauggugaccgugagcucg

SEQ ID NO: 55200 - RNA, 438 nt, Artificial Sequence
  derived and/or modified sequence opt11 from anti-HIV_cap256-206-075802_VR-Chain
caaaugcucuugguagagagcgggggcgaugucguggaaccgggcaagagcuugaccuugagcugugccacgagcagguucacguucucgaacuauggcaugcacuggguaagacaagcgcccgggggcgggcucgaguggguggccucgaucucgaacgagggcaauaaaaaguaccauggcgagagcguaugggggcgauuuaucauaagcagggacaauagcaagaacacgcucuuucuccauaugucggccuugcgcacggacgauagcgcgcucuauuucugugucagagacaggcaagaggacgagugcgaggaaugguggucggacuauuacgcguucgggcgcgggggcccgugcaggaaauaucacgggcaagggcucgcgggcauauucgauaucuggggcaggggcacgauggugaccgugagcucg

SEQ ID NO: 55201 - RNA, 438 nt, Artificial Sequence
  derived and/or modified sequence opt11 from anti-HIV_cap256-206-069097_VR-Chain
caaaugcucuuggucgagagcgggggcggggucguggaaccgggcaggagcuugaccuugagcugugccacgagcagguucacguucucgaacuauggcaugcacuggguaaggcaagcgcccgggcgcgagcuagaguggguggcaucgaucucgaacgagggcaauaaaaaguaccaugccgagagcgugugggggcgcuuuaucauaagcagggacaauagcaagaacacgcucuuucuccauaugucgaacgugcgcggggacgauagcgcgcucuauuucugugucagggacaggcaagaggacgagugcgaggaaugguggucggacuauuacgcguucgggcgcgggggcccgugcaggaaauaucacgggcaagggcucgcgggcauauucgaugucuggggcaggggcacggucgugaccgugagcucg

SEQ ID NO: 55202 - RNA, 438 nt, Artificial Sequence
  derived and/or modified sequence opt11 from anti-HIV_cap256-206-067758_VR-Chain
caaaugcucuuggucgagagcgggggcggggucguggaaccgggcaggagcuugaccuugagcugugccgcgagccaguucacguucucgcacuauggcaugcacugggucaggcaagcgcccgggcgcgggcucgaguggguggccucgaucucaaacgagggcaauaaaagguaccauggcgagagcgugugggggcgcuuuaucauaagcagggacaauagcaagaacacgcucuuucuccauaugucggcauugcgcacggacgauagcgcgcucuauuucugugucagggacaggcaagaggacgagugcgaggaaugguggucggacuauuacgcguucgggcgcgggggcccgugcaggaaauggcacgggcaagggcucgcgggcauauucgauaucuggggcaggggcacggucgugaccgugagcucg

SEQ ID NO: 55203 - RNA, 417 nt, Artificial Sequence
  derived and/or modified sequence opt11 from anti-HIV_cap256-206-057019_VR-Chain
caagagaaauuggucgagagcgggggcggggccgugcaaccgggcgggagcuugcgcuugagcugugucgcgagcggguucucguucucgggcuauggcaugcacugggucaggcaagcgcccgggaaagggcuagaguggcuggccacgaucucguucucgggcgugaaaaaguacuauggcacgagcgcgaaagggcgcuuuuacauauacagggacaauaccaagaacacgauguaucucgagaugaauggcuugcgcggggaagauaccgcgcuauauuacugugcaaaggacuugcgcuaucucgagugcggggaauggagcacguacuauccccagcccugucucgauaccaggggcgugagcggaaucucgaacgugugggggcccgggaccauggucacggucucgagc

SEQ ID NO: 55204 - RNA, 438 nt, Artificial Sequence
  derived and/or modified sequence opt11 from anti-HIV_cap256-206-055385_VR-Chain
caaaugauguugguagagagcgggggcggggucguggaaccgggcaggagcuugacauugagcugugccgcgagcaaguucacguucucgaacuauggcaugcacugggucaggcaagcgcccgggcgcgggcuagaguggguggcaucgaucucgaacgagggcaauaaaaaguaccauggcgagcccgugugggggcgcuugaucauaagcagggacaauagcaagaacacgcucuuucuccauaugucggacuugcgcgcggacgauagcgcgcucuauuucugugucagggacaggcaagaggacgagugcgaggaaugguggucgaacuauuacgcguucgggcgcgggggcccgugcagaaaauggcgagggcaagggcucgcgggcauauucgauguauggggcaggggcacgauggugaccgugagcucg

SEQ ID NO: 55205 - RNA, 435 nt, Artificial Sequence
  derived and/or modified sequence opt11 from anti-HIV_cap256-206-053187_VR-Chain
caagagcaacugguagagagcgggggcggggucgugcccccgggaucgagccugcgauugagcugugucgcgagcagguucacguucucggccuuuggcaugcacuggguaaggcaagcgcccgggaaagggcucgaguggguggcagggauaucguucgugggaauaaaauauuacuaugcagauagcgugaaagggcgauuuaccauaagcagggacaauagcaagaacacgcucuuucuccagaugaauggccugagaggggaagauaccggacuauauuacuguguaaaggacaugcgcgagcuagagugcgaggaaugggcaucggacuauuacgauuucgggaaaccgaaccagccaugucucgaucgcaggggagugagcgggauaucggcauuuugggggcaagggaccauggucacgguaucgagc

SEQ ID NO: 55206 - RNA, 438 nt, Artificial Sequence
  derived and/or modified sequence opt11 from anti-HIV_cap256-206-053139_VR-Chain
caaaugcucuuggucgagagcgggggcgaugucguggaaccgggcaggagcuugaccuugagcugugccacgagccaguucacguucucgaacuauggcaugcacugggucaggcaagcgcccgggcgagggcucgaguggguggccucgaucucgaacgagggcucgaaaaaguaccauggcgagagcgugugggggcgcuuuaucauaagcagggacaauagcaagaacacgcuauuucuccauaugacgacccugcgaccggacgauagcgcgcucuauuucugugucagggacaggcaagaggacgagugcgaggaaugguggucggacuauuacgcguucgggcgcgggggcccgugcaggaaauaucacgggcaagggcuagcgggcauauucgauauauggggcagaggcacgauggugaccgugagcucg

SEQ ID NO: 55207 - RNA, 432 nt, Artificial Sequence
  derived and/or modified sequence opt11 from anti-HIV_cap256-206-050350_VR-Chain
caagagcaauuggucgagagcgggggcggggucgugcccccgggcaagagccugaaauugagcugugucgcgagcagguucucguucggggccuuuggcaugcacuggguaaggcaagcgcccgggaaagggcuagaguggguggccgggauaucguucgugggcaucaaaaaguacuaugccgauagcgugaaagggcgcuuuuacauaagcagggacaauagcaagaacacggucuuucucgagaugaaugccuugcgcggggaagauaccgcgcucuaucacugugucaaggacaugcgcgagcucgagugcgaggaaugggccucggacuauuacgauuucgggaaaccgcaaccgugcuuggacaggcgcggggucucgggcauaagcgcgauguggggcccgggaacgauggugauagugagcucg

SEQ ID NO: 55208 - RNA, 432 nt, Artificial Sequence
  derived and/or modified sequence opt11 from anti-HIV_cap256-206-046207_VR-Chain
caagagcaauuggucgagagcggaggcgggguagugcccccgggaacgagcuugcgcuugagcugugucgcgagcagguucacguucucggccuuuggcaugcacugggucaggcaagcgcccgggaaaggacucgaguggguggccgggauaucauucgcgggcaucaaaaaguacuaugccgauagcgugaaagggcgcuuuaccauaagcagggacaauagcaagaacucgcuauuucucgagaugaauggccugcgaggggacgauaccgcgcucuauuacugugucaaggacuugcgcuaucucgagugcgagcucuggaccucggacuauuacgauuucgggcgaccgcaaccgugcauagacucgcgcggggucucgggaauaagcgcgauguggggcccgggcacgauggugaccgugagcgcg

SEQ ID NO: 55209 - RNA, 417 nt, Artificial Sequence
  derived and/or modified sequence opt11 from anti-HIV_cap256-206-043389_VR-Chain
caagaaaaacuagucgaauccggcggcggcgccguccaacccggcggcagccuccgccuauccugcgucgccagcggcuucaccuucuccggcuucggcaugcacugguuccgacaagcccccggcaaaggccucgaaugggucgccacaaucucauucuccggcaucaaaaaauacuacaacaccagcgccaaaggccgcuucuucaucagccgcgacaacaccaaagacacacucuaccuccaaauggacggccuccaagaaaaagacaccgcccucuaccucugcgccaaagaccuccgcuaccucgaaugcggcuacugguccaccuacuacccccaacccugccucgacacccgcggcgucuccggaaucucaaacgucuggggccccggcaccauggucaccgucucaucc

SEQ ID NO: 55210 - RNA, 432 nt, Artificial Sequence
  derived and/or modified sequence opt11 from anti-HIV_cap256-206-042555_VR-Chain
caagagcaauuggucgagagcgggggcggggucgugcccccgggcaagagcuugcgcuugagcugugucgugagcggguucacguucucggccuuuggcaugcacugggucaggcaagcgcccgggaaagggcucgaguggguggccgggaucucguucgcgggcacgaaaucguacuaugccgagagcgugaaagggcgauuuaccauaagcagggacaauagcaagaacucgcucuuucuccagaugaauggcuugcgcggggacgauaccgcacucuauuacugugucaaggacaugcgcgagcucgagugcgagcucuggaccucggacuauuacgauuucgggcgcccgcaaccgugcauagacaggcgcggagucucgggcauaagcgcgauguggggccagggcacgauggugaccauaagcucg

SEQ ID NO: 55211 - RNA, 432 nt, Artificial Sequence
  derived and/or modified sequence opt11 from anti-HIV_cap256-206-029720_VR-Chain
caagagaaauuggucgagagcgggggcggggucgugcaaccgggcaggagcuugaccuugagcugugucgcgagccauuucacauucucgggcgugggcaugcacugggucagacaagcgcccgggaaagggcucgaguggguggccgggauaucguucgcgggcacgcgcaaguacuaugccgauagcgugaaagggcgcuuuaccauaagcagggacaauagcaagaacacggucuaucuccagaugaauggcuugcgcggggaagauaccgcgcucuaucacugugccaaggacuugcgcgagcucgagugcgagcucuggaccucggacuauuacgacuucgggcgcccgcaaccgugcauagacaggcgcggggucucgggcauaugcgauauguggggccagggcacgauggugauagugagcucg

SEQ ID NO: 55212 - RNA, 432 nt, Artificial Sequence
  derived and/or modified sequence opt11 from anti-HIV_cap256-206-028848_VR-Chain
caagagcaauuggucgagagcgggggcggggucgugccaccgggcaagagcuugcgccugagcugugucgcgagcggguucacguucucgggcuuuggcaugcacugggucaggcaagcgcccgggaaagggcuccaguggguggccgggaucucguucgcgggcacgaaauauuacuaugaagauagcgugaaagggcgcuuuaccauaagcagggacaauagcaagaacacggucuuucuccagaugaauggauugcgaggggacgauacagcgcuauauuacugugucaaggacaugcgagagcucgagugcgaggaauggaccucggacuauuacgauuucgggaaaccgcaaccgugcauagacaggcgcggggucucgggcauaagcgcgauguggggccagggcacgauggugaccauaagcucg

SEQ ID NO: 55213 - RNA, 432 nt, Artificial Sequence
  derived and/or modified sequence opt11 from anti-HIV_cap256-206-027652_VR-Chain
caagagcaauugguagugagcgggggagaugucgugcccccgggcaagagcuugcgcuugagcugugucgcgagcggguucacauucucggccuuuggcaugcacugggucaggcaagcgcccgggaaagggcucgaguggguggccucgaucucguucgcgggcacgaaauauuacuaugccgauagcgugaaagggcgcuuugccauaagcagagacaauagcaagaacacgcucuuucuccagaugaauggcuugcgcagggaagauacagggcucuauuacugugucaaggacaugcgccagcucgagugcgaggaauggaccucggacuauuacgauuucgggcgcccgcaaccgugcauagacaggcgcggggucucgggcauaagcgcaauguggggccagggcacgauggugaccauaagcucg

SEQ ID NO: 55214 - RNA, 417 nt, Artificial Sequence
  derived and/or modified sequence opt11 from anti-HIV_cap256-206-024075_VR-Chain
caagagaaauuggucgagagcgggggcggggccgugcaaccgggcgggagcuugcgcuugagcugugucgcgagcggguucacguucucgggcuuuggcaugcacugggucaggcaagcgcccgggaaagggcuagagugguuggccacgaucucguucucgggcgugaaaaaguacuauggcacgagcgcgaaagggcgcuuuuacauaagcagagacaauaccaagaacacggucuaucuccagauggauggcuugcgcggggacgauaccgcgaucuauuacugugccaaggacuugcgcuuucucgagugcgggcucuggagcacguacuauccccagccaugucucgauaccaggggcgugagcgggaucucgaacgugugggggcccgggaccauggucacggucucgagc

SEQ ID NO: 55215 - RNA, 417 nt, Artificial Sequence
  derived and/or modified sequence opt11 from anti-HIV_cap256-206-008748_VR-Chain
caagagaaauuggucgagagcgggggcggggccgugcaaccgggcgggagcuugcgcuugagcugugucgcgaguggguucacguucaauggcuuuggcaugcacugggucaggcaagcgcccgggaaagggcucgaguggguggccacgaucucguucucgggagugaaaaaguacuauggcacgagcgcgaaagggcgcuuuuucauaagcagggaaaauagcaagaacacgcuauaucuacagaugaauggcuugcgaggggaagauacagcgcucuauuacugugccaaggacuugcgcuaucucgagugcggggaauggagcacguacuauccccagcccugucuagauaccaggggcgugagcgggaucucgaacgugugggggcccgggaccagggucacggucucgagc

SEQ ID NO: 55216 - RNA, 432 nt, Artificial Sequence
  derived and/or modified sequence opt11 from anti-HIV_cap256-206-008530_VR-Chain
caagagcaauuggucgagagcgggggcggggucgugcccccgggcaagagcuugcgcuugagcugugucgcgagcggguucucguucggggccuuuggcaugcacugggucaggcaagcgcccgggaaagggcucgaguggguggccgggaucucguucgugggcauaaaauauuacuaugccgauagcgugaaagggcgcuuuaccauaagcagggacaauagcaagaaaacgcucuuucuccagaugaauggcuugcgcggggacgauaccgcgcuauauuacugugucaaggacaugcgcgagcucgagugcgaggaauggaccucggacuauuacgauuucgggaaaccgcaaccgugcauagacaggcgcggggucucgggcauaagcgcguucuggggccagggcacgauggugaccauaagcucg

SEQ ID NO: 55217 - RNA, 432 nt, Artificial Sequence
  derived and/or modified sequence opt11 from anti-HIV_cap256-176-723043_VR-Chain
caagagcaauuggucgagagcgggggcggggucgugccaccgggcaagagcuugcgauugagcugugucgcgagcggguucacguucucagccuuuggcaugcacugggucaggcaagcgcccgggaaagggcucgaguggguggccggggucucguucgcgggcauaaaauauuacuaugccgauagcgugaaagggcgcuuuaccauaagcagagacaauagcaagaacacgcucuuucuacagaugaauggcuugcgcggggacgauaccgcgcucuauuacugugucaaggacuugcgcgagcuagagugcgaggaauggaccucggacuauuacgauuucgggcgcccgcaaccgugcauagacccgcgcggggucucgggcauaagcgcgauguggggccagggcacggucgugaccauaagcucg

SEQ ID NO: 55218 - RNA, 432 nt, Artificial Sequence
  derived and/or modified sequence opt11 from anti-HIV_cap256-176-600049_VR-Chain
gaagugcaauugguccagagcgggggcggggucgugcaaccgggcaggagcuugcgcuugagcugugccgcgccauauuucgaguucgggcgcuacggcuuucacugggucaggcaagcgcccgggaaagggcuagaguggguggccucgaucucguucgcgggcaggggcuauuaccauagcccgagcgugugggggcgauuuaccauaagcagggacaauagcaagaacacgcucuaucuccagaugaauagcuugcgcauagaagauaccgcgcucuauuucugugccagggacuugcgcgagagcgagugcgaggaaugggaaucggacuauuacgauuucgggaaaaagggcccgugcgugaaaccgcgcggggucgcgggcgggcucgaccucuggggccagggcacgauggugaucgugagcucg

SEQ ID NO: 55219 - RNA, 432 nt, Artificial Sequence
  derived and/or modified sequence opt11 from anti-HIV_cap256-176-531926_VR-Chain
caagugcaacuggucgagagcgggggcggggucgugcccccgggcaagagcuugaccuugagcugugucgcgagcagguucacguucucggccuuuggcaugcacugggucaggcaagcgcccgggaaagggcuagaguggguggccgggaucucguucgugggcauacgcaaguacuaugccgauagcgugaaagggcgcuuuagcauaagcagggacaauagcaagaacacggucuuucucgagaugaauggauugcgaggggaagauaccgggcucuauuacugugucaaggacaugcgcgagcucgagugcgaggaaugggccucggacuauuacgauuucgggaaaccgcaaccgugcuuggacaggcgcggggucucgggcauaagcgcgauguggggccagggcacgcucgugaucauaagcuca

SEQ ID NO: 55220 - RNA, 432 nt, Artificial Sequence
  derived and/or modified sequence opt11 from anti-HIV_cap256-176-504134_VR-Chain
gaagugcaacuggucgagagcgggggcggggucgugcccccgggaaagagccugcgcuugagcugugucacgagcagacucgcguucggggccuuuggcaugcacugggucaggcaagcgccagggaaagggcucgaguggguggcaucgauaucguucgcgggcaucaaaaaguacuaugccgacagcgugaaagggcgcuuuaccauaagcagggacaauagcaaggacacggucuuucucgagaugaauggcuugcgcggggacgauaccgggcucuauuacugugucaaggacaugcgcuaucucgagugcgaggaaugggccucggacuauuacgauuucgggcgcccgcaaccgugcuuggacccgcgcggggucucgggcauaagcgcgauguggggacagggcacgcucgugauaauaagcucg

SEQ ID NO: 55221 - RNA, 432 nt, Artificial Sequence
  derived and/or modified sequence opt11 from anti-HIV_cap256-119-186229_VR-Chain
caaaugcaauuggucgagagcgggggcggggucgugcaaccgggcgggagcuugcgauugcucuguagcgcaagcggguucacguucucgaccuauggcaugcacugggucaggcaagcgcccgggaaagggcucgaguggguggccucgaucucguacgauggcucggacaaguaccaugcagggcucgugugggggcgcuuuaucauaagcagggacaauagcaagaacacgcucuaucuccagaugaauagcuugcgcgcggaagauaccgcgcucuauuacugugucagggacgagcgcgagagcgagugcgagcucugggaaucggacuacuacaauuucgggaaaaagcuaccgugcgugaaaccgcgcgggguagcgggcacgcucgauaucuggggccagggcacgaccgugaucgugagcucg

SEQ ID NO: 55222 - RNA, 432 nt, Artificial Sequence
  derived and/or modified sequence opt11 from anti-HIV_cap256-119-183891_VR-Chain
caagugcaacuggucgagagcgggggcggggucgugcaaccgggagggagcuugcgcuugagcugugccgcaagcggguucacguucucgagcuauggcaugcacugggucaggcaagcgcccgggaaagggcucgaguggguggccuuuaccagguacgauggcucggacaaguacuaucuagauagcgugaaagggcgcuuuaccauaagcagagacaauagcaaguacacgcucuuucuccagauggugagcuugcgcacggaagauaccgcgcucuauuucugugccagggacuugcgcgagagcgagugcgaggaaugggaaucguacuauuacgauuucgggaaaaagggcccgugcgugaaaccgcgcggggucgugggcgugcucgauaucuggggccagggcacgcucgugaccgugagcucg

SEQ ID NO: 55223 - RNA, 435 nt, Artificial Sequence
  derived and/or modified sequence opt11 from anti-HIV_cap256-119-183631_VR-Chain
caaguccaacucguccaaagcggcggcggagucguacaacccggccgcagccugcgccucagcugcgccgcaagcaaauucacauucuccaccuacacccuccacugggucagacaagcccccggaaaaggacucgaaugggucgccguaaucucacacgacggcggcaaccgauucuacgccgacagcgucaaaggccgcuucacaaucagccgcgacaacuccaaaaacaaccucuuccuccaaaugaacucccuccgcguagaagacaccgcacucuacuacugcgccagagaccuccgagaaauggaaugcgaagaauggacccucuacaacuacuacgacuucggcucacgcggccccugcgucgacccccgaggcgucgucggcagcuucgacgucuggggccaaggcaccauggucacagucucaucc

SEQ ID NO: 55224 - RNA, 432 nt, Artificial Sequence
  derived and/or modified sequence opt11 from anti-HIV_cap256-119-182676_VR-Chain
caagugcaauuggucgagagcgggggcggggucgugcaaccgggcaagagcuugcgcuugagcugugucgugagcggguucacguucucgaacuaucccaugcacugggucaggcaagcgcccgggaaagggcucgaguggguggccucgauaucguucgcgggcaucaaaaaguacuauggcgauagcgugaaagggcgcuuuaccauaagcagggacaauagcaagaacacgcucuaucuacagauggauggcuugcgcggggaagauaccgcacucuauuacugugccaaggacuugcgagagcucgagugcgaggaaugggccucggacuauuacgauuucgggcgcccgcaaccgugcuuggacccgcgcggggucucgggcauaagcaaugucuggggccagggcacgauggugaccgugagcucg

SEQ ID NO: 55225 - RNA, 432 nt, Artificial Sequence
  derived and/or modified sequence opt11 from anti-HIV_cap256-119-180772_VR-Chain
caagugcaauuggucgagagcgggggcggggucgugcaaccgggcaggagcuugcgcuugagcugugccgcgagcgaguucacguucucgaacuaugccaugcacugggucaggcaagcgcccgggaaagggcuagaguggguggccucgaucucguucgauggcagggacaaguaccauagcucgcuagugugggggcgcuugaccauaagcagggacaauagcaagagcacgcucuuucuccagaugaauagcuugcgcccggaagauaccgcgcuauauuacugugccagggacgugcgagagagcgagugcgaggaauggcaaucagacuauuacgcguucuaucgcaagcucccgugcgugaaaccgcgaggggucgcgggaacgcucgauaucuggggccagggcacgauggugaccgugagcucg

SEQ ID NO: 55226 - RNA, 435 nt, Artificial Sequence
  derived and/or modified sequence opt11 from anti-HIV_cap256-119-180508_VR-Chain
caagugcacuuggucgagagcgggggcggggucgugcaaccgggaaggagcuugcgauugagcugugccgcgagccauuucucgcucucgagcuauggcaugcacugggucaggcaaacgcccgggaaagggcucgaguggguggccgggaucucguucgcgggcgugaaaacauacuauggcacgagcgugaaagggcgcuuuaccauaagcagggacaauagcaagaacaaucuauaucuccagaugaauagcuugcgcccagaagauaccgcgcucuauuacugugccagggacuugcgcgagauggagugcgaggaauggaaacuguacaauuacuaugacuuucgcacgcgaggacccugugucgaucccagaggaguggucgggagcuuugacgugugggggcaagggaccguggucacggucucgagc

SEQ ID NO: 55227 - RNA, 432 nt, Artificial Sequence
  derived and/or modified sequence opt11 from anti-HIV_cap256-119-180260_VR-Chain
gaagugcaauuggucgagagcgggggcggggucgugcgaccgggcgggagcuugcgcuugagcugugccgcgagccaguucacauucucgaacuuuggcaugcacugggucaggcaagcgcccgggaaagggcucgaguggguggccucgaucucguucgugggaauaaaaacgcacuaugccaauagcgugcgcgggcgcuuuaccauaagcagggaccagagcaagaacacgcucuaucuccagaugaauagcgugcgcguggaagauaccgggcgcuauuacugugccagggacaugcgcgaguacgagugcgagcucugggccucggacuauuacgauuucgggaaaccgcaaccgugcgaggacccgcgcggggucgugggcacguucgauauguggggcuugggcacgcucgugaccgugagcucg

SEQ ID NO: 55228 - RNA, 432 nt, Artificial Sequence
  derived and/or modified sequence opt11 from anti-HIV_cap256-119-180173_VR-Chain
gaagugcaauuggucgagagcgggggcgggcucgugcaaccgggcgggagccugcgcuugagcugugccgcgagcggguucacgguaucgagcaauuacaugagcugggucaggcaagcgcccgggaaagggcucgaguggguggccucgaucucguucgcgggcacgaaaaagcacuauggcaauagcgugaaagggcgcuuuaccauaagcagggacaauagcaagaacacgcucuaucuccagaugaauagcuugcgcggggaagauaccgcgcuauauuacugugccaaggacuugcgcgaguacgagugcgaggaauggaccucggacuauuacgauuucgggcgcccgcaaccgugcauagacucgcgcggggucgugggcauacucgauaucuggagccagggcacgauggugaccgugagcucg

SEQ ID NO: 55229 - RNA, 432 nt, Artificial Sequence
  derived and/or modified sequence opt11 from anti-HIV_cap256-119-179839_VR-Chain
caagugcaauuggucgagagcgggggcggggucgugcaaccgggcaggaguuugcgcuugagcugugccgcgagcggguucucguucgggaccucggacgugcacugggucaggcaagcgcccggggaagggcucgaguggguggccuugaucucguucgauggcaggcaaaaggacuuggccgauagcgugcgcgggcgcuuuaccauaaguagggacucgagcaagaacacgcucuaucucgagaugaauagcuugcgcccggaagauacagcgcuauauuacugugccaaggacaugcgaggguacgagugcgaggaauggaccucggacuauuacgauuucgggcgcccgcaaccgugcauagacucgcgcggggucgugggcacguucgaugucuggggccagggcacgauggugaccgugagcucg

SEQ ID NO: 55230 - RNA, 423 nt, Artificial Sequence
  derived and/or modified sequence opt11 from anti-HIV_cap256-119-179262_VR-Chain
cagguacagcucguggaaucgggcgggcgcgugguccagagcgggggcucgcucaggcucucgugcggggccucgggcuuuagcuuuaccacgagugcgaugcauugggugcgccaggccccgggcaagggcuuggaaugggucgcgaucaauggcgcgaacaagcacuaugccgagagcgugaaagggcgcuuuaccauaagcagggacaauagcaagaacacgcucuuucucgagaugaauagcuugcgcccggacgauaccgcgcucuauuucugugucaaggaccagcgcgaggacgagugcgaggaaugguggucggacuauuacgauuucgggcgcgagcaaccgugcuuggacccgcgcggggucgugggcauauucgaucucuggggccagggcacgauggugaccguaagcucg

SEQ ID NO: 55231 - RNA, 432 nt, Artificial Sequence
  derived and/or modified sequence opt11 from anti-HIV_cap256-119-178995_VR-Chain
caagugcaauuggucgagagcgggggcggggucgugcaaccgggcaagagcuugcgcuugagcugugccgcgagcggguucacgcucacgcgcuuugccaugcacugggucaggcaagcgcccgggaaagggcucgaguggguggcagugaucugguacgauggcucgaacaaguacuaugccgauagcgugaaagggcgcuuuaccgugagcagagacaauagcaagaacacgcucuaucuccagaugaauagccugcgcacggaagauaccgcgcucuauuacugugucagggacaggcgcgagagcgagugcgagcuaugggaaucagacuauuacaauuucgggcgcaggcuaccgugcgugaaaccgcgcggggucgcaggcauacucgauaucuggggccagggcacgaccgugaccgugagcccg

SEQ ID NO: 55232 - RNA, 432 nt, Artificial Sequence
  derived and/or modified sequence opt11 from anti-HIV_cap256-119-178455_VR-Chain
gaagugcaauugguagagagcgggggcgggcucgugcaaccgggcgggagcuugcgcuugagcugugucgugagcggguucacguucucaaacuuuuggaugagcugggucaggcaagcgcccgggaaagggcucgaguggguggccucgaucucauacgauggcagggacaaguaccacagcucgcucgugugggggcgauugaccauaagcagggacaauagcaagagcacgcuauuucuccagaugaauagccugcgcgcggaagauaccgcgcucuauuacugugccagggacuugcgcgagagcgagugcgaggaauggcaaucggacuauuacgcguucuauaaaaagcucccgugcgugaaaccgcgcggggucgcgggcacgcucgauaucuggggccagggcacgauggugaccgugagcucg

SEQ ID NO: 55233 - RNA, 438 nt, Artificial Sequence
  derived and/or modified sequence opt11 from anti-HIV_cap256-119-177993_VR-Chain
caagugcaccuggucgagagcgggggcggggucgugcaaccgggcaagagcuugcgaauauacugcgccgugagcgaguucacguucucgaacuaugccaugcacuggguaaggcucgcgcccgggcgcgggcuccagugguuggccgugaucucguacgauggcucgaaaaaguacuaugccgauagccuggaagggcgcuuuaccauaagcaaggacaauagcaagaacacacucuuucuccagaugaauagccugcgcguggaagauaccgcgcucuauuucugugucaaggaccagcgcgaggacgagugcgaggaaugguggucggacuauuacgauuucggggaaagggcaccgcucccgaaagugcccgggcccgggcccggguggaaucucgauauguggggccauggcacgauggugaccgugagcucg

SEQ ID NO: 55234 - RNA, 438 nt, Artificial Sequence
  derived and/or modified sequence opt11 from anti-HIV_cap256-119-177727_VR-Chain
caagugcaauuggucgagagcgggggcggggucgugcaaccgggcaggagcuugcgcuugagcugugccgcgagcggguucacgcucucgcgcuaugacaugcacugggucaggcaagcgcccgggaaaggacucgaguggguggccucgaucucgaaagacggcacgaaaaaguaccauggcgauagcgugugggggcgcuuuaucauaagcagggacaauagcaagaacacgcucuuucuccagaugucgagcuugcgcgcggaagauaccgcgcuauauuucugugucagggaccagcgagaggccgagugcgaggaaugguggucggacuauuacgauuucgggcgcgagcucccgugcaggaaauuucgcgggcucgggcucgcgggcauauucgauaucuggggccauggcacgauggugaccgugagcucg

SEQ ID NO: 55235 - RNA, 432 nt, Artificial Sequence
  derived and/or modified sequence opt11 from anti-HIV_cap256-119-176746_VR-Chain
gaagugcaauuggucgagagcgggggcgggcucgugcaaccgggcgggagcuugcgcuugagcugugccgcgagcgauuucacauucgaugacuaugccaugcacugggucaggcaagcgcccgggaaagggcuagagugggugggcggaaucucguacgauggcucggacaaguaccauaccaauagcgugugggggcgcuuuaucgugagcagggacaauagcaagaacacgcucuaucuccagaugaauagccugcgcccggaagauaccgcgcucuauuacugugucagggacaggcgcgagagcgagugcgaggaaagguggucggacuauuacgauuucgggaaacagcucccgugcgugaaaccgcgcggggucgcgggcauauucgauaucuggggacagggcacgauggugaccgugagcucg

SEQ ID NO: 55236 - RNA, 432 nt, Artificial Sequence
  derived and/or modified sequence opt11 from anti-HIV_cap256-119-176241_VR-Chain
caagugcaauuggucgagagcgggggcggggucgugcaaccgggcaggagcuugcgcuuaagcugugccgcgagcggguucacguucucgaacuaugccaugcacugggucaggcaagcgcccgggaaagggcucgaguggguggccgugaucucguacgauggaucgaacaaguacuaugccgauagcgugaaagggcgcuuuaccauaagcagggacaauagcaagaacacgcucuaucuccagauggauggcuugcgcggggaagauaccgcgcucuauuacugugccaaggaccugcgcgagcucgagugcgaggaaugggcaucggacuauuacgauuucgggcgcccgcaaccgugcuuggacccgcgcggggucucgggcauaagcaaugucuggggccagggcacgauggugaccgugagcucg

SEQ ID NO: 55237 - RNA, 432 nt, Artificial Sequence
  derived and/or modified sequence opt11 from anti-HIV_cap256-119-175215_VR-Chain
caagugcaauuggucgagagcgggggcggggucgugcaaccgggccgcagcuugagacugagcugugcagugagccaguucacguucgggcgcuauggcauguacugggucaggcaagcgcccgggaaagggcuagaguggguggccgggaucucguacgauggcucggacaaguaccauaccaauagcgugugggggcgcuuuaucgugagcagggacaauagcaagaacaugcuauaucuccagaugaauaacuugcgcccggaagauaccgcgcucuauuacugugucagggacaggcgcgagagcgagugcgaggaaagguggucggacuauuacgauuucgggaaacagcucccgugcgugaaaccgcgcggggucgcgggcauauucgauaucuggggccagggcacgauggugaccgugagcuca

SEQ ID NO: 55238 - RNA, 432 nt, Artificial Sequence
  derived and/or modified sequence opt11 from anti-HIV_cap256-119-173928_VR-Chain
ggaguggaauugcuagagagcgggggcgggcucguggaaccgggcgggagccugcgauugagcugugucgggagccaguucucauucgauagauauggcaugcacugggucagacaagcgcccgggaaagggcucgaguggguggccgcggucucguucgauggcacggacaaguaccaugccgaugacgugugggggcgcuuuaccauaagcagggacaauagcaagaacacgcucuaucuccagaugaauagcuuacgcgcggaagauaccgcgcucuauuacugugccaaggacuugcgcgaggacgagugcgaggaaugguggucggacuauuacgaucucgggaaacagcucccgugcaggaaaucgcgcggggucgcgggcgugcucgauaaauggggccugggcacgauggugaccgugagcucg

SEQ ID NO: 55239 - RNA, 432 nt, Artificial Sequence
  derived and/or modified sequence opt11 from anti-HIV_cap256-119-173495_VR-Chain
caagugcaauuggucgagagcgggggcggggucgugcaaccgggcaagagcuugcgcuugagcugugccgcgagcagguucacguucaaucgcuauggcaugcacugggucaggcaagcgcccgggaaagggcucgaguggguggccgcgaucucguucgauggcacggacaaguaccauagcgaugacgugugggggcgcuuuacaauaagcagggacaauagcaagaacacgcucuaucuccagaugaauagcuugcgcgcggaagauaccgcggucuauuacugugccaaggacuugcgagaggacgagugcgaggaaagguggucggacuauuacgauuucgggaaacagcucccgugcaggaaaucgcgcggagucgcgggcauauucgauaacuggggccagggcacgauggugaccguaagcucg

SEQ ID NO: 55240 - RNA, 432 nt, Artificial Sequence
  derived and/or modified sequence opt11 from anti-HIV_cap256-119-172882_VR-Chain
caagugcaauuggucgagagcgggggcggggucgugcaaccgggcaggagcuugaccuugagcugugaagugagcggguucacguucaagaccuauggcaugcacugggucaggcaagcgcccgggaaagggcucgaguggguggccucaaucucguacgauggcucggacaaguaccaugccgaucgcgugugggggcgcuuuaccauaagcagggacaauagcaagaacacgcucuaucuccagaugaauagccugcgcgcggaagauaccgcgcucuauuacugugucagggacgcgcgagagagcgagugcgagcucugggaaucagacuauuacaauuucgggcgaaagcucccgugcgugaaaccgcgagggguagcgggcacgcucgauaucuggggccagggcacgauggugaccgugagcucg

SEQ ID NO: 55241 - RNA, 432 nt, Artificial Sequence
  derived and/or modified sequence opt11 from anti-HIV_cap256-119-172429_VR-Chain
gaagugcaauuggucgagaccgggggcgggcucauacaaccgggcgggagcuugcgcuugagcugugucgcgagccaguucacguucucgggauguggccugcacuggguaaggcaagcgcccgggaaagggcucgaguggguggccucgaucucguucgcgggcacgaaaaagcacuauggcaauagcgugaaagggcgcuuuacaauaagcagggacaauagcaagaacacgcucuaccucgagaugaauaccuugcgcgcggaagauaccgcgcucuauuacugugccaaggacuugcgcgaguacgagugcgaggaauggaccucggacuauuacgauuucgggcgcccgcaaccgugcauagacucgcgcggggucgugggcauacucgauaucuggggccagggcacgauggugagcguaagcucg

SEQ ID NO: 55242 - RNA, 432 nt, Artificial Sequence
  derived and/or modified sequence opt11 from anti-HIV_cap256-119-172223_VR-Chain
caagugcaauuggucgagagcgggggaggggucgugcaaccgggcaggagcuugcgcuugagcugugccgcgagcggguucacguucucgagcuaugccaugcacugggucaggcaagcgcccgggaaagggcucgaguggguggccgugaucucguacgauggcagggacuuuuaccaugccaggagcgugugggggcgcuuuaccauaagcagggacaauagcaagaacacgcuccaucuacagaugaauagcuugcgcccggaagauaccgcgcucuauuucugugccagggacuugcgagagagcgagugcgaggaaugggaaucguacuauuacgauuucgggaaaaaggacccaugcgugaaaccgcgcggggucgugggcgugcuagauaucuggggacagggcacccuagugacagugagcucg

SEQ ID NO: 55243 - RNA, 432 nt, Artificial Sequence
  derived and/or modified sequence opt11 from anti-HIV_cap256-119-171838_VR-Chain
caagugcaauugggcgagagcgggggaggggucgugcaaccgggcaggagcuugcgauugagcugugccgcgagcggguucacguucucgaccuuugcaaugcacugggucaggcaagcgccagggaaagggcucgaguggguggccgugaucucguacgauggcucgaacaaguacuaugccgauagcguaaaagggcgcuuugccauaagcagggacaaugccaagaacuugcuacaucuccagaugaauagcuugcgcccggaagauaccgcgcucuauuacugugccaaggacuugcaagaggacgagugcgaggaaugguggucggacuauuacgauuucgggaaacagcucccgugcaggaaaucgcgcggggucgcgggcauauucgaugacuggggccagggcacgauggugaccgugagcucg

SEQ ID NO: 55244 - RNA, 432 nt, Artificial Sequence
  derived and/or modified sequence opt11 from anti-HIV_cap256-119-171587_VR-Chain
gaagugcaauuggucgagagcgggggcgggcucgugcaaccgggcgggagcuugcgcuugagcugugccgcaagcggguucacguucucggacuauuacaugagcuggaucaggcaagcgcccgggaaagggcucgaguggguggccucgaucucguucgcgggcacgaaacagcacuauggcaauagcgugaaagggcgcuuuaccauaagcagggacaauagcaagaacacggucuaucuccagaugaauagccugcgcuuggaagauaccgcgcucuauuacugugccaaggacuugcgagaguacgagugcgaggaauggacaucggacuauuacgauuucgggcgcccgcaaccgugcauagacucgcgcggggucgugggcauacuagacaucuggggccagggcacgauggugaccgugagcucg

SEQ ID NO: 55245 - RNA, 432 nt, Artificial Sequence
  derived and/or modified sequence opt11 from anti-HIV_cap256-119-169596_VR-Chain
cucgugcaauuggucgagagcgggggcggggucgugcaaccgggcaggagccugcgcuugagcuguaccgcgagcggguucacguucucgagcuuugccaugcacagggucaggcaaacgcccgggaaagggcucgaguggguggccucgaucucguacgauggcucggacaaguaccaugcagaucgcgugugggggcgcuuuaccauaagcagggacaauagcaagaacacacucuaucuccagaugaauagcuugcgcgcggaagauacagcgcucuauuacugugucagggacgcgcgcgagagcgagugcgagcucugggaaucggacuauuacaauuucgggcgcaagcucccgugcgugaaaccgcgcggggucgcgggcacgcucgauaucuggggccagggcacgauggugaccgugagcuca

SEQ ID NO: 55246 - RNA, 432 nt, Artificial Sequence
  derived and/or modified sequence opt11 from anti-HIV_cap256-119-169523_VR-Chain
caagugcaauuggucgagagcgggggcggggucgugcaaccgggcgagagcuugcgcuugagcugugccgcgagcggguucucguucgggaccucggacgugcacugggucaggcaagcgcccggggaagggcucgaguggguggccucgauaucguucgcgggcaucaaaaaguacuauggugauagcgugaaagggcgauuuaccauaagcagggacaauagcaagaacacgcuauaucuccagauggauggcuugcgcggggaagauaccgcgcuauauuacugugccaaggacuugcgagagcucgagugcgaggaaugggccucggacuauuacgauuucgggcgcccgcaaccgugcuuggacccgcgcggggucucgggcauaagcaaugucuggggccagggcacgauggugaccgugagcucg

SEQ ID NO: 55247 - RNA, 432 nt, Artificial Sequence
  derived and/or modified sequence opt11 from anti-HIV_cap256-119-169462_VR-Chain
gaagugcaauuggucgagagcgggggcgggcucguacaaccgggcgggagcuuacgcuugagcugugccgcgagcggguucacguucacgaccuauagccugcacugggucaggcaaucgcccgggaaagggcucgaguggguggccgcgaucucguucgcgggcacgaaagagaacuaugccaauagcgugcgcgggcgcuuuaccauaagcagggacaauagcaagaacacgcuauaucuacagaugaauagcuugcgcgcggaagauaccgcgcucuauuacuguaccaaggacaugcgcgaguacgagugcgaggaauggacaucggacuauuacgauuucgggcgcccgcaaccgugcauagacucgcgcggggucgugggcacguucgaugucuggggccagggcacgauggugaccgugagcucg

SEQ ID NO: 55248 - RNA, 432 nt, Artificial Sequence
  derived and/or modified sequence opt11 from anti-HIV_cap256-119-169092_VR-Chain
gaagugcaauuggucgagagcgggggcgggcucgugcaaccgggagggagcuugcgcuugagcuguguaauaagcggguucacguucucgagcuaugaaaugaacuggguaaggcaagcgcccgggaaagggcucgaguggguggccgggaucucguacgauggcagggacaaguaccaugcccauuucgugugggggcgcauaaccauaagcagggacaauagcaagaacacgcucuaucuacagaugaauagcuugcgcgcggaagauaccgcgcucuaucacugugucagggacuugcgcgagagcgagugcgagcucugggaaucggacuauuacgauuucgggaaaaagcucccaugcgugaaaccgcgcggggucgcgggaauauucgaucucuggggccagggcacgauggugaccgugagcucg

SEQ ID NO: 55249 - RNA, 432 nt, Artificial Sequence
  derived and/or modified sequence opt11 from anti-HIV_cap256-119-168680_VR-Chain
caagugcaauugguagagagcgggggcggggucguacaaccgggcaggagcuugcgcgugagcugugccgcgagccauuucacguucucgcgcuauggcaugcacugggucaggcaagcgcccgggaaagggcucgaguggguagccucgauaucauacgauggcagggacuuuuaccaugccaggagcguaugggggcgcuuugccauaagcagggacaauagcaagaacacgcuacaucuccagaugaauagcuugcgcacggaagauaccgcgcucuaucacugugucagggacuugcgcgagagcgagugcgagcucugggaaucggacuauuacgauuucgggaaaaagcucccgugcgugaaaccgcgaggggucgcgggcacguucgaucuauggggccagggaacgauggugacagugagcucg

SEQ ID NO: 55250 - RNA, 438 nt, Artificial Sequence
  derived and/or modified sequence opt11 from anti-HIV_cap256-119-166385_VR-Chain
caagugcaauuggucgagagcgggggcggggucgugcacccgggcaggagcuugcgccugagcugugccgcgagcggguucucguucgggaacuuuggcaugcacugggucaggcaagcgcccgggaaagggcucgaguggguggccucgaucucgaacgauggcacgaaaaaguaccaugccgagagcgugugggaucgcuuuagcauaagcaaggacaauagcaagaacacgcucuuucuacagaugaauagcuugcgaguggaagauaccgcgcucuauuucugugucaaggaccagcgagaggacgagugcgaggaaugguggucggacuauuacgauuucgggcgcgagcucccgugcaggaaaucgcgagggcucgggcucgcgggcauauucgauauguggggccauggcacgauggugaccgugagcuca

SEQ ID NO: 55251 - RNA, 432 nt, Artificial Sequence
  derived and/or modified sequence opt11 from anti-HIV_cap256-119-165943_VR-Chain
gaagugcaauuggucgagagcgggggcgggcucgugcaaccgggcaggagcuugcgcuugagcugugccgugagcggguucacggucucgagcaauuacaugagcugggucaggcaagcgcccgggaaagggcucgaguggguggccucgauaucguucgcgggcaucaaaaaguacuauggcgauagcgugaaagggcgcuuuaccauaagcagggacaauagcaagaacacgcuauaucuccagauggauggccugcgcggggaagauacagcgcucuauuacugugccaaggacuugcgcgagcucgagugcgaggaaugggccucggacuauuacgauuucgggcgcccgcaaccgugcuuggacccgcgcggggucucgggcauaagcaaugucuggggccagggcacgauggugaccgugagcucg

SEQ ID NO: 55252 - RNA, 432 nt, Artificial Sequence
  derived and/or modified sequence opt11 from anti-HIV_cap256-119-165738_VR-Chain
gaagugcaauuggucgagagcgggggcgggcuagugcaaccgggcaggagcuugcgcuugaguugugccgcgagcggguucacguucgaugacuaugccaugaacugggucaggcaagcgcccgggaaagggcucgaguggguggccacgaucucguucgauggaacggacaaguaccaugccgaugacgugugggggcgcuuuaccauaagcagggacaauagcaagaaaacgcucuaucuccagaugaauagcuugcgcgcggaagauaccgcgcucuauuacugugccaaggacuugcgcgaggacgagugcgaggaaugguggucggacuauuacgaucucgggaaacagcucccgugcaggaaaucgcgaggggucgcgggcgugcuagauaaauggggcuugggcacgauggugaccgugagcuca

SEQ ID NO: 55253 - RNA, 432 nt, Artificial Sequence
  derived and/or modified sequence opt11 from anti-HIV_cap256-119-164913_VR-Chain
caagaucacuuggucgagagcgggggcgggggcgugcaaccgggcaagagccugcgacugagcugugccgcgagcggguucacguucucggcccaugccaugcacugggucaggcaagcgcccgggaaagggcccgaguggguggccgugaucucgcacgauggcgggcaacaguucuaucgcgagagcgugaaagggcgcuuuaccauaagcagggacaauagcaagaacacgcucuaucuccagauggauggcuugcgcggggaagauaccgcgcucuauuacugugccaaggacuugcgagagcucgagugcgaggaaugggccucggacuauuacgauuucgggcgcccgcaaccgugcuuggacccgcgaggaguaucgggcauaagcaaugucuggggccagggcacgauggugaccgugagcucg

SEQ ID NO: 55254 - RNA, 432 nt, Artificial Sequence
  derived and/or modified sequence opt11 from anti-HIV_cap256-119-164167_VR-Chain
gaagugcgcuuggucgagagcgggggcgggcucauacaaccgggcgggagcuugagauugagcugugccgcgagcgggcucacggucucgagcaaucacaugagcugggucaggcaagcgccagggaaagggcucgaguggguggccucgaucucguacgauggcagggacuuuuaccaugccaggagcgugugggggcgcuuuaccauaagcagggacaauagcaagaacacgcuccaucuccagaugaauagcuugagaccggaagauaccgcgcucuauuucugugcaagggaccugcgcgagagcgagugcgaggaaugggaaucguacuauuacgauuucgggaaaaagggcccgugcgugaaaccgcgaggggucgugggcgugcucgauaucuggggccagggcacgcucgugaccgugagcucg

SEQ ID NO: 55255 - RNA, 432 nt, Artificial Sequence
  derived and/or modified sequence opt11 from anti-HIV_cap256-119-163558_VR-Chain
caaaugcaauuggucgagagcgggggcggggucgugcaaccgggcaggagcuugaccuugagcugugccgcgagccaguucaauuucgcgaacuauggcaugcacugggucaggcaagcgcccgggaaaggacucgaguggguggccucgaucucguacgauggcucggacaaguaccaugccgaucgcgugugggggcgcuuuaccauaagcagagacaauagcaagaacacgcucuaucuccagaugaauagcuugcgcgcggaagauaccgcgcucuauuacugugucagggacgcgcgcgagagcgagugcgagcucugggaaucggacuauuacaauuucgggcgcaagcucccgugcgugaaaccgcgaggagucgcgggcacgcucgauaucuggggccagggcacgauggugaccgugagcucg

SEQ ID NO: 55256 - RNA, 432 nt, Artificial Sequence
  derived and/or modified sequence opt11 from anti-HIV_cap256-119-162043_VR-Chain
caagugcaauuggucgagagcgggggcggggucgugcaaccgggcaggagcuugcgcgugagcugugccgcgagccauuucacguucucgcgcuauggcaugcacuggguaaggcaagcgcccgggaaagggcucgagugggugaccgggaucucguucgcggccacgaaaacguacuauggcgauagcgugcgcgggcgcuuuaccgugagcagggacauaagcaagaacacgcucuaucuccagaugaauaguuugcgcccggaagauaccgcgauguauuacugugccagggaccagcgcuauuacgagugcgaggaaugggccucggacuauuacgauuucgggcgcgagcaaccgugccaggacccgcgcggggucgugggcauacucgaucucuggggccagggcacgauggugaccgugagcucg

SEQ ID NO: 55257 - RNA, 432 nt, Artificial Sequence
  derived and/or modified sequence opt11 from anti-HIV_cap256-119-161718_VR-Chain
caagugcaacuggucgagagcgggggaggggucgugcaaccgggcaagagcuugcgcuugagcugugccgcgagccauuucucguucaaucgcuauggcaugcacugggucaggcaagcgcccgggaaagggcucgaguggguggccgcgaucucguacgauggcacggacaaguaccaugccgaucaagugugggggcgcuuuaccauaagcagggacaauagcaagaacacgcucuaucuccagaugaauagcuugcgcccggaagauaccgcgcucuauuacugugccaaggacuugcgcgaggacgagugcgaggaaugguggucggacuauuacgaucuagggaaacagcucccgugcaggaaaucgcgcggggucgcgggcauauucgauaaauggggccagggaacgauggugaccgugagcucg

SEQ ID NO: 55258 - RNA, 432 nt, Artificial Sequence
  derived and/or modified sequence opt11 from anti-HIV_cap256-119-161675_VR-Chain
caagugcaauuggucgagagcgggggcggggucgugcaaccgggcaggagcuugcgauugagcuguaccgcgagcggguucacguucucgaucuauagcaugaacugggucaggcaagcgcccggaaaagggcucgauuggguggccgggaucucguucgcggcaacgaaaacguacuauggagggagcgugaaagggcgcuuuaccgugagcagggacauaagcaagaacacgcucuaucuccagaugaauagcuugagaccggaagauaccgcgauguauuacugugccagggaccagcgcuauuacgagugcgaggaaugggcaucggacuauuacgauuucgggcgcgagcaaccgugccaggacccgcgcggggucgugggcguguucgauauguggggccagggcacgauggugaccgugagcucg

SEQ ID NO: 55259 - RNA, 432 nt, Artificial Sequence
  derived and/or modified sequence opt11 from anti-HIV_cap256-119-161053_VR-Chain
caagugcacuuggucgagagcgggggcggggucgugcaaccgggcacgagccugcgauugagcugugucgcgagcggguucacguucucgaacuuugccaugcacugggucaggcaagcgcccgggaaagggcucgagugggcggccauaaucucgaccaggggcaauaacaggaacuaugccgauagcgugcgcgggcgcuuuaccgugagcagggacauaagcaagaacacgcucuaucuccagaugaauagcuugcgaccagaagauaccgcgauguauuacugugccagggaccaacgcuauuacgagugcgaggaaugggccucggacuauuacgauuucgggcgagagcaaccgugccaggacccgcgcggggucgugggcauacucgaucucuggggccagggcacgauggugaccgugagcucg

SEQ ID NO: 55260 - RNA, 432 nt, Artificial Sequence
  derived and/or modified sequence opt11 from anti-HIV_cap256-119-159499_VR-Chain
caagugcaauuggucgagagcgggggcggggucgugcaaccgggcaggagcuugcgauugagcugugccgcgagcggguucgcguucucgcacuauggcauauucugggucaggcaagcgcccgggaaagggcucgaguggguggccucgaucucguucgauggcagggacuauuaccauagcccacacgugugggggcgcuugaccauaagcagagacaauagcaagaacacgcucuaucuccagaugaauaguuugcgagcggaagauaccgcgcucuauuacugugccagggacuugcgcgagagcgagcgagaggaaugggaaucggacuauuacgauuucgggaaaaagggcccgugcgugaaaccgcgcggggucgcgggcucgcuagauauguggggccagggaacgauggugaucgugagcuca

SEQ ID NO: 55261 - RNA, 432 nt, Artificial Sequence
  derived and/or modified sequence opt11 from anti-HIV_cap256-119-159114_VR-Chain
gaagugcaauuggucgagagcgggggcgggcucgugcaaccgggcgggagcuugcgcuuggccugugcagcgagcgggcuaacguucaggaaacauggcaugcacugggucaggcaagcgcccgggaaagggcucgagugggugagcuauaucucgagcgauggcgugaacaauuaccugaucgauagcgugcgagggcgauuuacagugagcagggacaauagcaagaacacgcucuaucuccagauggauggcuugcgcggggaagauaccgcgcucuauuacugugcaaaggacuugcgcgagcuagagugcgaggaaugggccucggacuauuacgauuucgggcgcccgcaaccgugcuuggacccgcgcggggucucgggcauaagcaaugucuggggccagggcacgauggugaccgugagcucg

SEQ ID NO: 55262 - RNA, 432 nt, Artificial Sequence
  derived and/or modified sequence opt11 from anti-HIV_cap256-119-156751_VR-Chain
gaagugcaauugcucgagagcgggggcgggcucgugcaaccgggcgggagcuugagauugagcugugcagcgagcggguucgcguucucgagcuauggcaugcacugggucaggcaagcgcccgggaaagggcucgaguggguggccucgaucucguacgauggcagggacuuuuaccaugccaggagcgugugggggcgcuuuaccauaagcagggacaauagcaagaacacgcuccaucuccagaugaauagccugcgcccggaagauaccgcgcucuauuucugugccagggacuugcgagagagcgagugcgaggaaugggaaucguacuauuacgauuucgggaaaaagggcccgugcgugaaaccgcgcggggucgugggcgugcucgauaucuggggccagggcacgcucgugaccgugagcucg

SEQ ID NO: 55263 - RNA, 432 nt, Artificial Sequence
  derived and/or modified sequence opt11 from anti-HIV_cap256-119-155656_VR-Chain
gaagugcaauuggucgagagcgggggagggcucgugcaaccgggcgggagcuugcgcuugagcugugccgcgagcgggaucacguucucgagcuauggcaugcacugggucaggcaagcgcccgggaaagggcuagaguggguggcauuuaucagguacgauggcucgagcaaguacuaugccgauagcgugaaagggcgcuuuaccauaagcagggacaauagcaagaacacgcucuaucuccagauggauggauugcgcggggaagauaccgcgcuauauuacugugcaaaggacuugcgcgagcucgagugcgaggaaugggccucggacuauuacgauuucgggcgcccgcaaccgugcuuggacccgcgcggggucucgggcauaagcaaugucuggggccagggcacgauggugaccguaagcuca

SEQ ID NO: 55264 - RNA, 432 nt, Artificial Sequence
  derived and/or modified sequence opt11 from anti-HIV_cap256-119-154420_VR-Chain
caagugcgccuggucgagagcgggggcggggucgugcaaccgggcaggagcuugcgcauaagcugugccgcgagccaguucauguucucgcgauauggcaugcacugggucaggcaagcgcccgggaaagggcucgaguggguggccucgaucucguacgauggcacggacaaguaccaugccgaucucgugugggggcgauuuaccauaagcagggacaauagcaagaacacgcucuaucuccagaugaauagcuugcgcgcggaagauaccgcgcucuauuacugugccagggacuugcgcgagagcgagugcgaggaaugggaaucggacuauuacgauuucgggaaaaagggcccgugcgugaaaccgcgcggggucgcgggcucgcucgauauguggggccagggcacgauggugauaguaagcuca

SEQ ID NO: 55265 - RNA, 432 nt, Artificial Sequence
  derived and/or modified sequence opt11 from anti-HIV_cap256-119-153954_VR-Chain
gaagugcaagugcucgagagcgggggcgggcucgugcaaccgggcgggagcuugcgcuugagcugugucgcgagccaguucacguucucgggcuguggcuugcacugggucaggcaagcgcccgggaaagggcucgaguggguggccucgaucucguucgcgggcacgaaaaagcacuauggcaauagcgugaaagggcgcuuuaccauaagcagagacaauagcaagaacacggucuaucucgagaugaauagcuugcgagcggaagauaccgcgcuauauuacugugccaaggaccugcgcgaguacgagugcgaggaauggaccucggacuauuacgauuucgggcgcccgcaaccgugcauagacucgcgcggggucgugggcauacucgauaucuggggccagggcacgauggugaccgugagcucg

SEQ ID NO: 55266 - RNA, 432 nt, Artificial Sequence
  derived and/or modified sequence opt11 from anti-HIV_cap256-119-153864_VR-Chain
caagugcacuuggucgagagcgggggcgggguagugcaaccgggcgggagcuugcgcuugagcugugccgcgagcggguucacguucucgggauguggcuugcacugggucaggcaagcgcccgggaaagggcucgaguggguggccucgaucucguucgcgggcacgaaaaagcacuauggcucgagcgugcgcgggcgcuuuagcauaagcagggacaauagcaagaacacgcucuaucuccagaugaauagcuugcgcacggaagauaccgcgcucuauuucugugccaaggacuugcgcgaguacgagugcgaggaauggacaucggacuauuacgauuucgggcgcccgcaaccgugcauagacucgcgcggggucgugggcauacucgauaucuggggccagggcacgauggugaccgugagcucg

SEQ ID NO: 55267 - RNA, 432 nt, Artificial Sequence
  derived and/or modified sequence opt11 from anti-HIV_cap256-119-153793_VR-Chain
gaagugcaacuggucgagagcgggggcggggucgugcaaccgggagggagcuugagauugagcugugccacgagcggguucacguucgggaccuuuggcaugcacugggucaggcaagcgcccgggaaagggcucgauuggguggccuauaucagguacgauggcaagaccaagaacuauggcgagagcgugaaagggcgauuuaccauaagcagggacaauagcaagaacacgaugucgcuccagaugaauagcuugagaccggaagauaccgcgcucuauuacugugccaaggacuugcgcgaggacgagugcgaggaaagguggucagacuauuacgauuucgggaaacagcuaccgugcaggaaaucgcgaggaguagcgggcguguucgauaacuggggccagggcacaauggugaccgugagcucg

SEQ ID NO: 55268 - RNA, 432 nt, Artificial Sequence
  derived and/or modified sequence opt11 from anti-HIV_cap256-119-153462_VR-Chain
caagugcaauuggucgagagcgggggcggggucgugcaaccgggcgggagcuugcgcuugagcugugccgcgagcggguucacguucucgaacuauggcaugcaaugggucaggcaagcgcccgggaaagggcucgaguggguggccgcgauaucguacgauggaaggaacgaguacuaugccgagagcguaaaagggcgcuuuaccauaagcagggacaauuucaagagcacgcucuuucuccagaugaauagcuugcgagcggaagauaccgcgcucuauuacugugccagggacuugcgcgagagcgagugcgaggaaugggaaucggacuauuacgcguucuaucgcaagcucccgugcgugaaaccgcgcggggucgcgggcacgcucgauaucuggggccagggcacgauggugacagugagcuca

SEQ ID NO: 55269 - RNA, 438 nt, Artificial Sequence
  derived and/or modified sequence opt11 from anti-HIV_cap256-119-153124_VR-Chain
caagugcaauuggucgagagcgggggcgggguagugcaaccgggcaggagcuugaccuugagcugcaucgcgagccaguucaauuucgcgagcuauggcaugcacugggucaggcaagcgccagggaaagggcucgaguggguggccucgaucucgcacgauggcacgaaaaaguaccaugccgagagcgugugggggcgcuuuaccauaagcaaggacaauagcaagaacacgcuauuucuccagaugaauagcuugcgaguggaagauaccgcgcucuauuucugugucaaggaccagcgcgaggacgagugcgaggaaugguggucggacuauuacgauuucgggcgcgagcucccgugcaggaaaucgcgcgggcucgggcucgcgggcauauucgauauguggggccauggcacgauggugaccgugagcucg

SEQ ID NO: 55270 - RNA, 438 nt, Artificial Sequence
  derived and/or modified sequence opt11 from anti-HIV_cap256-119-153025_VR-Chain
caaaugcaauuggucgagagcgggggcggggucgugcaaccgggcaagagcuugaccuugagcugugccgcgagccaguucacguucucaaacuauggcaugcacugggucaggcaagcgcccgggaaagggcucgaguggguggccucgaucucgaacgauggcaauaaaaaguaccauggcgauagcgugugggggcgcuugaccauaagcagggacaauagcaagaacacgcucuuucuccagaugaauagcuugcgcccggaagauaccgcgcucuauuucugugucaaggaccagcgcgaggacgagugcgaggaaugguggucggacuauuacgauuucgggcgcgagcuaccgugcaggaaauuucgcgggcuagggcucgcgggcauauucgauaucuggggccauggcacgauggugaccgugagcucg

SEQ ID NO: 55271 - RNA, 432 nt, Artificial Sequence
  derived and/or modified sequence opt11 from anti-HIV_cap256-119-152713_VR-Chain
gaagugcaauuggucgagagcgggggcgggcucgugcgcccgggcgggagcuugcgcuugagcugugcaacgagcggguucacguucucgagccauuggaugagcugggucaggcaagcgcccgggaaagggcuagaguggguggccgggaucucguucgcgggcacgaaaacguacuauggcgauagcgugaaagggcgauuuaccgugagcacagacauaagcaagaacacgcucuaucuccaggucaauagcuugcgcccagaagauacagcgauguauuacugugccagagaccagcgcuauuacgagugcgaggaaugggccucggacuauuacgauuucgggaaagagcaaccgugcuuggacccgcgcggggucgugggcauauucgauaucuggggccagggcacgauggugaccgugagcucg

SEQ ID NO: 55272 - RNA, 438 nt, Artificial Sequence
  derived and/or modified sequence opt11 from anti-HIV_cap256-119-151794_VR-Chain
cacgugcaauugguagagagcgggggcggggucgugcaaccgggcacgagcuugcgcuugagcugugucgcgagcgaguucucguucaagaacuauggcaugcacugggucaggcaagcgcccgggaaagggcucgaguggguggccucgaucucaaacgauggcacgaaaaaguaccaugccgagagcgugugggaucgcuuuagcauaagcaaggacaauagcaagaacacgcucuuucuccagaugaauagcuugcgcguggaagauaccgcgcucuauuucugugucaaggaccagcgcgaggacgagugcgaggaaugguggucggacuauuacgauuucgggcgcgagcucccgugcaggaaaucgcgagggcucgggcucgcgggcauauucgauauguggggccauggcacgauggugaccgugagcucg

SEQ ID NO: 55273 - RNA, 438 nt, Artificial Sequence
  derived and/or modified sequence opt11 from anti-HIV_cap256-119-150980_VR-Chain
caagugcaauuggucgagagcgggggcggggucgugcaaccgggcaagagccugcgcuugagcugugccgcgagcggguucauacucucgaacuaugccaugcacugggucaggcaagcgcccgggaaagggcuagaguggguggccucgaucucgaacgauggcucgaaaaaguaccauggcgauagcgugugggcgcgcuuuaucauaagcagggacaauagcaagaacacgcucuuucuccagaugagcucauugcgcgcggaagauaccgcgcucuauuucugugucagggaccaucgcgaggacgagugcgaggaaugguggucggacuauuacgauuucgggcgcgagcucccgugcaggaaauuucgagggcucgggcucgcgggcauauucgauaucuggggccauggcacgauggugaccgugagcucg

SEQ ID NO: 55274 - RNA, 432 nt, Artificial Sequence
  derived and/or modified sequence opt11 from anti-HIV_cap256-119-148895_VR-Chain
caagugcaauuggucgagagcgggggcggggucgugcaaccgggcaggagcuugcgcuugagcugugccgcgagcggguucacguucaggagcuauggcaugcacugggucaggcaagcgcccgggaaagggcucgaguggguggcagugaucucgagcgauggcgauaucgaguacuauacccagagcgugaaaggacgauuuaccauaagcagggacaauagcaagaacacgcucuaucuccagaugaaugccuugcgcccggaagauaccgcgauguauuacugugcaagggaccagcgcuauuacgagugcgaggaaugggccucggacuauuacgauuucgggcgcgagcaaccgugccaggacccgcgcggggucgugggcguguucgauauguggggccagggcacgauggugaccgugagcucg

SEQ ID NO: 55275 - RNA, 438 nt, Artificial Sequence
  derived and/or modified sequence opt11 from anti-HIV_cap256-119-148848_VR-Chain
caaaugcaauuggucgagagcgggggcggggucgugcaaccgggcaggagcuugaccuugagcugugccgcgagccaguucucguucacgagcuauggcaugcacugggucaggcaagcgcccgggaaagggcucgaguggguggccucgaucucgaacgauggcacgaaaaaguaccauggcgagagcgugugggaucgcuuuagcauaagcagggacaauagcaagaacacgcucuuucuccagaugaauagcuugcgcguggaagauaccgcgcuuuauuucugugucaaggaccagcgcgaggacgagugcgaggaaugguggucggacuauuacgauuucgggaaagagcucccgugcaggaaauggaaaacgcgcggggucgcgggcauacucgauaacuggggccagggcacgauguugaccgugagcucg

SEQ ID NO: 55276 - RNA, 432 nt, Artificial Sequence
  derived and/or modified sequence opt11 from anti-HIV_cap256-119-148743_VR-Chain
caagugcaauuggucgagagcgggggcggggucgugcaaccgggcaggagcuugacccugagcugugccgcgagccaguucaauuucgcgaacuauggcaugcacugggucaggcaagcgcccgggaaagggcucgaguggguggccucgaucucgaacgacggcacgaaaaaguaccaugccgagagcgugugggaucgcuuuagcauaagcaaggacaauagcaagaacacgcucuuucuccagaugaauagcuugcgcguggaagauaccgcgcucuauuucugugucaaggaccagcgcgaggacgagugcgaggaaugguggucggacuauuacgauuucgggaaaaagcucccgugcaggaaaucgcgcggacucgcgggcauauuccaugucuggggccauggcacgauggugaccgugagcucg

SEQ ID NO: 55277 - RNA, 432 nt, Artificial Sequence
  derived and/or modified sequence opt11 from anti-HIV_cap256-119-148595_VR-Chain
gaagugcaauuggucgagagcgggggcgggcuagugcaaccgggcgggagcuugcgauugagcugugccgcgagcagguucacguucgauaacuauggcaugcacugggucaggcaagcgcccgggaaagggcucgaguggguggccuugcucaauuacgauggcucgaaaaaguacuaugucgauagcgugaaagggcgauuuaucauauucagggacaauagcaagaacacgcucuuucuccagaugaauagccugcgcccggaagauaccgcgcucuauuucugugucaaggaccagcgcgaggacgcgugcgaggaaugguggucggacuauuacgauuucgggaaaaagcucccgugcaggaaaucgcgcgggcucgcgggcauauuccaugucuggggccauggcacgauggugaccgugagcucg

SEQ ID NO: 55278 - RNA, 432 nt, Artificial Sequence
  derived and/or modified sequence opt11 from anti-HIV_cap256-119-148490_VR-Chain
caagugcaauuaguagagagcgggggcggggucgugcaaccgggcaggagcuugcgcuugagcugugucgcgagcggguucacguucucggacuaugccaugcacuggguaagacaagcgcccgggaaagggcucgaguggguggccacgaucucguucgauggcgcggacaaguaccaugccgaugacgugugggggcgcuuuaccauaagcagggacaauagcaagaacacgcucuaucuccagaugaauagcuugcgcccggaagauacagcgcucuauuacugugccaaggacuugcgcgaggacgagugcgaggaaagguggucggacuauuacgauuucgggaaacagcucccgugcaggaaaucacgaggggucgcgggaguguucgauaacuggggccagggcacgauggugaccgugagcucg

SEQ ID NO: 55279 - RNA, 438 nt, Artificial Sequence
  derived and/or modified sequence opt11 from anti-HIV_cap256-119-148470_VR-Chain
caagugcaauuggucgagagcgggggcggggucgugcaaccgggcaggagcuugcgcuugagcugugucgcgagcggguucacguucucgagcuauggcauacacugggucaggcaagcgccagggaaagggcucgaguggguggccgugaucucggacgauggcucgaaaaaguaccaugaagagagcgugugggggcgcuuuaccauaagcaaggacaauagcaagaacacgcucuuucuacagaugaauaguuugcgcauagaagauaccgcgcuauauuucugugucaaggaccagcgcgaggacgagugcgaggaaugguggucggacuauuacgauuucgggcgagagcucccgugcaggaaaucacgcgggcucgggcucgcgggcauauucgauauguggggccauggcacgauggugaccgugagcucg

SEQ ID NO: 55280 - RNA, 432 nt, Artificial Sequence
  derived and/or modified sequence opt11 from anti-HIV_cap256-119-148107_VR-Chain
gaagugcaacuggucgagagcgggggcgggcucgugcaaccgggagggagcuugcgcuugagcugugccgcgagcggguucacggucucgagcaauuacaugaccugggucaggcaagcgcccaggaaagggcucgagugggugggcucgaucucguacgauggcucggacaaguaccauaccaauagcuugugggggcgcuuuaucgugagcagggacaauagcaagaacacgcuauaucuccagaugaauaacuugcgcccggaagauaccgcgcuauauuacugugucagggacaggcgagagagcgagugcgaggaaagguggucggacuauuacgauuucgggaaacagcucccgugcgugaaaccgcgcggggucgcgggcauauucgauaucuggggccagggcacgauggugacagugagcucg

SEQ ID NO: 55281 - RNA, 432 nt, Artificial Sequence
  derived and/or modified sequence opt11 from anti-HIV_cap256-119-147933_VR-Chain
gaauugcaauugguggagagcgggggagggcuggugcaaccgggauggagcuugagguugagcugugaggcgagcggguucccguucucggcauuuuggaugacauggguaaggcaggcgccagggaaagggcugggguggguggcauuuauaagguacgaugggaguaacaaguacuaugcagauagcgugaaagggagguuuacaauaagcagggacaauagcaugacgacgcuauaucuacagaugaauagcuugagggcggaagaugcagcgguauauuacugugcaaaggacuugagggaggacgagugcgaggaaugguggucggacuauuacgauuucgggaaaaggcugccgugcaggaaaucgagagggguggcgggaguguucgauaaaugggggcagggaacgauggugacagugagcucg

SEQ ID NO: 55282 - RNA, 432 nt, Artificial Sequence
  derived and/or modified sequence opt11 from anti-HIV_cap256-119-147434_VR-Chain
caagugcaauuggucgagagcgggggcggggucgugcaagcgggcaggagcuugcgcuugagcugugccgcgagccaguucacguucgggcgcuauggcaugcacugggucaggcaagcgcccgggaaagggcucgagugggugggcucaaucucguacgauggcucggacaaguaccauaccaauagcgugugggggcgcuuuaucgugagcagggacaauagcaagaacacgcucuaucuccagaugaauagcuugcgcccggaagauaccgcgauguauuacugugccagggaccagcgcuauuacgagugcgaggaaugggccucggacuauuacgauuucggacgcgagcaaccgugccaggacccgcgcggggucgugggcguguucgauauguggggccagggcacaauggugacagugagcucg

SEQ ID NO: 55283 - RNA, 435 nt, Artificial Sequence
  derived and/or modified sequence opt11 from anti-HIV_cap256-119-146106_VR-Chain
caagugcagcuagucgagagcgggggcggggucgugcaaccgggcaggagcuugcgccugagcugugccgcgagcggguucacguucucaagcucaggcaugcacugggucaggcaagcgcccgggaaagggcuacaauggguagccgugaucucguacgacggcgggaacaaguacuaugccgacagcgugaaagggcgcuuuaccauaagcagggacaauagcaagaacaaccucuaucuccagaugaauagccugcgcccggaagauaccgcacucuauuacugcgccagggacuugagagagauggagugcgaggaauggaaauuauacaacuacuaugacuuccgcacgcgcgggcccugugucgaucccaggggcguggucgggagcuuugacgugugggggcaaggaaccguggucacgguaucgagc

SEQ ID NO: 55284 - RNA, 438 nt, Artificial Sequence
  derived and/or modified sequence opt11 from anti-HIV_cap256-119-145604_VR-Chain
gacgugcaacuggcagagagcgggggagggcucgugcaaccgggcgggagcuugcgcuugagcugugucgcgagcggguucacguucucgagcuucgaaaugcacugggucaggcaagcgcccgggaaagggcucgaguggguggccucgaucucgaacgauggcacgaaaagguaccaugccgagagcgugugggaucgcuuuagcauuagcaaggacaauagcaagaacacgcucuuucuccagaugaauagcuugcgcguggaagauaccgcgcucuauuucugugucaaggaccagcgcgaggacgagugcgaggaaugguggucggacuauuacgauuucgggcgcgagcuaccgugcaggaaaucgcgcgggcucgggcuagcgggcauauucgauauguggggccauggcacgauggugaccgugagcucg

SEQ ID NO: 55285 - RNA, 438 nt, Artificial Sequence
  derived and/or modified sequence opt11 from anti-HIV_cap256-119-143998_VR-Chain
caagugcaauuagucgagagcgggggcggggucgugcaaccgggcaggagcuugcgcuugaguugugccgcgagcggguucacguucaggaacuauggcaugcacugggucagacaagcgcccgggaaagggcucgaguggguggccucgaucucgaacgauggcucgaaaaaguaccauggcgauagcgugugggcgcgcuuuaucauaagcagggacaauagcaagaacacgcuauuucuccagaugucgagcuugcgcgcggaagauaccgcgcucuauuucugugucaaggaccagcgagaggacgagugcgaggaaugguggucggacuauuacgauuucgggcgcgagcucccgugcaggaaaucgcgagggcucgggcucgcgggcauauucgauauguggggccauggaacgauggugaccgugagcucg

SEQ ID NO: 55286 - RNA, 438 nt, Artificial Sequence
  derived and/or modified sequence opt11 from anti-HIV_cap256-119-143441_VR-Chain
gaagugcacuuggucgagagcgggggcgggcucgcgcaaccgggcaggagcuugcgcuugagcugugccgcgagccaguucaauuucgcgagcuauggcaugcacugggucaggcaagcgcccgggaaagggcucgaguggguggccucgaucucgaacgauggcacgaaaagguaccaugccgagagcgugugggaucgcuuuagcauaagcaaagacaauagcaagaacacacucuuucuacagaugaauagccugcgaguggaagauaccgcgcucuauuucugugucaaggaccagcgcgaggacgagugcgaggaaugguggucggacuauuacgauuucgggcgcgagcucccgugcaggaaaucgcgcgggcucgggcuagcgggcauauucgauauguggggccauggcacgauggugaccgugagcucg

SEQ ID NO: 55287 - RNA, 432 nt, Artificial Sequence
  derived and/or modified sequence opt11 from anti-HIV_cap256-119-141307_VR-Chain
caagugcacuuggucgagagcgggggcggggucgugcaaccgggcaggagcuugcgauugagcugugccgcgagccaguucacguucaaucgcuauggcuugcacugggucaggcaagcgcccgggaaagggcucgaguggguggccgggaucucguacgauggcagggacaaguaccaugcccauuucgugugggggcgcuuuaucauaagcagggacaauagcaagaacacgcucuaucuccagaugaauagcuugcgcgcggaagauaccgcgcucuauuacuguguaagggaccugcgcgagagcgagugcgagcucugggaaucagacuauuacgauuucgggaaaagacucccgugcgugaaaccgcgaggggucgcgggcacguucgaucucuggggccagggcacaauggugaccgugagcucg

SEQ ID NO: 55288 - RNA, 432 nt, Artificial Sequence
  derived and/or modified sequence opt11 from anti-HIV_cap256-119-140896_VR-Chain
gaagugaaauuggucgagagcgggggcgggcucgugcaaccgggcgggagcuugaaauugagcugugccgcgagcggguucacguucucguacuacgccaugcacugggucaggcaagcgcccgggaaagggcucgaguggguggccgugaucucguacgauggcucggacaaguacuaugccgauagcgugaaagggcgcuuuaccauaagcagggacaauagcaagaacacgcuccaucuccagaugaauagcuugcgcccggaagauaccgcgcucuauuucugugccagagacuugcgcgagagcgagugcgaggaaugggaaucguacuauuacgauuucgggaaaaagggcccgugcgugaaaccgcgcggggucgugggcgugcucgauaucuggggccagggaacgcucgugaccgugagcucg

SEQ ID NO: 55289 - RNA, 432 nt, Artificial Sequence
  derived and/or modified sequence opt11 from anti-HIV_cap256-119-140090_VR-Chain
gaagugcaauuggucgagagcgggggcgggcucgugcaaccgggcgggagcuugcgcuugagcugugccgcgagcggguucgcguucucgagcuauuggaugaccugggucaggcaagcgcccgggaaagggcuagaguggguggccgugaucucguacgauggcucgaacaaguacuaugccgauagcgugcgcgggcgcuuuaccauaagcagggacucgagcaagaacacgcucuaucucgagaugaauagcuugcgcccggaagauaccgcgcucuauuacugugccaaggacaugcgcggguacgagugcgaggaauggaccucggacuauuacgauuucgggcgaccgcaaccgugcauagacucgcgcggggucgugggcacguucgaugucuggggccagggcacgauggugaccgugagcucg

SEQ ID NO: 55290 - RNA, 438 nt, Artificial Sequence
  derived and/or modified sequence opt11 from anti-HIV_cap256-119-140037_VR-Chain
caagugcaauuggucgagagcgggggcgggcucgugcaaccgggcaggagcuugcgcuugagcugugccgcgagcggguucacguucgaugacuaugucaugcacugggucaggcaagcgcccggaaaagggcucgaguggguggccucgaucucgaacgauggcacgaaaaaguaccaugaagagagcgugugggggcgauuuaccauaagcaaggacaauagcaagagcacgcucuuucuccagaugaacagcuugcgcauagaagauaccgcgcucuauuucugugucaaggaccagcgcgaggacgagugcgaggaaugguggucggacuauuacgauuucgggcgagagcucccgugcaggaaaucgcgcgggcucgggcucgcgggcauauucgauauguggggccauggcacgauggugaccgugagcucg

SEQ ID NO: 55291 - RNA, 432 nt, Artificial Sequence
  derived and/or modified sequence opt11 from anti-HIV_cap256-119-139135_VR-Chain
gaagugcaauuggucgagagcgggggcggggucgugcgcccgggcgggagcgugcgcuugagcugugucgcgagcggguucucguucaggagcuauggcaugcacugggucaggcaagcgcccgggaaagggcucgaguggguggcaucgaucucguacgauggcagggacuuuuaccaugccaggagcgugugggggcgcuuuaccauaagcagggacaacagcaagaacacgcuccaucuccagaugaauagcuugcgcccggaagauaccgcgcucuauuucugugccagggacuugcgcgagagcgagugcgaggaaugggaaucguacuauuacgauuucgggaaaaagggcccgugcgugaaaccgcgcggggucgugggcgugcucgauaucuggggccagggcacgcucgugaccgugagcuca

SEQ ID NO: 55292 - RNA, 438 nt, Artificial Sequence
  derived and/or modified sequence opt11 from anti-HIV_cap256-119-137881_VR-Chain
caagugcaauuggucgagagcgggggcgggcucgugaaaccgggcaggagcuugaccuugagcugugccgcgagccaguucacguucucgaacuauggaaugcacugggucaggcaagcgcccgggaaagggcucgaguggguggccucgaucucgaacgauggcaauaaaaaguaccauggcgauagcgugugggcgcgcuuuaccauaagcagggacaauagcaagaacacgcuauuucuccagaugucgagcuugcgcacggaagauaccgcgcucuauuucugugucagggacaggcgcgaggacgagugcgaggaaugguggucggacuauuacgauuucgggcgagagcucccgugcaggaaauuucgcgggcucgggcucgcgggaauauucgauaucuggggccauggcacgauggugaccgugagcucg

SEQ ID NO: 55293 - RNA, 432 nt, Artificial Sequence
  derived and/or modified sequence opt11 from anti-HIV_cap256-119-137643_VR-Chain
gaagugcaauuggucgagagcgggggcgaucucgugcaaccgggcgggagccugcgcuugagcugugccgcgagcggauucucauucucgagcuauggcaugcacugggucaggcaagcgcccgauaaagggcucgagugggugaccgugaucucguacgauggcucgaacaagcacuaugccgauagcgugaaagggcgauuuaccauaagcagggacaauagcaagaacacgcucuaucucgagaugaacaccuugcgcgcggaagauaccgcgcucuauuacugugccaaggaccugcgcgaguacgagugcgaggaauggaccucggacuauuacgauuucgggcgcccgcaaccgugcauagacucgcgcggggucgugggcauacucgauaucuggggccagggcacgauggugagcgugagcucg

SEQ ID NO: 55294 - RNA, 438 nt, Artificial Sequence
  derived and/or modified sequence opt11 from anti-HIV_cap256-119-137170_VR-Chain
caagugcaauugguagagagcgggggcggggucgugcaaccgggcaggagcuugcgcuugagcugugccgcgagcgaguucacguucucgcgcuauagcaugcacugggucaggcaagcgcccgggaaagggcuagaguggguggccgugaucucgagcgauggcucgaaccaguuccaugccgauagcgugugggggcgauuuaccauaagcaaggacaauagcaagaacacgcucuuucuccagaugaauagcuugcgcauagaagauaccgcgcucuauuucugugucaaggaccagcgcgaggacgagugcgaggaaugguggucggacuauuacgauuucgggcgcgagcucccgugcaggaaaucgcgcgggcuugggcucgcgggcauauucgauauguggggccauggcacgauggugaccgugagcucg

SEQ ID NO: 55295 - RNA, 432 nt, Artificial Sequence
  derived and/or modified sequence opt11 from anti-HIV_cap256-119-136616_VR-Chain
caagugcaauugguagagagcgggggcggggucgugcaaccgggcaggaguuugcgcuugagcugugccgcgagcggguucacguucucgcgcaaugccauaaacugggucaggcaagcgcccgggcgagggcucgaguggguggccgugaucucggacgauggcucgcucaaguacuaugccgauagcgugaaaggacgcuuuaccauaagcagggacaauagcaagaacacgcucuaucuccagaugaauaaccugcgcccggaagauacagcgcucuauuacugugucagggacaggcgcgagagcgagugcgaggaaagguggucggacuauuacgauuucgggaaacagcucccgugcgugaaaccacgcggggucgcaggcauauucgauaucuggggccagggcacgauggugaccgugagcucg

SEQ ID NO: 55296 - RNA, 432 nt, Artificial Sequence
  derived and/or modified sequence opt11 from anti-HIV_cap256-119-136206_VR-Chain
caagugcaauuggucgagagcgggggcggagucgugcaaccgggcaggagcuugcgcuugagcugugccgcgagucaguucacguucgggcgcuauggcaugcacugggucaggcaagcgcccgggaaagggcucgaguggguggccgcgaucucguucgcgggcacgaaaaaguacuauggcgauagugcgcgcgggcgcuuuaccauaagcagggacaauagcaagaacaugcucuuucuccagaugaauagccugcgcgcggaagauaccgcgcucuauuacugugccagggacuugcgcgauuacgagugcgaggaaugggaagcguacuauuacgauuucgggcgcgugggcccgugcacggacccgcgcggggucgugggcauacuagaugucuggggccagggcacgcuagugaccgugagcucg

SEQ ID NO: 55297 - RNA, 438 nt, Artificial Sequence
  derived and/or modified sequence opt11 from anti-HIV_cap256-119-135565_VR-Chain
caagugcacuuggucgagagcgggggcggggucgugcaaccgggcaagagcuugcgcuugagcugugccgcgagccaguucacguucgaucgauauggcaugcacugggucaggcaagcgcccgggaaagggcucgaguggguggccucaaucucgaacgauggcacggacaaguaccaugcagauaacgugugggggcgcuuuaccauaagcagggacaauagcaagaacacgcucuaucucgagaugaauagcuugcgcggagaagauaccgcgcucuauuucugugucaaggaccagcgcgaggacgagugcgaggaaugguggucggacuauuacgauuucgggcgagagcucccgugcaggaaaucgcgcgggcucgggcucgcgggcauauucgauauguggggccauggcacgauggugaccgugagcucg

SEQ ID NO: 55298 - RNA, 432 nt, Artificial Sequence
  derived and/or modified sequence opt11 from anti-HIV_cap256-119-135025_VR-Chain
gaagugcaauuggucgagagcgggggcgggcucgugcaaccgggcgggagccugcgauugagcugugaagcgagcggguucacguucaauaccuaugaaaugaacugggucaggcaaccgcccgggcgcgggcuagaguggguggccgggaucucguucgcggccacgaaaacguacuauggcgggagcgugaaagggcgcuuuaccgugagcagggacauaagcaagaacacgcucuaucuccagauggauggcuugcgcggggaagacaccgcgcucuauuacugugccaaggacuugcgcgagcucgagugcgaggaaugggccucggacuauuacgauuucgggcgcccgcaaccgugcuuggacccgcgcggggucucgggaauaagcaaugucuggggccagggcacgauggugaccgugagcucg

SEQ ID NO: 55299 - RNA, 432 nt, Artificial Sequence
  derived and/or modified sequence opt11 from anti-HIV_cap256-119-133983_VR-Chain
caaaugcaauuggucgagagcgggggcggggucgugcaaccgggcaggagccugaccuugagcugugccgcgagccaguucaauuucgcgaacuauggcaugcacugggucaggcaagcgcccgggaaagggcucgaguggguggccucgaucucgaacgauggcacgaaaaaguaccaugaagagagcgugugggggcgcuuuaccauaagcaaggacaauagcaagaacacgcucuuucuccagaugaauagcuugcgcccggaagauaccgcgcucuauuacugugccaaggacuugcgcgaggacgagugcgaggaaagguggucggacuauuacgauuucgggaaacagcucccgugcaggaaaucgcgcggggucgcgggaguguucgauaacuggggccagggcacgauggugaccgugagcucg

SEQ ID NO: 55300 - RNA, 438 nt, Artificial Sequence
  derived and/or modified sequence opt11 from anti-HIV_cap256-119-133917_VR-Chain
caaaugcaacugguagagagcgggggcggggucgugcaaccgggcaggagccugaccuugagcugugccgcgagccaguucacguucucgaacuauggcaugcacugggucaggcaagcgcccgggaaagggcucgaguggguggccucaaucucgaacgauggcagcaaaaaguaccauggcgauucagugugggcgcgcuuuaccauaagcagggacaauagcaagaacacgcucuuucuccagaugucgagccugcgcguggaagauaccgcgcucuauuucugugucagggaccagcgcgaggacgagugcgaggaaugguggucggacuauuacgauuucgggcgcgagcucccgugcaggaaauuucgcgggcucgggcucgcgggcauauucgauaucuggggccacggcacgauggugaccgugagcucg

SEQ ID NO: 55301 - RNA, 432 nt, Artificial Sequence
  derived and/or modified sequence opt11 from anti-HIV_cap256-119-132663_VR-Chain
caagcgcaauuggucgagagcgggggcggggucgugcaaccgggcaggagcuugcgcauaagcugugccgugagccaguucacguucucgcgcuauggcaugcacugggucaggcaagcgcccgggaaagggcucgaguggguggccucgaucucguucgauggcagggacaaguaccauagcccgcucgugugggggcgccugaccauaagcagggacaauagcaagaacacgcucuuucucgagaugaauagccugcgcgcggaagauaccgcggucuauuacugugccagagacuugcgcgagagcgagugcgaggaauggcaaucggacuauuacgcguucuauaaaaagcucccgugcgugaaaccgcgcggggucgcgggcucgcucgauaucuggggccagggcacggucgugaccgugagcucg

SEQ ID NO: 55302 - RNA, 438 nt, Artificial Sequence
  derived and/or modified sequence opt11 from anti-HIV_cap256-119-132113_VR-Chain
caagugcaauuggucgagagcgggggcgggcucgugaaaccgggcgggagcuugcgccugagcugugccgcgagccaguucaauuucgcgaacuauggcaugcacugggucaggcaagcgcccgggaaagggcucgaguggguggccucgaucucgaacgauggcacgaaaaaguaccaugaagagagcgugugggggcgauuuaccauaagcaaggacaauagcaagagcacgcucuuucuucagaugaauagcuugcgcauagaagauacagcgcucuauuucugugucaaggaccagcgagaggacgagugcgaggaaugguggucggacuauuacgauuucgggcgcgagcucccgugcaggaaaucgcgagggcucgggcucgcgggcauauucgauauguggggccauggcacgauggugaccgugagcucg

SEQ ID NO: 55303 - RNA, 432 nt, Artificial Sequence
  derived and/or modified sequence opt11 from anti-HIV_cap256-119-131839_VR-Chain
caagugcaacuggucgagagcgggggcggggucguacaaccgggcaggagccugcgcuugagcugugccgcgagcggguucacguucucgagcuaugccaugcacugggucaggcaagcgcccgggaaagggcucgaguggguggccgugaucucguacgauggcucgaacaaguacuaugccgauagcgugaaagggcgauuuacaauaagcagagacaauagcaagaacacgcucuaucuccagaugaauagcuugcgcgcggaagauaccgcggucuauuacugugccagggaccagcgcuauuacgagugcgaggaaugggccucggacuauuacgauuucgggagagagcaaccgugccaggacccgcgcgggguagugggcguguucgauauguggggccagggcacgauggugaccgugagcucg

SEQ ID NO: 55304 - RNA, 435 nt, Artificial Sequence
  derived and/or modified sequence opt11 from anti-HIV_cap256-119-130626_VR-Chain
gaagugcaauuggucgagagcgggggcgggcuaauacacccgggcgggugccugcgccugagcugugccguaagcggguucacguucucggacuaucccaugcacugggucaggcaaucgcccgggaaagggcucgaguggguggccgugaucucguacgauggcauaaacuauuacuaugccgacagcgugaaagggcgcuuuaccauaagcagggacaauagcaagaacaaucucuuucuccagaugaauagccugcgccuggaagauaccgcgcucuauuacugugccagggacuugcgcgagcucgauugcgaggaauggaccuuauacaauuacuaugacuuuggcucacgaggaccaugcgucgaucccaggggcgugggcgggagcuuugacgugugggggcaagggaccauggucacggucucgagc

SEQ ID NO: 55305 - RNA, 438 nt, Artificial Sequence
  derived and/or modified sequence opt11 from anti-HIV_cap256-119-130191_VR-Chain
gaagugcaacuggucgagagcgggggcgggcucauacaaccgggcaggagcuugcgcuugagcugugccgcgagcggguucacggucucaagcaauuucaugaccugggucaggcaagcacccgggaaagggcucgaguggguggccucgaucucgaacgauggcacgaaaaaguaccaugccgagagcgugugggaucgcuuuagcauaaguaaggacaauagcaagaacacgcuauuucuccagaugaauagcuugcgcguggaagauaccgcgcucuauuucugugucaaggaccagcgagaggacgagugcgaggaaugguggucggacuauuacgacuucgggcgcgagcucccgugcaggaaaucgcgcgggcucgggcucgcgggcauauucgauauguggggccauggcacgauggugaccgugagcucg

SEQ ID NO: 55306 - RNA, 438 nt, Artificial Sequence
  derived and/or modified sequence opt11 from anti-HIV_cap256-119-129798_VR-Chain
caagugcaauugguagagagcgggggcggggucgugcaaccgggcaagagcuugcgccugagcugugcagcgagcggguucauauucucgagcuauuucaugcacugggucaggcaagcgcccgggaaagggcucgaguggguggccguggucacggacgauggcucgaaaaaguacuaugccgauagcgugaaagggcgcuuuaccauaagcagggacuauagcaagaacacgcucuuucuccagaugaaucgauugcgcguagaagauaccgcgcucuauuucugugucaaggaccagcgcgaggacgagugcgaggaaugguggucggacuauuacgauuucgggcgagagcucccgugcaggaaauuucgcgggcuagggcucgcgggcauauucgauauguggggccauggcacgauggugaccgugagcucg

SEQ ID NO: 55307 - RNA, 432 nt, Artificial Sequence
  derived and/or modified sequence opt11 from anti-HIV_cap256-119-128745_VR-Chain
caagugcaacuggucgagagcgggggaggggucgugcaaccgggcaggagccugcgcuugagcugugccgcgagcggguucacguucucgaacuaugccaugcacugggucagacaagcgcccgggaaagggcucgaguggguggccucgaucucauucgcgggcacgaaaacgcacuauggcaauagcguaaaagggcgcuuuagcauaagcagggacaauagcauaaacacggucuaucuacagaugaauagcuugcgcgcggaagauaccgcgcucuauuacugugccaaggaccugcgcgaguaugagugcgaggaauggaccucagacuauuacgauuucgggcgcccgcaaccgugcauagacucgcgcggggucgugggcauacucgacaucuggagccagggcacgauggugaccgugagcucg

SEQ ID NO: 55308 - RNA, 438 nt, Artificial Sequence
  derived and/or modified sequence opt11 from anti-HIV_cap256-119-128593_VR-Chain
caagugcaauuggucgagagcgggggaggggucgugcaaccgggcaggagccugcgauugagcugugccgcgagcggguucacguucucgagcuaugccaugcacugggucaggcaagcgcccgggaaagggcucgaguggguggccucgaucucguacgauggcagggacuuuuaccaugccaggagcgugugggggcgcuuuaccauaagcagggacaauagcaagaacacgcuccaucuccagaugaauagcuugcgcguggaagauaccgcgcucuauuucugugucaaggaccagcgagaggacgagugcgaggaaugguggucggacuauuacgauuucgggcgagagcucccgugcaggaaaucgcgcgggcucgggcucgcgggcauauucgauaucuggggccauggcacgauggugaccgugagcucg

SEQ ID NO: 55309 - RNA, 438 nt, Artificial Sequence
  derived and/or modified sequence opt11 from anti-HIV_cap256-119-128152_VR-Chain
caagugcaauuggucgagagcggaggcggggucgugcaaccgggcaggagcuuacgcuugagcugugccgugagcggguucacguucacgagcuaucccaugcacugggucaggcaagcgcccgggaaagggcucgaguggguggccucggucucgaacgauggcacgaaaaaguaccacggcgauagcgugugggaucgcuuuaccauaagcagagacaauagcaagaacacgcucuuucuccagaugucgagcuugcgcgcggaagauaccgcggucuauuucugugucagggacgagcgcgaggacgagugcgaggaaugguggucggacuauuacgauuucgggcgcgagcucccgugcaggaaauuucgcgggcucgggcucgcgggcauauucgauaucuggggccauggcacgcucgugaccgugagcucg

SEQ ID NO: 55310 - RNA, 438 nt, Artificial Sequence
  derived and/or modified sequence opt11 from anti-HIV_cap256-119-127693_VR-Chain
gaagugcaauugcuagagagcgggggcgggcuagugcaaccgggcgggagcuugcgcuugagcugugcagcgagcggguucacguucucgagcuaugccauggccugggucagacaagcgcccgggaaagggcucgaguggguggccucgaucucgaacgauggcucgaaaaaguaccauggcgauagcgugugggcgcgcuuuauaauaagcagggacaauagcaagaacacgcucuuucuccagaugucgagcuugcgcguggaagauaccgcgcucuauuucugugucagggaccaucgcgaggacgagugcgaggaaugguggucggacuauuacgauuucgggcgcgagcucccgugcaggaaauuucgcgggcucgggcucgcgggcauauucgauaucuggggccauggcacgauggugacagugagcucg

SEQ ID NO: 55311 - RNA, 432 nt, Artificial Sequence
  derived and/or modified sequence opt11 from anti-HIV_cap256-119-126684_VR-Chain
caagugcaauugguagagagcggaggcggggccgugcgcccgggcaggagcuugcgccugagcugugccacgagcggguucacguucucgaacuaugccaugcacugggucaggcaagcgcccgggaaagggcucgagugggugaccgggaucucguucgcgggcacgaaaacguacuauggcgauagcgugcgcgggcgcuuuaccgugagcagggacauaagcaagaacacgcucuuucuccagaugaauagcuugcgcccggacgauaccgcaauguauuacugugccagggaccagcgcuauuacgagugcgaggaaugggcaucggacuauuacgauuucgggcgcgagcaaccgugcuuagacccgcgcggggucgugggcauauucgaucucuggggacagggcacgauggugaccgugagcuca

SEQ ID NO: 55312 - RNA, 438 nt, Artificial Sequence
  derived and/or modified sequence opt11 from anti-HIV_cap256-119-126056_VR-Chain
gaagugcaauuggucgagagcggaggcgggcucgugcaaccgggcgggagcuugcgcuugagcugugccgauagcggguucacguucucgagcuauuggaugagcugggucaggcaagcgcccgggaaaggacucgaguggguggccucgaucucgaacgauggcacgaaaaaguaccaugccgagagcgugugggaucgcuuuagcauaagcaaggacaauagcaagaacacgcucuuucuccagaugaauagcuugcgcguggaagauaccgcgcucuauuucugugucaaggaccagcgcgaggacgagugcgaggaaugguggucggacuauuacgauuucgggcgcgagcucccgugcaggaaaucgcgcgggcucgggcucgcgggcauauucgauauguggggccauggcacgauggugaccgugagcucg

SEQ ID NO: 55313 - RNA, 432 nt, Artificial Sequence
  derived and/or modified sequence opt11 from anti-HIV_cap256-119-125765_VR-Chain
caagugcaacugguccagagcgggggcggggucgugcaaccgggcaggagccugcgcuugagcugugccgcgagcggguucacguucucgagcuaugucaugcacugggucaggcaagcgcccgggaaagggcucgagggcguggccgugaucucguucgauggcaauaacgaguacuaugccgacagcgugaaagggcgcuuuaccauaagcagggacaauagcaagaacacggucuaucuccagaugaauagcuugcgcguggaagauaccgcgcucuacuacugugccaaggacaugcgcgaguacgagugcgaggaauggaccucggacuauuacgauuucgggcgcccgcaaccgugcauagacucgcgcggggucgugggcauacucgauaucuggggccagggcauaauggugaccgugagcucg

SEQ ID NO: 55314 - RNA, 438 nt, Artificial Sequence
  derived and/or modified sequence opt11 from anti-HIV_cap256-119-125106_VR-Chain
caagugcaauuggucgagagcgggggcggggucgugcaaccgggcaggaguuugcgccugagcugugccgcgagcggguucauauucaggagcuauggcaugcacuggguaaggcaagcgcccgggaaagggcucgaguggguggccucgaucucgaacgauggcacgaaaagguaccaugccgagagcgugugggaucgcuuuagcauaagcaaggacaauagcaagaacacgcucuuucuccagaugaauagcuugcgcguggaagauaccgcgcucuauuucugugucaaggaccagcgcgaggacgagugcgaggaaugguggucggacuauuacgauuucgggcgcgagcucccgugcaggaaaucgcgcgggcucgggcucgcgggcauauucgauauguggggccauggcacgauggugaccgugaguucg

SEQ ID NO: 55315 - RNA, 435 nt, Artificial Sequence
  derived and/or modified sequence opt11 from anti-HIV_cap256-119-124026_VR-Chain
caagugcaauuggucgagagcgggggcggggucgugcaaucgggcaggagcuugcgccugaccuguagcgggagcgcguucagauucucgagcuauaccgugcacugggucaggcaagcgcccgggaaagggcuagagugguuggccuugaucucguacgauggccagaaaaagcacuuugcagauagcgugaaagggcgauuuaccauaagcagggacaauagcaagaacaaucuauuucuccagaugaauagcuugagauuggaagauaccgcgcucuauuacugugccagggaccugcgcgagcucgauugcgaggaauggaccuuguacaauuacuaugacuuuggcucgcgcgggcccugugucgaucccaggggcgugggcgggagcuuugacgugugggggcaagggaccauggucacggucucgagc

SEQ ID NO: 55316 - RNA, 432 nt, Artificial Sequence
  derived and/or modified sequence opt11 from anti-HIV_cap256-119-121783_VR-Chain
cucgggcgauuggucgcgagcgggggcggggucgugccaccgggcgggagcuugaccuugagcugugucacgagccaguucacguucucgggcuguggcuugcacugggucaggcaagcgcccgggaaagggcucgaguggguggccucgaucucguucgcgggcacgaaaaagcacuauggcucgagcgugcgcggacgcuuuagcauaagcagggacaauagcaagaacacgcucuaucuccagaugaauagcuugcgcacggaagauaccgcgcucuauuucugugcaaaggacuugcgcgaguacgagugcgaggaauggaccucggacuauuacgauuucgggcgcccgcaaccgugcauagacucgcgcggggucgugggcauacucgauaucuggggccagggcacgauggugaccgugagcucg

SEQ ID NO: 55317 - RNA, 432 nt, Artificial Sequence
  derived and/or modified sequence opt11 from anti-HIV_cap256-119-121208_VR-Chain
cucgggcgccuggucgcgagcgggggcggggucgugcccccgggcaagagcuugacccugagcugugucgcgagccaguucacguucucaggcuguggcuugcacugggucagacaagcgcccgggaaagggcucgaguggguggccucgaucucauucgcgggcacgaaaaagcacuauggcaauuucgugcgcgggcgcuuuaccauaagcagggacaauagcaagaacacgcucuaucuccagaugaauagccugcgcgcggaagauaccgcgcucuauuacugugccaaggaccugcgcgaguacgagugcgaggaauggaccucggacuauuacgauuucgggcgcccgcaaccgugcauagacucgcgcggggucgugggcauacucgauaucuggggccaaggcacgauggugaccgugagcuca

SEQ ID NO: 55318 - RNA, 432 nt, Artificial Sequence
  derived and/or modified sequence opt11 from anti-HIV_cap256-119-120945_VR-Chain
caagugcaauuggucgagagcgggggcggggucgugcaaccgggcgggagcuugcgcuugagcugugucgcgagcggguucacguucucgaacuauggcaugcacugggucaggcaagcgcccgggaaagggcucgcguggguggcauuuaucagguacgacggcucgaacaaguacuaugucgauagcgugugggggcgauuuaccauaagcagggacaauagcaagaacacgcuccaucuccagaugaauagcuugcgcccggaagauaccgcgcucuauuucugugccagggacuugcgcgagagcgagugcgaggaaugggaaucguacuauuacgauuucgggaacaagggcccgugcgugaaaccgcgcggggucgugggcgugcucgauaucuggggccagggcacgcuagugaccgugagcucg

SEQ ID NO: 55319 - RNA, 432 nt, Artificial Sequence
  derived and/or modified sequence opt11 from anti-HIV_cap256-119-118229_VR-Chain
caagugcaaguggucgagagcgggggcggggucgugcaaccgggcaggagccugcgcuugagcugugccgcaagcggguucacguucucgaacuaugccauacacuggguaaggcaagcgcccgggaaagggcucgaguggguagccuugaucucguacgauggauauaacaaguacuaugcagauagcgugcgcgggcgcuuuaccauaagcagggacaauagcaauaacacggucuaucuccagaugaauagcuugaaaccagaagauaccgcggucuauuacugugccagggacuugcgcgagagcgagugcgaggaaugggaaucguacuauuacgauuucgggaaaaagggcccgugcgugaaaccgcgcggggucgugggcgugcucgauaucuggggccagggaacgcucgugaccgugagcucg

SEQ ID NO: 55320 - RNA, 432 nt, Artificial Sequence
  derived and/or modified sequence opt11 from anti-HIV_cap256-119-118025_VR-Chain
gaagugcaauuggucgagagcgggggcggggucgugcaaccgggcaagagcuugcgcuugagcuguaccgcgagccaguucacguucucgaacuuuggcaugcacugggucaggcaagcgcccgggaaagggcucgaguggguggccucgaucucguucgugggcauaaaaacgcacuaugccaauagcgugcgcgggcgcuuuaccauaagcagggaccagagcaagaacacgcucuaucuccagaugaauagcgugcgcauagaagauaccgcgcgcuauuucugugccagggacaugcgcgaguacgagugcgagcucugggccucggacuauuacgauuucgggaaaccgcaaccgugcgaggacccgcgcggggucgugggcacguucgauauguggggcuugggcacgcucgugaccgugagcucg

SEQ ID NO: 55321 - RNA, 432 nt, Artificial Sequence
  derived and/or modified sequence opt11 from anti-HIV_cap256-119-117418_VR-Chain
caagugcaauuggucgagagcgggggcggggucgugcaaccgggcaggagcuugcgcuugagcugugccgcgagcggguucaauuucaggaacuaugacauaaacugggucaggcaagugcccgggaaagggcuagaguggguggccgcgaucucguucgauggcgcggacaaguaccaugccgauaacgugugggggcgguugagcauaagcagggacaauagcaagagcacgcucuaucuccagaugaauagcuugcgcccggaagauacagcggucuauuucugugccaaggaccugcgcgaggacgagugcgaggaaagguggucggacuauuacgauuucgggaaacagcuaccgugcaggaaaucgcgcggggucgcgggcauauucgauaacuggggccagggcacgauggugaccgugagcgcg

SEQ ID NO: 55322 - RNA, 432 nt, Artificial Sequence
  derived and/or modified sequence opt11 from anti-HIV_cap256-119-117250_VR-Chain
caagugcgcuuggucgagagcgggggcggggucgugcaaccgggcgggagcuugcgcuugagcugugccgcgagccaguucacguucucggcauauggcaugcacugggucaggcaagcgcccgggaaagggcucgaguggguggccucgaucucguucgauggcacggacaaguuccaugccgauaaagugugggggagauuggucauaagcagggacaauagcaagaacacgcucuaucuccagaugaauagcuugcgcccggaagauaccgcggucuauuacugugccaaggacuugcgcgaggacgagugcgaggaaagguggucggacuauuacgauuucgggaaacagcucccgugcaggaaaucgcgcggggucgcgggcguguucgauaacuggggccagggcacgauggugaccgugagcucg

SEQ ID NO: 55323 - RNA, 432 nt, Artificial Sequence
  derived and/or modified sequence opt11 from anti-HIV_cap256-119-117230_VR-Chain
caagugcaauuggucgagagcgggggcgggggcgugcaaccgggcaggagccugcgauugagcugugccgcgagcggguucacgcucucgagcuauggcaugcacugggucaggcaagcgccagggaaaggacucgaguggguggccucgaucucguucgauggcagggacuauuaccauagcccgcacgugugggggcgcuugacaauaagcagagacaauagcaagaacacgcucuaucuccagaugaauaguuugcgcgcggaagauacagcgcucuauuacugugccagggacuugcgcgagagcgagugcgaggaaugggaaucggacuauuacgauuucgggaaaaagggcccgugcgugaaaccgcgcggggucgcgggcucgcucgauauguggggccagggcacgauggugaucgugagcucg

SEQ ID NO: 55324 - RNA, 432 nt, Artificial Sequence
  derived and/or modified sequence opt11 from anti-HIV_cap256-119-116999_VR-Chain
caagugcaauuggucgagagcgggggcggggucgugcaaccgggcacgagcuugcgcauaagcugugccgcgagccaguucacguucucgcgcuauggcaugcacugggucaggcaagcgcccgggaaagggcucgaguggguggcaucgaucucguacgauggcagggacuauuaccaugccgggcgcgugugggggcgcuuuaccauaagcagggacaauagcaagaacacgcuauaucuccagaugaauagcuugcgcccggaagauaccgcgcucuauuucugugucagggacucgcgcgagagcgagugcgaggaaugggaaucggacuauuacgauuucgggaaaaagcucccgugcgugaaaccgcgcggggucgugggcgugcucgaucuauggggccagggcacgcucgugaccgugagcucg

SEQ ID NO: 55325 - RNA, 432 nt, Artificial Sequence
  derived and/or modified sequence opt11 from anti-HIV_cap256-119-116558_VR-Chain
caagugcaauuggucgagagcgggggcggggucgugcaaccaggcaggagcuugcgcuugagcugugccgcgagcggguucacguucaaucgcuauagcuugcacugggucaggcaagcgcccgggaaaggacucgaguggguggccuuuaccucguacgauggcucgaacaaguacuaucccgauagcgugaaagggcgcuuuaccauaagcagggacucgagcaagaacacgcucuaucucgagaugaauagccugcgcccggaagauaccgcgcucuauuacugugccaaggacaugcgaggguacgagugcgaggaauggaccucggacuauuacgauuucgggcgcccgcaaccgugcauagacucgcgcggggucgugggcacguucgaugucuggggccagggcacgauggugaccgugagcucg

SEQ ID NO: 55326 - RNA, 432 nt, Artificial Sequence
  derived and/or modified sequence opt11 from anti-HIV_cap256-119-116484_VR-Chain
gacgugcaauugcucgagagcgggggcgaucucgugcagccgggcgggagcuugcgcuugagcugugccgcgagcggauucacguucacgaaauaugaaaugaccugggucaggcaagcgcccgggaaagggcucgaguggguggccucgaucucguacgauggcucggacaaguaccauaccucgagcuugugggggcgcuuuaucgugagcagggacaauagcaagaacacgcucuaucuccagaugaauagcuugcgaccggaagacaccgcgcucuauuacugugucagggacaggcgcgagagcgagugcgaggaaagguggucggacuauuacgauuucgggaaacagcuaccgugcgugaaaccgcgcggggucgcgggcauauucgauaucuggggccagggcacgauggugaccgugagcucg

SEQ ID NO: 55327 - RNA, 438 nt, Artificial Sequence
  derived and/or modified sequence opt11 from anti-HIV_cap256-119-114844_VR-Chain
gaagugcaauuggucgagagcgggggcgaccucgugcaaccgggcaggagcuugcgcuugagcugugccgcgagcggguucacguucucgagcuauuggaugagcugggucaggcaagcgcccgggaaagggcucgaguggguggccucgaucucgaacgauggcacgaaaaaguaccaugaagagagcgugugggggcgcuuuaccauaagcaaggacaauagcaagagcacgcucuuucuccagaugaauagcuugcgcguggaagauaccgcgcuauauuucugugucaaggaccagagagaggacgagugcgaggaaugguggucggacuauuacgauuucggacgcgagcucccgugcaggaaaucgcgagggcucgggcuagcgggcauauucgauauguggggccauggcacgauggugaccgugagcucg

SEQ ID NO: 55328 - RNA, 438 nt, Artificial Sequence
  derived and/or modified sequence opt11 from anti-HIV_cap256-119-114141_VR-Chain
ggcgggcgcucgggcgggggcggggucgggaccacgccaaggcgcgggccccugcgauugagcugugccgcgagcggguucacgcucgaugacuaugcaaugcacugggucaggcaagcgcccgggaaagggcucgaguggguggcaucgaucucgaacgauggaacgaaaaaguaccaugccgagagcgugugggaucgcuuuagcauaagcaaggacaauagcaagaacacgcucuuucuccagaugaauagcuugcgcguggaagauacagcgcucuauuucuguguaaaggaccagagagaggacgagugcgaggaaugguggucggacuauuacguguucugggaaagggccccgugcaggaccgugcccgggcgcgggcccgggugguauuucgauauggugggcaggcgcacgauggugacagugagcucg

SEQ ID NO: 55329 - RNA, 432 nt, Artificial Sequence
  derived and/or modified sequence opt11 from anti-HIV_cap256-119-111917_VR-Chain
gaagugcacuuggucgagagcgggggcgggcucgugcaaccgggcgggagcuugcgauugagcugugccgcgagcggguucacguucucgagcuauggcaugcacugggucaggcaagcgcccgggaaagggcucgaguggguggccacgaucucguucgauggcgcggacaaguaccaugccgaugacgugugggggcgcuuuagcauaagcagggacaauagcaagaacacgcuauaucuccagaugaauaacuugcgcccggaagauaccgcgcucuauuacugugccaaggacuugcgcgaggacgagugcgaggaaagauggucggacuauuacgauuucgggaaacagcucccgugcaggaaaucgcgagggguugcgggcguguucgauaacuggggccagggcacgauggugacagugagcucg

SEQ ID NO: 55330 - RNA, 432 nt, Artificial Sequence
  derived and/or modified sequence opt11 from anti-HIV_cap256-119-111862_VR-Chain
caagugcaauuggucgagagcgggggcggggucgugcaaccgggcgggagccugcgauugagcugugccgcgagcggguucacguacucggacuauggcaugcacugggucaggcaagcgcccgggaaagggcucgaguggguggccucgaucucguucgcgggcacgaaacagcacuauggcaauagcgugaaagggcgcuuuaccauaagcagagacaauagcaagaacacggucuaucuccagaugaauagcuugcgcguggaagauaccgcgcucuauuacugugccaaggacaugcgagaguacgagugcgaggaauggaccucggacuauuacgauuucgggcgcccgcaaccgugcauagacucgcgcggggucgugggcauacuagauaucuggggccagggcauaauggugacagugagcucg

SEQ ID NO: 55331 - RNA, 432 nt, Artificial Sequence
  derived and/or modified sequence opt11 from anti-HIV_cap256-119-110064_VR-Chain
cucgggcgcuuggucgcgagcgggggcggggucgugcccccgggcaggagcuugcgcuugagcugugucgcgagccaguucacguucucgggcuguggccugcacugggucaggcaagcgcccgggaaagggcucgaguggguggccucgaucucguucgcgggaacgaaacagcacuauggcaauagcgugaaagggcgcuuuaccauaagcagggacaauagcaagaacacggucuaucuccagaugaauagcuugcgaguggaagauaccgcgcucuauuacugugccaaggacaugcgcgaguacgagugcgaggaauggaccucggacuauuacgauuucgggcgcccgcaaccgugcauagacucgcgcggggucgugggcauacucgauauauggggccagggcacgauggugaccgugagcuuu

SEQ ID NO: 55332 - RNA, 432 nt, Artificial Sequence
  derived and/or modified sequence opt11 from anti-HIV_cap256-119-109192_VR-Chain
caagugcaacuggucgagagcgggggcgggguagugcaaccgggcaggagcuugcgccugagcugugccgcgagcggguucacguucucgaacuaugccaugcacugggucaggcaagcgcccgggaaagggcucgaguggguggccgugaucgcguacgauggcgauaacaaguacuaugccgauagcgugaaagggcgcuuuaccauaagcagggacaauagcaagaacacgcucuaucuccagaugaauagcuugcgcgcggaagauacagcgcucuauuacugugccaaggacuugcgcgaggacgagugcgaggaaugguggucggacuauuacgaucucgggaaacagcucccgugcaggaaaucgcgcggggucgcgggcgugcucgauaaauggggcuugggcacgauggugaccgugagcucg

SEQ ID NO: 55333 - RNA, 435 nt, Artificial Sequence
  derived and/or modified sequence opt11 from anti-HIV_cap256-119-108793_VR-Chain
caauuccaacucgucgaauccggcggcggcgucguccaacccggccgcucccuccgacucuccugcgccgccuccggcuucaccuucuccuccuaccccaugcacuggguccgccaagcccccggcaaaggccucgaaugggucgcacuaaucuccuacgacggcaccgacaaauacuacgcagacuccgucaaaggccgcuucaccaucucccgagacaacuccaaaaacacccucuaccuccaaaugaacucccuccgcgucgaagacaccgccguauaccacugcgccaaagaccucggcggcucaaaauccgacgaaugggccaccgacuacuacuacgacugguccaaagccuaccccguccacgacccccgcgccgucgucggcgucuucgacaucuggggccaaggcacccucguaaccguauccucc

SEQ ID NO: 55334 - RNA, 432 nt, Artificial Sequence
  derived and/or modified sequence opt11 from anti-HIV_cap256-119-108127_VR-Chain
caagugcaauuggucgagagcgggggcggggucgugcaaccgggcaggagcuugcgaauaagcugugccgcgagccaguucacguucaaucgauauggcaugcacugggucaggcaagcgcccgggaaagggcuagaguggguggccucgaucucguacgauggcucagacaaguaccaugccgggcucgugugggggcgcuucaucauaagcagggacaauagcaagaacacgcucuaucuacagaugaauagcuugcgcgcggaagauaccgcgcuauauuacugugucagggacaggcgcgagagcgagugcgaggaaagguggucggacuauuacgauuucgggaaacagcucccgugcgugaaaccgcgcggggucgcgggcauauucgauaucuggggccagggcacgauggugaccgugagcucg

SEQ ID NO: 55335 - RNA, 438 nt, Artificial Sequence
  derived and/or modified sequence opt11 from anti-HIV_cap256-119-107758_VR-Chain
gaagugcaacuggucgagagcgggggcgggcucgugaaaccgggcgggagcuugcgcuugagcugugccgcgagcggguucacguucucgaacgcguggaugagcuggguaaggcaagcgccagggaaagggcuagaguggguggccucgaucucgaacgauggcacgaaaaaguaccaugaagagagcgugugggggcgcuuuaccauaagcaaggacaauagcaagaacacgcucuuucuccagaugaauagcuugcgaauagaagauaccgcgcucuauuucugugucaaggaccagcgagaggacgagugcgaggaaugguggucggacuauuacgauuucgggcgcgagcucccgugcaggaaaucgcgcgggcucgggcucgcgggcauauucgauauguggggccauggcacgauggugaccguaagcucg

SEQ ID NO: 55336 - RNA, 432 nt, Artificial Sequence
  derived and/or modified sequence opt11 from anti-HIV_cap256-119-107209_VR-Chain
gaagugcaauuggucgagagcgggggcgggcucgugcaaccgggcaggagcuugcgcuugagcuguaccgcgaguggguucacguucggggacuauggcaugcacugggucaggcaagcacccgggaaagggcucgaguggguggccgcgaucucguucgauggcgcggacaaguaccaugccgauaacgugugggggcgauugagcauaagcagggacaauagcaagagcacgcucuaucuccagaugaauagcuugcgcccggaagauaccgcggucuauuucugugccaaggacuugcgcgaggacgagugcgaggaaagguggucggacuauuacgauuucgggaaacagcucccgugcaggaaaucgcgcggggucgcgggcauauucgauaacuggggccagggcacgauggugacagugagcgcg

SEQ ID NO: 55337 - RNA, 432 nt, Artificial Sequence
  derived and/or modified sequence opt11 from anti-HIV_cap256-119-107184_VR-Chain
caagcgcaauuggucgagagcggaggcggggucgugcaaccgggcaggagcuugggcuugagcugugcagcgaguaaguucucgcucucgagcuauggcaugcacugggucaggcaagcgcccgggcgcgggcucgaguggguggccgggaucucguucgcgggcacgaaaaaguacuaugccgauagcgugcgcgggcgcuuuagcgugagcacggacauaagcaagaacacgcucuaucuccagaugaauagcuugcgcccggcagauaccgcgcucuauuucugugccagggacuugcgcuauuacgagugcgaggaaugggccucggacuauuacgauuucgggaaagagcaaccgugcuuggacccgcgcggggucgugggcauauucgaucuauggggacagggcacgauggugaccgugagcucg

SEQ ID NO: 55338 - RNA, 438 nt, Artificial Sequence
  derived and/or modified sequence opt11 from anti-HIV_cap256-119-106827_VR-Chain
gccgugcaauuggucgagagcgggggcgggcucgugcaaccgggagggagcuugcgcuugagcuguagcgugagccaguucacguucgggagauauggcauguacugggucaggcaagcgcccgggaaagggcucgaguggguggccgugaucucguacgauggcgggaacagguacuaugccgauagcgugaaaaaucgcuuuagcauaagcagggacaauagcaagaacacgcucuuucuacagaugucgagcuugcgcgcggaagauaccgcgcucuauuucugugucagagaccaucgcgaggacgagugcgaggaaugguggucggacuauuacgauuucgggcgcgagcucccgugcaggaaauuucgcgggcucgggcucgcgggcauauucgauaucuggggccauggcacgauggugaccgugagcucg

SEQ ID NO: 55339 - RNA, 432 nt, Artificial Sequence
  derived and/or modified sequence opt11 from anti-HIV_cap256-119-106511_VR-Chain
caagugcaacuggucgagagcgggggcggggucgugcaaccgggcaggagcuugcgcuugagcugugucgcgagccaguucucguucgaucgauauggcaugcacugggucaggcaagcgcccgggaaagggcucgaguggguggccucaaucucguucgauggcacggacaaguaccaugccgauaaagugugggggcgcuuuaccauaagcagggacaauagcaagaacacgcuauaucuccagaugaauagcuugcgcccggaagauaccgcgcucuauuacugugccaaggacaugcgcgaggacgagugcgaggccugguggucggacuauuacgaucucgggaaacagcucccgugcagggaaucgcgcggggucgcgggcauauucgaugaauggggccagggcacgauggugaccgugagcucg

SEQ ID NO: 55340 - RNA, 432 nt, Artificial Sequence
  derived and/or modified sequence opt11 from anti-HIV_cap256-119-106327_VR-Chain
caagugcaauuggucgagagcgggggcggggucgugcaaccgggaaggagcuugcgccugagcugugccgcgagcggguucacguucucgagcuaugccaugcacugggucaggcaagcgcccgggaaagggcuagaguggguggccgcgaucucgggcgggggcgggaacacguacguggccgauagcgugaaagggagauuuacaauaagcagggacaauagcaagaacacgguauaccuccagaugaauagcuugcgcuuggaagauaccgcgcucuauuacugugccaaggacuugcgagaguacgagugcgaggaauggaccucggacuauuacgauuucgggcgaccgcaaccgugcauagacucgcgcggagucgugggcauacucgauaucuggggccagggcacgauggugaccgugagcucg

SEQ ID NO: 55341 - RNA, 438 nt, Artificial Sequence
  derived and/or modified sequence opt11 from anti-HIV_cap256-119-105486_VR-Chain
caagugcaauuggucgagagcgggggcggggucgugcaaccgggcgggagcuugcgcuugagcugugccgcgagcggguucacggucucgggcuauggaaugcacugggucaggcaagcgcccgcgaaagggcuagacuggguggccuuuaucucgcacgauggcucgaacaaguacuaugccgauagcgugcgcgggcgcuuuaucauaagcagggacaauagcaauaacacgcucuauguccagaugucgagcuugcgcgcggaagauaccgcgcucuauuucugugucagggaccaucgcgaggacgagugcgaggaaugguggucggacuauuacgauuucgggcgcgagcucccgugcaggaaauuucgcgggcucgggcucgcgggcauauucgauaucuggggccauggcacgauggugaccgugagcucg

SEQ ID NO: 55342 - RNA, 432 nt, Artificial Sequence
  derived and/or modified sequence opt11 from anti-HIV_cap256-119-105197_VR-Chain
caagugcaauuggucgagagcgggggcggggucgugcaaccgggcaggagcuugcgcuugagcugugccgugagccaguucacguucgggcgcuacggcaugcacugggucaggcaagcgcccgggaaagggcucgagugggugggcucgaucucguacgauggcucggacaaguaccauacaaauagcuugugggggcgcuuuaucgugagcagggacaauagcaagaacacgcucuaucuccagaugaauaaccugcgcccggaagauaccgcgcucuacuacugugucagggacaggcgcgagagcgagugcgaggaaagguggucggacuauuacgauuucgggaaacagcucccgugcgugaaaccgcgcggggucgugggcgugcucgacaucuggggccagggcacgcucguaaccgugagcucg

SEQ ID NO: 55343 - RNA, 432 nt, Artificial Sequence
  derived and/or modified sequence opt11 from anti-HIV_cap256-119-104946_VR-Chain
caagagcaacuggucgagagcgggggcggggucgugcaaccgggcaggagcuugcgauugagcugugucgcgaguagguucacguucucggccuuuggcaugcacugggucaggcaagcgcccgggaaagggcucgaguggguggccucgaucucguucgcgggcaucaaaaaguacuauggcgauagcgugaaaggacgcuuuaccauaagcagggacaauagcaagaacacgcucuaucuccagauggauggcuugcgaggggaagauacagcgcucuauuacugugccaaggacuugcgcgagcucgagugcgaggaaugggccucggacuauuacgauuucgggcgaccgcaaccgugcauagacucgcgcggggucgugggcauacucgauauauggggccagggcauaauggugaccgugagcucg

SEQ ID NO: 55344 - RNA, 432 nt, Artificial Sequence
  derived and/or modified sequence opt11 from anti-HIV_cap256-119-103667_VR-Chain
caagugcacuuggucgagagcgggggcggggucgugcaaccgggcaagagcuugcgcuugagcugugccgcgagccaguucacguucaaucgcuuuggaaugcacugggucaggcaagcgcccgggaaaggacucgaguggguggccgggaucucguacgauggcucggacaaguaccaugccgauaaagugugggggagauuuaccauaagcagggacaauagcaagaacacgcucuaucuccagaugaauagccugcgcgcggaagauaccgcgcucuauuacugugccaaggacuugcgcgaggacgagugcgaggaaugggccucggacuauuacgauuucgggaaagagcaaccgugcuuggacccgcgcggggucgugggcauauucgauaucuggggccagggcacgauggugaccgugagcucg

SEQ ID NO: 55345 - RNA, 438 nt, Artificial Sequence
  derived and/or modified sequence opt11 from anti-HIV_cap256-119-103385_VR-Chain
gaagugcaacuggucgagagcgggggcgggcucgugcaaacgggcgggagcuugcgcuugagcugugccgcgagcggauucacguucucgcgcuaugacaugaacugggucaggcaagcgcccgggaaagggcucgaguggguggccucgaucucgaacgauggcucgaaaaaguaccauggcgauagcgugugggcgcgcuuuaccauaagcagggacaauagcaagaacacgcucuuucuacagaugucgagcuugcgcguggaagauaccgcgcucuauuucugugucagggaccagcgagaggacgagugcgaggaaugguggucggacuauuacgauuucgggcgagagcucccgugcaggaaauuucgcgggcucgggcucgcgggcauauucgauaucuggggccauggcacgauggugaccgugagcucg

SEQ ID NO: 55346 - RNA, 438 nt, Artificial Sequence
  derived and/or modified sequence opt11 from anti-HIV_cap256-119-103267_VR-Chain
gaagugcccucggucgagagcgggggcgggcucgugcaaacgggcgggagcuugacauugagcugugccgcgagccaguucacguucucgaacuauggcaugcacugggucaggcaagcgcccgggaaagggcucgaguggguggccucgaucucgaacgauggcucgaaaaaguaccauggcgauagugugugggcgcgcuuuaucauaagcagggacaauagcaagaacacacuauuucuccagaugucgagcuugcgcgcggaagauaccgcgcucuauuucugugucagggaccaucgcgaggacgagugcgaggaaugguggucggacuauuacgauuucgggcgagagcucccgugcaggaaauuucgcgggcucgggcucgcgggcauauucgauaucuggggccauggcacgauggugaccgugagcucg

SEQ ID NO: 55347 - RNA, 432 nt, Artificial Sequence
  derived and/or modified sequence opt11 from anti-HIV_cap256-119-103011_VR-Chain
caagugcaacuggucgagagcgggggcggggucgugcaaccgggcgggagcuugcgcuugagcugugccacgagcggguucacguucgggaccuuuggcaugcacugggucaggcaagcgcccgggaaaggacucgauuggguggccgcgauaucguucgcgggcacgaaaaagaacuaugccgauagcgugcgagggcgcuuuaccauaagcagggacucgagcaagaacacgcucuaucuccaaaugaauagcuugcgcccggaagauaccgcgcucuauuacugugucaaggacaugcgcggguacgagugcgaggaauggacaucggacuauuacgauuucgggcgaccacaaccgugcauagacucgcgcggggucgugggcacguucgaugucuggggccagggcacgauggugaccgugagcucg

SEQ ID NO: 55348 - RNA, 438 nt, Artificial Sequence
  derived and/or modified sequence opt11 from anti-HIV_cap256-119-102072_VR-Chain
gaagugcaauuggucgagagcggaggcgggcucgugcaaccgggcgggagcuugcgcgugagcugugccgugagcggguucacguucucgaacuaugaaaugaacugggucaggcaagcgcccgggaaagggcucgaguggguggcaucgaucucgaacgauggcacgaaaaaguaccaugccgagagcgugugggaucgcuuuagcauaagcaaggacaauagcaagaacacgcucuuucuccagaugaauagcuugcgaguggaagauacagcgcucuauuucugugucaaggaccagcgagaggacgagugcgaggaaugguggucggacuauuacgauuucgggcgcgagcucccgugcaggaaaucgcgcgggcuugggcucgcgggcauauucgauaucuggggccauggcacgauggugaccgugagcucg

SEQ ID NO: 55349 - RNA, 438 nt, Artificial Sequence
  derived and/or modified sequence opt11 from anti-HIV_cap256-119-101945_VR-Chain
gaagugcaauuggucgagagcgggggcgggcucgugcaaccgggcgggagcuugcgccugagcugcgccgcgagcggguucacguucucgagcuaugucaugcacugggucaggcaagcgcccgggaaagggcucgaguggguagccucgaucucgaacgauggcacgaaaaaguaccaugaagagagcgugugggggcgcuuuaccauaagcaaggacaauagcaagaacacgcucuuucuccagaugaauagcuugcgcauagaagauaccgcgcucuauuucugugucaaggaccagcgcgaggacgagugcgaggaaugguggucggacuauuacgauuucgggcgcgagcucccgugcaggaaaucgcgagggcucgggcucgcgggcauauucgauauguggggccauggcacgauggugaccgugagcucg

SEQ ID NO: 55350 - RNA, 432 nt, Artificial Sequence
  derived and/or modified sequence opt11 from anti-HIV_cap256-119-101319_VR-Chain
caagugcaacuggucgagagcgggggcggggucgugcaaccgggcaagagcuugcgcuugagcugugucgggagcggguucacguucgaugacuauggcaugcacugggucaggcaagcgcccgggaaagggcucgaguggguggccucgaucucguacgauggaagagacuuuuaccaugccagaagcgugugggggcgcuuuaccauaagcagggacaauagcaagaacacgcuccaucuccagaugaauagccugcgcccggaagauaccgcgcucuauuucugugcaagggacuugcgcgagagcgagugcgaggaaugggaaucguacuauuacgauuucgggaaaaagggcccgugcgugaaaccgcgcggggucgugggcgugcucgauaucuggggacagggcacgcucgugaccgugagcucg

SEQ ID NO: 55351 - RNA, 432 nt, Artificial Sequence
  derived and/or modified sequence opt11 from anti-HIV_cap256-119-100871_VR-Chain
caagugcaauuggucgagagcgggggcggggucgugcaaccgggcgagagcuugcgcauaagcugugccgcgagccaguucacguucucgcgcuauggcaugcacugggucaggcaagcgcccgggaaagggcucgaguggguggccucgaucucguucgauggcagagacaaguaccauagcucgcucgugugggggcgcuugaccauaagcagggacaauagcaagagcacgcuauuucuccagaugaauagcuugcgcgcggaagauaccgcgcucuauuacugugccagggacuugcgcgagagcgagugcgaggaaugggaaucggacuauuacgauuucgggaaaccgcaaccgugcgaggacccgcgcggagucgugggcacguucgauauguggggcuugggcacgcucgugaccgugagcucg

SEQ ID NO: 55352 - RNA, 432 nt, Artificial Sequence
  derived and/or modified sequence opt11 from anti-HIV_cap256-119-100838_VR-Chain
gaagugcaauuggucgagagcgggggcggggucgugcaaccgggcgggagcuugcgcuugagcugugccgcgagcggguucacguucucgagcuauggcaugcacugggucaggcaagcgcccgggaaagggcucgaguggguggccuuuaucagguacgauggcucgaacaaguacuaugccgauagcgugaaagggcgcuuuaccauaagcagggacaauagcaaucacacgcucuauaugcagcucgauagcuugcgcgcggaagauaccgcgcuauauuacugugccaaggacuugcgagaguacgagugcgaggaauggaccucggacuauuacgauuucgggcgcccgcaaccgugcauagacucgcgcgggguagugggcauacucgauauauggagccagggcacgauggugaccgugagcucg

SEQ ID NO: 55353 - RNA, 438 nt, Artificial Sequence
  derived and/or modified sequence opt11 from anti-HIV_cap256-119-100025_VR-Chain
caagugcaauuggucgagagcgggggcggggucgugcaaccgggaaggagcuugcgcuugagcugugccgcgagcguguucacguucucguacuauggcaugcacugggucaggcaagcgccagggaaagggcucgaguggguggccuuuauaucgcacgauggcucgaacaaguacuaugccgauagcgugcgcgggcgcuuuaucauaagcagggacaauagcaauaacacgcucuauguccagaugaauagcuugcgcgcggaagauaccgcgcucuauuucugugucaaggaccagcgcgaagacgagugcgaggaaugguggucggacuauuacgauuucgggcgcgagcucccgugcaggaaauuucgcgggcucgggcucgcgggcacguucgauaucuggggccauggcacgauguugaucgugagcucg

SEQ ID NO: 55354 - RNA, 432 nt, Artificial Sequence
  derived and/or modified sequence opt11 from anti-HIV_cap256-119-100000_VR-Chain
caaaugcaacuggucgagagcggaggcggggucgugcaaccgggcaggagccugaccuugagcugugccgcgagccaguucacguucucgaacuauggcaugcacugggucaggcaagcgcccgggaaagggcucgaguggguggccucgaucucaaacgauggcaauaaaaaguaccauggcgauagcgugugggcgcgcuuuaccauaagcagggacaauagcaagaacacgcucuuucuccagaugucgagccugcgcacggaagauaccgcgcucuauuucugugucagggacaggcgcgagagcgagugcgaggaaagguggucggacuauuacgauuucgggaaacagcucccgugcgugaaaccgcgcggggucgcgggcauauucgauaucuggggccagggcacgauggugaccgugagcucg

SEQ ID NO: 55355 - RNA, 432 nt, Artificial Sequence
  derived and/or modified sequence opt11 from anti-HIV_cap256-119-098890_VR-Chain
caagugcaauuggucgagagcgggggcggggucgugcaaccgggcgagagcuugcgcauaagcugugucgcgagccaguucacguucgggcgcuauggaaugcacugggucaggcaagcgccagggaaagggcucgaguggguggccucaaucucguucgauggcagggacaaguaccauagcccgcucgugugggggcgcuugaccauaagcagggacaauagcaagaacacgcucuuucuccagaugaauagccugcgcacggaagauaccgcgcucuauuacugugccagggaccugcgcgagagcgagugcgaggaaugggaaucggacuauuacgcguucuggcgcaagcucccgugcgugaaaccgcgcggggucgcgggcacgcucgauaucuggggccagggcacgauggugagcgugagcucg

SEQ ID NO: 55356 - RNA, 435 nt, Artificial Sequence
  derived and/or modified sequence opt11 from anti-HIV_cap256-119-098715_VR-Chain
caagugcaauuggucgagagcggaggcgggguagugcaaccgggcaggagcuugcgcuugagcugugccgcgagcggguucucguucaauaaccacggcaugcacugggucaggcaagcgcccgggaaagggcucgaguggguggcaggaauaucguucgcgggcaucaaaaaguacuauggcacgagcgugaaagggcgcuuuaccauaagcagggacaauagcaagaacaaucucuuucuccagaugaauagccugcgcguggaagauaccgcgcucuacuacugugccagggaccugcgagagauggagugcgaggaauggacccuguacaauuacuaugacuuuggcucgcgcgggcccuguguagaucccagaggcgugguagggagcuuugacgugugggggcaagggaccauggucacggucucgagc

SEQ ID NO: 55357 - RNA, 438 nt, Artificial Sequence
  derived and/or modified sequence opt11 from anti-HIV_cap256-119-098632_VR-Chain
caaaugcaacuggucgagagcgggggcggggucgugcaaccgggcagaagccucaccuugagcugugccgcgagccaguucaauuucgcgaacuaugacaugcacugggucaggcaagcacccgggaaagggcucgaguggguggcauuuaucagguacgauggcaauaacaaguacuaugccgauagcgugaaagggcgcuuuaccauaagcagggacaauagcaagagcacguuguuccuccagaugaauagcuuacgcauagaagauaccgcgcucuauuucugugucaaggaccagcgcgaggacgagugcgaggaaugguggucggacuauuacgauuucgggcgcgagcucccgugcaggaaaucgcgcgggcucgggcucgcgggcauauucgauauguggggccauggaacgauggugaccgugagcucg

SEQ ID NO: 55358 - RNA, 432 nt, Artificial Sequence
  derived and/or modified sequence opt11 from anti-HIV_cap256-119-097199_VR-Chain
caagugcaauuggucgagagcgggggcggggucgugcaaccgggcaggagucugcgcuugagcugugccgcgagcggguucgcguucucgagcuaugccuuucacugggucaggcaagcgcccgggaaagggcucgaguggguggccuauaucccguuccauggcaaucaacaguacuauggcgauagcgugaaagggagauuuaccauaagcagggacaauagcagggacacgcuauuucuagagaugaauagcuugcgcccggaagauaccgcgcucuauuucugugccagggaccagcgauauuacgagugcgaggaaugggccucggacuauuacgauuucgggcgagagcaaccgugcuuggacccgcgcggggucgugggcauauucgaucucuggggccagggcacgauggugacagugagcucg

SEQ ID NO: 55359 - RNA, 432 nt, Artificial Sequence
  derived and/or modified sequence opt11 from anti-HIV_cap256-119-096189_VR-Chain
caagugcaauuggucgagagcgggggcggggucgugcaaccgggcaggagccugcgauugagcugugccgcgagcggguucaaguucgggagcuuuggcaugcacugggucaggcaagcgcccgggaaagggcucgaguggguggccgugaucucguacgauggcucggacaaguacuauggcucgagcgugcgcgggcgauuuagcauaagcagggacaauagcaagaacacgcucuaucuccagaugaauagcuugcgcacggaagauaccgcgcucuauuucugugccaaggaccugcgcgaguacgagugcgaggaauggaccucggacuauuacgauuucgggcgcccgcaaccaugcauagacucgcgcggggucgugggcauacucgauaucuggggccagggcacgauggugaccgugagcucg

SEQ ID NO: 55360 - RNA, 432 nt, Artificial Sequence
  derived and/or modified sequence opt11 from anti-HIV_cap256-119-094581_VR-Chain
caagugcacuuggucgagagcgggggcggggucgugcaaccgggcaggagccugcgcuugagcugugccgcgagcggguucaauuucucgaacuaugccauacacugggucaggcaaacgcccgggaaagggcucgagugggugaccuugaucucgaacgauggcucgaacaaguacuaugccgauagcuugaaagggcgcuuuaccauaagcagagacaauagcaagaacacgcucuaucuccagaugaauagccugcgcgcggaagacaccgcacucuauuacugugccaaggacuugcgcgaggacgagugcgaggaaugguggucggacuauuacgauuucgggaaacagcucccgugcaggaaaucgcgcgggguagcgggcauauucgauggauggggccagggcacgauggugaccgugagcucg

SEQ ID NO: 55361 - RNA, 432 nt, Artificial Sequence
  derived and/or modified sequence opt11 from anti-HIV_cap256-119-094200_VR-Chain
gaagugcaauugguagagagcgggggcgggcucgugcaaccgggcgggagcuugcgcuugagcugugccgcgagcggguucauauucucaagcuaugccuugcacugggucaggcaagcgcccgggaaagggcucgaguggguggccucgaucucguucgcgggcacgaaaaaucacuauggcaacagcgugaaagggcgcuuuaccauaagcagggacaauagcaagaacacggucuaucuccagaugaauagcuugcgcgcggaagauaccgcgcucuauuacugugcaaaggacuugcgcgaguacgagugcgaggaauggaccucggacuauuacgauuucgggcgcccgcaaccgugcauagacucgcgcggggucgugggaauacucgauaucuggagccagggcacgauggugaccgugagcucg

SEQ ID NO: 55362 - RNA, 432 nt, Artificial Sequence
  derived and/or modified sequence opt11 from anti-HIV_cap256-119-094158_VR-Chain
caaaugcaauuggucgagagcgggggcggggucgugcaaccgggcucgagccugaccuugagcugugccgcgagccaguucacguucucgaacuauggaaugcacugggucaggcaagcgcccgggaaagggcucgaguggguggccucgaucucgaacgauggcacgaaaaaguaccauggcgauagcgugugggaucgcuuuaccauaagcagggacaauagcaagaacacgcucuuucuccagaugaauagcuugcgcgcggaagauaccgcgcucuauuucugugucaaggaccagcgcgaggacgagugcgaggaaugguggucggacuauuacgauuucgggaaacagcucccgugcaggaaaucgcgcggggucgcgggcauauucgauagcuggggccagggcacgauggugaccgugagcuca

SEQ ID NO: 55363 - RNA, 432 nt, Artificial Sequence
  derived and/or modified sequence opt11 from anti-HIV_cap256-119-092814_VR-Chain
caagugcaauuggucgaguucgggggcggggucgugcaaccgggcgggagcuugcgcuugagcugugcagcgagcggguucuauuucacggacuauggcaugcacugggucaggcaagcgcccggggaagggcuccaguggguggccuuuaucucguacgauggcaauacaaagaccacggccgauagcgugcgagggcgcuuuaccuugagcagggacaauagcaagaacacgcuauaucuccagaugaauagcgugcgcguggaagauaccgcgcgcuauuucugugccagggacaugcgcgaguacgagugcgagcucugggccucggacuauuacgauuucgggaaaccgcaaccgugcgaggacccgcgcggggucgugggcacguucgauauguggggcuugggcacgcuagugaccgugagcucg

SEQ ID NO: 55364 - RNA, 432 nt, Artificial Sequence
  derived and/or modified sequence opt11 from anti-HIV_cap256-119-092808_VR-Chain
caagugcaauuggucgagagcgggggcggggucgugcaaccgggcaggagcuugcgcuugagcugugccgcaagccaguucucguucgggaacuauggcaugcacugggucaggcaagcgcccgggaaagggcuagaguggguggccgcgaucucguucgcgggcacgaaaacgaacuaugccgauagcgugaaagggcgcuuuaccauaagcagagacaauagcaagaacacggucuaucuccagaugaauagcuugcgcgcggaagauaccgcgcucuauuucugugccaaggacauacgcgaguacgagugcgaguacuggaccucggacuauuacgauuucgggcgcccgcaaccgugcauagacucgcgcggggucgugggcacguucgaugucuggggccagggcacgauggugaccgugagcucg

SEQ ID NO: 55365 - RNA, 432 nt, Artificial Sequence
  derived and/or modified sequence opt11 from anti-HIV_cap256-119-092573_VR-Chain
caagagcaauuggucgagagcgggggcggggucgugcaaccgggcacgagcuugcgcuugagcuguagcgcgagcggguucacguucucgaacuuugccaugaacugggucaggcaagcgcccgggaaagggcucgagugggugagcuuuaucucgagcgauggcaagaacaagaacuaugucgauagcgugaaagggcgcuuuacaauaagcagggacaauuacaagaacacgcucuaucuccagaugaauagcuugcgcacggaagauaccgcggucuauuacugugccaaggacuugggcgggaccaaggacgaugaaugggccacggacuauuacgauuggucgacagcguacccgguccaggacccgcgcgcggucgcgggcggguucgaucucuggggcuugggcacgauggugaccgugagcucg

SEQ ID NO: 55366 - RNA, 432 nt, Artificial Sequence
  derived and/or modified sequence opt11 from anti-HIV_cap256-119-090815_VR-Chain
caagugcaauuggucgagagcgggggcggggucguggaaccgggcaggagcuugcgauugagcugugcagcgagccaguucucguucucgagcuauggcaugcacugggucaggcaagcgcccgggaaagggcucgaguggguggccgcgaucucguucgauggcgcggacaaguaccaugccgauaacgugugggggcgcuugagcauaagcagggacaauagcaagagcacgcucuaucuccagaugaauagccugcgcccggaagauaccgcggucuauuucugugccaaggacuugcgcgaggacgagugcgaggaaagguggucggacuauuacgauuucgggaaacagcucccgugcaggaaaucgcgaggggucgcgggcauauucgauaacuggggccagggcacgauggugaccgugagcgcg

SEQ ID NO: 55367 - RNA, 438 nt, Artificial Sequence
  derived and/or modified sequence opt11 from anti-HIV_cap256-119-090368_VR-Chain
caagugcaauuggucgagagcgggggcggggucgugcaaccgggcaggagcuugcgcuugagcugugccgcgagcggguucgcguucucgcacuauggaauauucugggucaggcaagcgcccgggaaagggcucgaguggguggccucgaucucgaacgauggcacgaaaaaguaccaugccgagagcgugugggaucgcuuuagcauaagcaaggacaauagcaagaacacgcucuuucuccagaugaauagcuugcgcguggaagauaccgcgcucuauuucugugucaaggaccagcgcgaggacgagugcgaggaaugguggucggacuauuacgauuucgggcgcgagcucccgugcaggaaaucgcgcgggcucgggcucgcgggcauauucgauauguggggccauggcacgauggugacagugagcucg

SEQ ID NO: 55368 - RNA, 432 nt, Artificial Sequence
  derived and/or modified sequence opt11 from anti-HIV_cap256-119-089710_VR-Chain
caagugcaauuggucgagagcgggggcggggucgugcaaccgggcaggagcuugcgcuugagcuguaccgcgagcggauucggguucucgaacuaugccaugcacugggucaggcucgcgcccgggaaagggcucgaguggguggccucaaucucguacgauggcagggacuaucaccaugccggggccgugugggggcgcuuuaucauaagcagggacaauagcaagaacucgcuccaucuccagaugaauagcuugcgcccggaagauaccgcgcucuauuucugugccagggacuugcgcgagagcgagugcgaggaaugggaaucggacuacuacaauuucuggaaaaagcuaccgugcgugaaaccgcgcggggucgugggcauacucgauaucuggggccagggcacggucgugaccgugagcucg

SEQ ID NO: 55369 - RNA, 432 nt, Artificial Sequence
  derived and/or modified sequence opt11 from anti-HIV_cap256-119-088555_VR-Chain
caagugcaauuggucgagagcgggggcggggucgugcaagcgggcaggagcuugcgcuugagcugugccgcgagccaguucacguucucgcgcuauggcaugcacugggucaggcaagcgcccgggaaagggcucgaguggguggccgggaucucguacgaugguagggacaaguaccaugcccauuucgugugggggcgcuucaucauaagcagggacaauagcaagaacacgcucuaucuccagaugaauagcuugcgcgcggaagauaccgcgcuauauuacugugucagggacuugcgcgagagcgagugcgagcucugggaaucggacuauuacgauuucggaaaaaggcucccgugcguaaaaccgcgcggggucgcgggcacguucgaucucuggggccagggcacgauggugaccgugagcucg

SEQ ID NO: 55370 - RNA, 432 nt, Artificial Sequence
  derived and/or modified sequence opt11 from anti-HIV_cap256-119-087962_VR-Chain
gaaaugcaauuggucgagagcgggggcgggcucgugaaaccgggcaggagccugcgauugagcugugccgcgagcggguucacguucucgagcuaugccauacacugggucaggcaagcgcccgggaaagggcucgaguggguggccgugaucucguacgauggcucgaacaaguacuaugccgauagcgugaaagggcgcuuuaccauaagcagggacaauagcaagaacacggucuaucuccagaugaauagccugcgcguggaagauaccgcgcucuauuacugugccaaggacuuacgagaguacgagugcgaggaauggaccucagacuauuacgauuucgggaaaccgcaaccgugcauagacucacgcggggucguaggcauacucgauaucuggggccagggcauaauggugaccgugagcucg

SEQ ID NO: 55371 - RNA, 432 nt, Artificial Sequence
  derived and/or modified sequence opt11 from anti-HIV_cap256-119-086903_VR-Chain
caagugcaccuggucgagagcgggggcgggguagugcaaccgggcaagagcuuacgcuugagcugugccgcgagccaguucacguucgaucgcuauggcaugcacugggucaggcaagcgcccgggaaagggcucgaguggguggccucgaucucgaacgauggcacggacaaguaccaugccgauaacgugugggggcgcuuuaccauaagcagggacaauagcaagaacacgcucuaucucgagaugaauagccugcgcggggaagauaccgcgcucuauuacugugccaaggacaugcgagaggacgagugcgaggaaugguggucggacuauuacgauuucgggcgcccgcaaccgugcauagacucgcgcggggucgugggcacguuccaugucuggggccagggcacgauggugaccgugagcucg

SEQ ID NO: 55372 - RNA, 432 nt, Artificial Sequence
  derived and/or modified sequence opt11 from anti-HIV_cap256-119-086804_VR-Chain
gaagugcaauuggucgagagcgggggaggggucgugcaaccgggcaggagcuugcgcuuguucugugccgggagcggguucacguucucgagcuauggcuugcacugggucaggcaagcgcccgggaaagggcucgagugggugagcuuuaucucguacgauggcucgaccacgaaauaugccgauagcuugaaagggcgauuuaccguaagcagggacaauagcaagaacacggucuaucucgagaugaauagcuugcgcgcggaagauaccgcgcucuauuacugugccaaggacuugcgcgaguacgagugcgaggaauggaccucggacuauuacgauuucgggcgcccgcaaccgugcauagacucgcgcggggucgugggcauacucgauaucuggggccagggcacgauggugaccgugagcucg

SEQ ID NO: 55373 - RNA, 432 nt, Artificial Sequence
  derived and/or modified sequence opt11 from anti-HIV_cap256-119-085910_VR-Chain
gaagugcaauugcucgagagcggaggcgggcucgugcaaccgggcgggagccugcgcuugagcugugccgcgagcggguucacguucucgagcuauggcaugcacuggguccggcaagcggccgggaaagggcucgaguggguggccucgaucucguacgauggcagggacuaucaccaugccggggccgugugggggcgcuuuaucauaagcagggacaauagcaagaacucgcuccaucuccagaugaauagcuugcgcccggaagauaccgcgcucuauuucugugccagggacuugcgcgagagcgagugcgaggaaugggaaucggacuauuacaauuucuggaaaaagcucccgugcgugaaaccgcgcggggucgugggcauacucgauaucuggggccagggcacggucgugacagugagcucg

SEQ ID NO: 55374 - RNA, 432 nt, Artificial Sequence
  derived and/or modified sequence opt11 from anti-HIV_cap256-119-085772_VR-Chain
gaagugcgcuuggucgagagcgggggcgggcuaauacaaccgggcgggagcuugcgcuugagcugugccgcgagcgggcucacggucucgagcaaucacaugagcugggucaggcaagcgcccgggaaagggcucgaguggguggccguaaucucguacgauggcucgaacacguucuauggcgauagcgugaaagggcgcuuuaccgugagcagggacauaagcaagaacacgcuauaucuacagaugaauagcuugcgcccggaagauacagcgauguauuacugugccagggaccagcgcuauuacgagugcgaggaaugggccucggacuauuacgauuucgggcgcgagcaaccgugccaggacccgcgaggggucgugggcguguucgauauguggggccagggcacgauggugaccgugagcucg

SEQ ID NO: 55375 - RNA, 432 nt, Artificial Sequence
  derived and/or modified sequence opt11 from anti-HIV_cap256-119-084603_VR-Chain
caagugcaauuggucgagagcgggggcggggucgugcaaucgggcaggagcuugcgcuugagcugugccgcgagcggguucccguucucggacuuugccaugcacugggucaggcaagcgcccgggaaagggcucgaguggguggccucgaucucguucgugggcauaaaaacgcacuaugccaauagcgugcgcgggagauuuaccauaagcagggaccagagcaagaacacgcucuaucuccagaugaauagcgugcgcguggaagauaccgggcgauauuacugugccagggacaugcgcgaguacgagugcgagcucugggccucggacuauuacgauuucgggaaaccgcaaccgugcgaggacccgcgcggagucgugggcacguucgauauguggggcuugggcacgcuagugacagugagcucg

SEQ ID NO: 55376 - RNA, 432 nt, Artificial Sequence
  derived and/or modified sequence opt11 from anti-HIV_cap256-119-084276_VR-Chain
caagugcaauuggucgagagcgggggcggggucgugcaaccgggcaggagccugcgccugagcugugccgcgagcagguucacguucucgagcuaugccaugcacugggucaggcaagcgcccgggaaagggcucgaguggguggccgugaucugguacgauggcucgaacaaguacuaugccgauagcgugcgcgggcgauuuagcgugagcacggacauaagcaagaacacgcucuaucuccagaugaauagcuugcgaccggccgauaccgcgcucuauuucugugccagagacuugcgcuauuacgagugcgaggaaugggccucggacuauuacgauuucgggaaagagcaaccgugcuuggacccgcgcggggucgugggcauauucgaucucuggggccagggcacgauggugaccgugagcucg

SEQ ID NO: 55377 - RNA, 432 nt, Artificial Sequence
  derived and/or modified sequence opt11 from anti-HIV_cap256-119-082288_VR-Chain
caaguguacuuggucgagagcgggggcggggucgugcaaccgggcaggagcuugcgccugagcucggccgcgagccauuucucgcuaucgagcuauggcaugcacugggucaggcaagcgcccgggaaagggcucgaguggguggccgggaucucauucgcgggcacgaaaacguacuauggagauagcgugaaagggcgcuuuaccgugagcacggacauaagcaagaacacgcucuaucuccaggucaauagcuugcgcccggaagauaccgcgauguauuacugugccagagaccagcgcuauuacgagugcgaggaaugggccucggacuauuacgauuucgggaaagagcaaccgugcuuggacccgcgcggggucgugggcauauucgauaucuggggccagggcacgauggugaccgugagcucg

SEQ ID NO: 55378 - RNA, 432 nt, Artificial Sequence
  derived and/or modified sequence opt11 from anti-HIV_cap256-119-080383_VR-Chain
caagugcaauuggucgagagcgggggcggggucgugcaaccgggcaggagcuugcgcauaagcugugccgcgagccaguucacguucucacgauauggcaugcacugggucaggcaagcgcccgggaaagggcucgaguggguggccucgaucucguacgauggcacggacaaguaccaugccaggcucguguggggacgcuuuaccauaagcagggacaauagcaagaacacgcucuaucuccagaugaauagcuugcgcgcggaagauaccgcgcucuauuacugugucagggacgagagagagagcgagugcgagcucugggaaucggacuauuacgauuucgggaaaaagcucccgugcgugaaaccgcgcggggucacgggcucgcucgauauguggggacagggcacgcaagugaccgugagcucg

SEQ ID NO: 55379 - RNA, 438 nt, Artificial Sequence
  derived and/or modified sequence opt11 from anti-HIV_cap256-119-079333_VR-Chain
gaagugcaauuagucgagagcgggggcaggcucgugcaaccgggcucgcccuugcgcuugagcugugccgcgagccaguucaauuucgcgagcuauggcaugcacugggucaggcaagcgccagggaaagggcucgaguggguggccucgaucucgaacgauggcacgaaaaaguaccaugccgagagugugugggaucgcuuuagcauaagcaaggacaauagcaagaacacgcucuuucuccagaugaauagcuugcgcguggaagauaccgcgcuauauuucugugucaaggaccagcgcgaggacgagugcgaggaaugguggucagacuauuacgauuucgggcgcgagcucccgugcaggaaaucgcgcgggcucgggcucgcgggcauauucgauauguggggccauggcacgauggugaccgugagcucg

SEQ ID NO: 55380 - RNA, 441 nt, Artificial Sequence
  derived and/or modified sequence opt11 from anti-HIV_cap256-119-078618_VR-Chain
caaaugcaauuggucgagagcgggggcggggucgugcaaccgggcaggagcuugaccuugagcugugccgcgagccaguucaauuucgcgagcuauggcaugcacugggucaggcaagcgcccgggaaagggcucgaguggguggccucgaucucgaacgauggcacgaaaaaguaccaugcagagagcgugugggaucgcuuuagcauaagcaaggacaauagcaagaacacgcucuuucuccagaugaauagcuugcgaguggaagauaccacgcuauauuucugugucaaggaccagcgcgaggacgagugcgaggaaugguggucggacuauuacgauuucgggcgcgagcucccgugcaggaaaucgcgcgggcucgggcucgcgggcaauuucuguaucuguggcgcggacgggaccaugguaacggucucgagc

SEQ ID NO: 55381 - RNA, 432 nt, Artificial Sequence
  derived and/or modified sequence opt11 from anti-HIV_cap256-119-077466_VR-Chain
caagugcaauuggucgagagcgggggcggggucgugcaaccgggcucgcccuugcgcauaagcugugccgugagccaguucacguucucgcgcuauggcaugcacugggucaggcaagcgcccgggaaagggcucgaguggguggccucgaucucguucgauggcagggacaaguaccauagcucgcucgugugggggcguuugaccauaagcagggacaauagcaagagcacgcuauuucuccagaugaauagcuugcgcgcggaagauaccgcgcucuauuacugugcaagggacuugcgagagagcgagugcgaggaaugggaaucggacuauuacgcguucuaucgcaagcucccgugcgugaaaccgcgcggggucgcgggaacgcucgauaucuggggccagggcacgauggugaccgugagcucg

SEQ ID NO: 55382 - RNA, 423 nt, Artificial Sequence
  derived and/or modified sequence opt11 from anti-HIV_cap256-119-076284_VR-Chain
cagguccagcucguggaaucgggcgggggcgugguccagcccgggcgcucgcucaggcucucgugcgcggccucgaacacguacgcaaugcauugggugcgacaggccccgggcaagggcuuggaauggauggcgcucauaagcuaugaagggagcgauaaauauuacguggacucagucaagggcagguucacgaucucgcgcgauaacucgaaaucgaccuuguacuugcaaaugaacucgcucucggccgaggacacggccguguacuuuugcgcgaaagaucucgggggcaauaaagaugacgaguggacgaccgauuacuauuacgauuggucgaaagcgcgcccgguccaggacccgcgcguggucgcgggcacguucgauaucuggggccagggcacgauggugaccgugagcucg

SEQ ID NO: 55383 - RNA, 432 nt, Artificial Sequence
  derived and/or modified sequence opt11 from anti-HIV_cap256-119-074680_VR-Chain
gaagugcaauuggucgagagcgggggagggcucgugcaaccgggcaggagcuugcgauugagcugugccgggagcggguucacguucguggacuaugccaugcacugggucaggcaagugcccgggaaagggcucgagugggugggcucgaucucguacgauggcucggacaaguaccauaccaauagcgugugggggcgcuuuaucgugagcagggacaauagcaagaacacgcuauaucuccagaugaauagcuugcgcccggaagauaccgcgcucuauuacugugucagggacaggcgcgagagcgagugcgaggaaagguggucggacuauuacgauuucgggaaacagcucccgugcgugaaaccgcgcggggucgcgggcauauucgauaucuggggccagggcacgauggugaccgugagcucg

SEQ ID NO: 55384 - RNA, 432 nt, Artificial Sequence
  derived and/or modified sequence opt11 from anti-HIV_cap256-119-074081_VR-Chain
gaagugcaauuggucgagagcgggggcgggcuagugcaaccgggcgggagcuugcgcuugagcugugucgugagcggggucacggucucgagcaauuacaugagcugggucaggcaagcgcccgggaaagggcucgaguggguggccucgaucucguacgauggcucggacaaguaccaugcagaucgcgugugggggcgcuuuaccauaagcagggacaauagcaagaacacgcuauaucuccagaugaauagcuugcgcgcggaagauaccgcgcuauauuacugugucagggacgcgcgcgagagcgagugcgagcuaugggaaucggacuauuacaauuucgggcgcaagcucccgugcgugaaaccgcgcggggucgcgggcacgcucgauaucuggggccagggcacgauggugaccgugagcucg

SEQ ID NO: 55385 - RNA, 432 nt, Artificial Sequence
  derived and/or modified sequence opt11 from anti-HIV_cap256-119-071704_VR-Chain
caaaugcaauuggucgagagcgggggcgggguagugcaaccgggcgggagcuugcgcuugagcugugccgugagccaguucacguucacgagcuauggcaugcacugggucaggcaagcgcccgggaaagggcucgaguggguggccacgaucucgagcgauggcucgaaaaaguaccauggcgauagcgugugggggcgcuugaccauaagcagggacaauagcaagaacacgcucuuucuccagaugaauaacuuacgcgcggaagauaccgcgcucuauuucugugucaaggaccagcgcgaggacgagugcgaggaaugguggucggacuauuacgauuucgggaaaaagcucccgugcaggaaaucgccagggcucgcgggcauauucgaugucuggggccauggcacgauggugaccgugagcccg

SEQ ID NO: 55386 - RNA, 432 nt, Artificial Sequence
  derived and/or modified sequence opt11 from anti-HIV_cap256-119-071266_VR-Chain
caagugcaauuggucgagagcgggggcggggucgugcaaccgggcgagagcuuacgcuugagcugugccgcgagcggguucacguucucgagcuuuggcaugcacugggucaggcaagcgcccgggaaagggcucgagugggugggaucgaucucguacgauggcucggacaaguaccauaccaauagcgugugggggcgauuuaucgugagcagggacaauagcaagaacacgcuauaucuccagaugaauagcuugcgcccggaagauaccgcgcuauauuacugugucagggacaggcgcgagagcgagugcgaggaaagguggucggacuauuacgauuucgggaaacagcucccgugcgugaaaccgcgcggggucgcgggcauauucgauaucuggggccagggcacgauggugaccgugagcucg

SEQ ID NO: 55387 - RNA, 432 nt, Artificial Sequence
  derived and/or modified sequence opt11 from anti-HIV_cap256-119-069667_VR-Chain
gaagugcaauuggucgagagcgggggcgggcuagugcaaccgggcaggagccugcgcuugagcugugccgcgagcggguucucguucaauaccuauggcaugcacugggucaggcaagcgcccgggaaagggcucgaguggguggccuuuaucagguacgauggcucgaacaaguacuaugccgauagcgugaaagggcgcuuuaccauaagcagggacaauagcaagaacacgcucuaucuccagauggauggccugcgcggggaagauaccgcgcucuauuacugugccaaggaccugcgcgagcucgagugcgaggaaugggccucggacuauuacgauuucgggcgcccgcaaccgugcuuagacccacgcggggucucgggcauaagcaaugucuggggccagggcacgauggugacagugagcucg

SEQ ID NO: 55388 - RNA, 432 nt, Artificial Sequence
  derived and/or modified sequence opt11 from anti-HIV_cap256-119-069591_VR-Chain
caagugcaauugguagagagcgggggcggggucgugcaaccgggcaggagccugcgcuugagcugugccgcgagcggguucacguucucgagcuaugccaugcacugggucaggcaagcgcccgggaaagggcuagaguggguggccgggaucucguacgauggcucggacaaguaccaugccgauaaagugugggggcgcuuuaccauaagcagggacaauagcaagaacacgcucuaucuccagaugaauagcuugcgcgcggaagauaccgcgcucuauuacugugccaaggacuugcgcgaggacgagugcgaggaaugguggucggacuauuacgauuucgggaaaaggcucccgugcaggaaaucgcgcggggucgcgggaguguucgauaaauggggccagggcacgauggugaccgugagcucg

SEQ ID NO: 55389 - RNA, 432 nt, Artificial Sequence
  derived and/or modified sequence opt11 from anti-HIV_cap256-119-068691_VR-Chain
caagggcacuuggucgcgagcgggggcggggucgugcccccgggcaggagccugaccuugagcugucucgcgagccaguucacguucucgggcuauggcuuucacugggucaggcaagcgcccgggaaagggcucgaguggguggccucgaucucguucgcgggcacgaaaaagcacuauggcaauagcguaaaagggcgcuuuaccauaagcagggacaauagcaagaacacacucuaucucgagaugaauagcuugcgcccggaagauaccgcgcucuauuacugugccaaggacaggcgcgaguacgagugcgaggaauggaccucggacuauuacgauuucgggcgcccgcaaccgugcauagacucgcgcggggucgugggcauucucgauaucuggggcaggggcacgauggugaccgugagcucg

SEQ ID NO: 55390 - RNA, 432 nt, Artificial Sequence
  derived and/or modified sequence opt11 from anti-HIV_cap256-119-068488_VR-Chain
caaaugcaauuggucgagagcgggggcggggucgugcaaccgggcaugagcuugacauugagcugugccgcgagccaguucacguucucgaacuauggcaugcacugggucaggcaagcgccagggaaagggcucgaguggguggccucgaucucgaacgauggcucgaaaaaguaccauggcgauagcgugaaagggcgcuuuaccauaagcagggacaauagcaagaacacgcucuaucuccagauggauggcuugcgcggggaagauaccgcgcuauauuacugugccaaggacuugcgcgagcucgagugcgaggaaugggccucagacuauuacgauuucgggagaccgcaaccgugcuuggacccgcgcggggucucgggcauaagcaaugucuggggccagggcacgauggugaccgugagcucg

SEQ ID NO: 55391 - RNA, 432 nt, Artificial Sequence
  derived and/or modified sequence opt11 from anti-HIV_cap256-119-067536_VR-Chain
caagugcaauuggucgagagcgggggcggggucgugcaaccgggcaggagcuugcgcauaagcugugccucgagccaguucacguucucgcgcuauggcaugcacugggucaggcaagcgcccgggaaagggcucgaguggguggcaucgaucucguacgauggcagggacuaucaccaugcaggggccgugugggggcgcuuuaucauaagcagagacaauagcaagaacucgcuccaucuacagaugaauagcuugcgaccggaagauacagcgcucuauuucugugccagggacuugcgagagagcgagugcgaggaaugggaaucggacuauuacgcguucuaucgcaagcucccgugcgugaaaccgcgcggggucgcgggaacacucgauaucuggggccagggcacgauggugaccgugagcucg

SEQ ID NO: 55392 - RNA, 432 nt, Artificial Sequence
  derived and/or modified sequence opt11 from anti-HIV_cap256-119-065852_VR-Chain
caagugcacuuggucgagagcgggggcggggccgugcccucgggcaggagcuugcgcuugagcugugucgcgagcggguucacguucggggucuaugacauacacugggucaggcaagcgccagggaaagggcucgaguggguggccucgaucucguacgauggcagggacaaguaccauagcucgcucgugugggggcgcuugaccauaagcagggacaauagcaagagcacgcucuuucuccagaugaauagcuugagagcggaagauaccgcgcucuauuacugugccagggacuugcgcgagagcgagugcgaggaauggcaaucggacuauuacgcguucuauaaaaagcucccgugcgugaaaccgcgcggggucgcgggaacgcucgauaucuggggacagggcacgauggugaccgugagcucg

SEQ ID NO: 55393 - RNA, 432 nt, Artificial Sequence
  derived and/or modified sequence opt11 from anti-HIV_cap256-119-065457_VR-Chain
cucgggcgcuuggucgcgagcgggggcggggucgugcccccgggcaggagcccgcgcuugagcugugucgcgagccaguucacguucucgggcuguggcuugcacugggucaggcaagcgcccgggaaagggcucgaguggguggccgcgaucucguucgauggcacggacaaguaccauagcgaugacgugugggggcgcuuuaccauaagcagggacaauagcaagaacacgcucuaucuccagaugaauagcuugcgcccggaagauacagcgcucuauuacugugccaaggacuugcaagaggacgagugcgaggaaugguggucggacuauuacgauuucgggaaacagcucccgugcaggaaaucgcgcggggucgcgggcauauucgaugacuggggccagggcacgauggugaccgugagcucg

SEQ ID NO: 55394 - RNA, 432 nt, Artificial Sequence
  derived and/or modified sequence opt11 from anti-HIV_cap256-119-064501_VR-Chain
caagugcaauuggucgagagcgggggcggggucgugcaaccgggcaggagccugcgcuugagcugugccgcgagcggguucacguucucgaguuaugccaugcacugggucaggcaagcgcccgggaaagggcuagaguggguggccgggaucucguacgauggcagggacaaguaccaugcacauagcgugugggggcgcuugagcauaagcagggacaauagcaagaacacgcucuaucuccagaugaauagcuugcgcacggaagauaccgcgcucuaucacugugucagggacuugcgcgagagcgagugcgagcucugggaaucggacuauuacgauuucgggaaaaagcucccgugcgugaaaccgcgaggggucgcgggcacguucgaucucuggggccagggcacgauggugaccgugagcucg

SEQ ID NO: 55395 - RNA, 432 nt, Artificial Sequence
  derived and/or modified sequence opt11 from anti-HIV_cap256-119-063568_VR-Chain
caagugcaaccggucgagagcgggggcggggucguguggccgggcaggagcuugcgcuugagcuguaccacgagcggguucacguucucgaacuaugccauacacugggucaggcaagcacccgggaaagggcuccaguggguggccgugaucucguacgauggcucgaacaaguucuaugccgauagcgugaaagggcgcuuuaccauaagcagggacaauagcaagaacacgcucuaccuccagaugaauagcuugcgaccggaagauaccgcgcucuauuacugugccaaggacuugcgcgaggacgagugcgaggaaagguggucggacuauuacgauuucgggaaacagcucccgugcaggaaaucgcgcggggucgcgggcguguucgauaacuggggccagggcacgauggugaccgugagcucg

SEQ ID NO: 55396 - RNA, 435 nt, Artificial Sequence
  derived and/or modified sequence opt11 from anti-HIV_cap256-119-063103_VR-Chain
caagugcaauuggucgagagcgggggcggacucgugcaaccgggcaagagcuuacgcuugagcugugccgcgagcggguucacguucucgaccuauggcaugcacugggucaggcaagcgcccgggaaagggcuagaguggguggccuugaucucguacgauggcucguacacguacuaugccgauagcgugaaagggcgcuucaccauaagcagggacaauagcaagagcacgcucgaucuccagcucaauacccugcgcccggaagauaccgcgcucuauuacugugccagggacuugcgcgagauggagugcgaggaauggaaacuguacaauuacuaugacuuucgcacgcgcgggcccugugucgaucccaggggcguggucgggagcuuugacgugugggggcaagggaccguggucacggucucgagc

SEQ ID NO: 55397 - RNA, 432 nt, Artificial Sequence
  derived and/or modified sequence opt11 from anti-HIV_cap256-119-061027_VR-Chain
caagugcaacuggucgagagcgggggcggggucgugcaaccgggcaggagcuugcgcuugagcuguagcgcgagcggguucacgcucucgagcuauggcauacacugggucagacaagcgcccgggaaagggcucgaguggguggccgugaugucgaacgauggaucgaaccaguucuauggcgauagcgugaaagggcgauuuaccauaagcagggacauaagcaagaacacgcucuaucuccagaugaauagcuugcgcccggaagauaccgcgauguauuacugugccagggaccagcgauauuacgagugcgaggaaugggccucagacuauuacgauuucgggcgcgagcaaccgugccaggacccgcgcggggucgugggcguguucgauauguggggccagggcacgauggugaccgugagcucg

SEQ ID NO: 55398 - RNA, 432 nt, Artificial Sequence
  derived and/or modified sequence opt11 from anti-HIV_cap256-119-058232_VR-Chain
caagugcaauuggucgagagcgggggcggggucgugcaaccgggcaagagcuugcgcuugagcuguaaagcgagccaguucacguucaaucgcuauggcaugcacugggucaggcaagcgcccgggaaagggcuagaguggguggccgcgaucucguucgauggcacggacaaguaccaugccgauaaagugugggggcgcuuuaccauaagcagggacgauagcaagagcacgcucuaucuccagaugaauagcuugcgcgcggaagauaccgcgcucuauuacugugccaaggacuugagagaggacgagugcgaggaaugguggucggacuauuacgauuucgggaaacagcucccgugcaggaaaucgcgcggggucgcgggcauauucgauggauggggccagggcacgauggugacagugagcucg

SEQ ID NO: 55399 - RNA, 432 nt, Artificial Sequence
  derived and/or modified sequence opt11 from anti-HIV_cap256-119-057341_VR-Chain
caagugcaauuggucgagagcgggggaggggucgugcaaccgggcaggagcuugcgcuugagcugugccgcgagccauuucucgcucucgagcuauggcaugcacugggucaggcaagcgcccgggaaagggcucgaguggguggccggggaaucguucgcggccacgaacaaguacuaugccgauagcgugaaagggcgcuuuaucgugagcagggacauaagcaagaacacgcucuaucucgaggucaauagcuugcgcgcggaagauaccgcgcucuauuacugugccagggaccagcgauauuacgagugcgaggaaugggccucggacuauuacgauuucgggcgcgagcaaccgugccaggacccgcgcggggucgcgggcauauucgauaucuggggccagggcacgauggugaccgugagcucg

SEQ ID NO: 55400 - RNA, 438 nt, Artificial Sequence
  derived and/or modified sequence opt11 from anti-HIV_cap256-119-056895_VR-Chain
caaaugcaacuggucgagagcggaggcggggucgugcaaccgggcagaagccugcgauugagcugugccgcgagccaguucacguucgggagcuauggcaugcacugggucaggcaaauacccgggaaagggcuagaguggguggccacgaucucguacgauggcacgaaaaaguaccaugccgauagcgugugggaucgcuuuaucauaagcagagacaauagcaagaacacgcucuuucuacagaugaauagcuugcgcccggaagauaccgcgcucuauuucugugucaaggaccagcgacaggacgagugcgaggaaugguggucggacuauuacgauuucgggcgcgagcucccgugcaggaaaucgcgcgggcucgggcucgcgggcauauucgauauguggggccauggcacgauggugaccgugagcucg

SEQ ID NO: 55401 - RNA, 432 nt, Artificial Sequence
  derived and/or modified sequence opt11 from anti-HIV_cap256-119-056402_VR-Chain
caagugaaauuggucgagagcgggggcggggucgugcaaccgggcaagagcuugcgacugagcuguaccgcgagccaguucacguucucgaacuuuggcaugcacugggucaggcaagcgcccgggaaagggcucgaguggguggccucgauaucguucgugggcaucaaaaagcacuaugccaauagugugcgcgggcgcuuuaccauaagcagggaccagagcaagaacacgcucuaucuccagaugaauagcgugcgcguggaagauaccgcgcgcuauuucugugccagggacaugcgcgaguacgagugcgagcucugggccucggacuauuacgauuucgggaaaccgcaaccgugcgaggacccgcgcggggucgugggcacguucgauauguggggauugggcacgcucgugaccgugagcucg

SEQ ID NO: 55402 - RNA, 432 nt, Artificial Sequence
  derived and/or modified sequence opt11 from anti-HIV_cap256-119-056034_VR-Chain
caagugcaacuggucgagagcgggggcggggucguacaaccgggaaggagcuugcgcuugagcugugccgcgagcggguucacguucucgagcuaugccaugcacugggucaggcaagcgcccgggaaaggacucgaguggguggccgcgaucucauucgcgggcacgaaaacgcacuaugccgauagcgugaaagggcgauuuaccauaagcagggacaauagcaagaacgcgcucuaucuccagaugaauaacuugcgcgcggaagauaccgcgcucuauuacugcgccaaggacuugcgcgaggacgagugcgaggaaagguggucggacuauuacgauuucgggaaacagcucccgugcaggaaaucgagaggagucgcgggcguguucgauaacuggggccagggcacgauggugaccgugagcucg

SEQ ID NO: 55403 - RNA, 432 nt, Artificial Sequence
  derived and/or modified sequence opt11 from anti-HIV_cap256-119-055042_VR-Chain
caagugcaauuggucgagagcgggggcggggucgcgcaaccgggaaggagcuugcgauugagcugugccgcgagcggguucacguucaggagcuauggcaugcacugggucaggcaagcgcccgggaaagggcucgaguggguggccgugaucucgcuagauggcucgaacaaguacuaugccgauagcgugaaagggcgcuuuagcauaagcagggacaauagcaagaacacgcucuaucuccagaugaauagcuugcgcccggaagauaccgcggucuacuacugcgccaaggacuugcgcgaggacgagugcgaggaaagguggucggacuauuacgauuucgggaaacagcucccgugcaggaaaucacgcggggucgcgggcguguucgauaacuggggccagggcacgauggugaccgugagcucg

SEQ ID NO: 55404 - RNA, 438 nt, Artificial Sequence
  derived and/or modified sequence opt11 from anti-HIV_cap256-119-054776_VR-Chain
caagugcaauugauggagagcgggggcggggucgugcaaccgggcaggagcuugcgauugagcuguaccgcgagcggguucacguucucgagcuauagcaugcacugggucaggcaagcgcccgggaaagggcucgaguggguggccauaaucucguacgaugaaucgaacaaguacuaugccgauagcgugcaagggcgcuuuaccauaagcagggacaauagcaagaacacgcucuuucuccagaugucgaguuugcgcgcggaagauaccgcgcucuauuucuguguaagggaccaucgagaggacgagugcgaggaaugguggucggacuauuacgauuucgggcgcgagcucccgugcaggaaauuucgcgggcucgggcucgcgggcauauucgauaucuggggccauggcacgauggugaccgugagcucg

SEQ ID NO: 55405 - RNA, 432 nt, Artificial Sequence
  derived and/or modified sequence opt11 from anti-HIV_cap256-119-054539_VR-Chain
caaaugcaacuggucgagagcgggggcggggucgugcaaccaggcgggagcuugcgccugagcugugccgcgagccaguucacguucgggagcuaugccaugcacugggucaggcaaccgcccggggaaaggcccgaguggguggccacgaucucguucgauggcacgaaaaaguaccaugccgauagcgugugggggcgcuuuaccauaagcagggacaauagcaagaacacgcucuuucuccagaugaauagcuugcgcccggaagauaccgcgcucuauuucugugucaaggaccagcgcgaggacgcgugcgaggaaugguggucggacuauuacgacuucgggaaaaauugccuggccgagagcccgggcgcguggcuggaauuuuucuaugucuggggccauggcacgauggugaccgugagcucg

SEQ ID NO: 55406 - RNA, 432 nt, Artificial Sequence
  derived and/or modified sequence opt11 from anti-HIV_cap256-119-054112_VR-Chain
caagugcaauuggucgagagcgggggcggggucgugcaagcgggcaggagccugcgcuugagcugugccgcgagcggguucacguucucgaccuaugccaugcacugggucaggcaagcgcccgggaaagggcucgaguggguggccgugaucucguacgauggcucgaacaaguacuaugccgauagcgugcgcgggcgcuuuaccauaagcagggacaauagcaagaacacgcucuaucuccagaugaauagucugcgcgcggaagauaccgcacucuauuacugugccaaggacaugagagaguacgagugcgaggaauggaccucggacuauuacgauuucgggcgcccgcaaccgugcauagacucgcgcggggucgugggcacguuccaugucuggggccagggaacgauggugaccgugagcucg

SEQ ID NO: 55407 - RNA, 432 nt, Artificial Sequence
  derived and/or modified sequence opt11 from anti-HIV_cap256-119-053339_VR-Chain
caaguacacuugguagagagcgggggcggggucgugcaaccgggcaggagcuugcgccugagcugugccgcgagccauuucucgcucucaagcuauggcaugcacugggucaggcaagcgcccgggaaagggcucgagugggugaccgggaucucguucgcgggaacgaaaacguacuauggcgauagcgugcgcgggcgcuuuaccgugagcagggacauaagcaagaacacgcucuugcuccagaugaauagccugcgcccggacgauaccgcgaucuauuacugugcaagggaccaacgcuauuacgagugcgaggaaugggccucggacuauuacgauuucgggaaagagcaaccgugccuggacccgcgcggggucgugggcauauucgaucucuggggacagggcacgauggugaccgugagcucg

SEQ ID NO: 55408 - RNA, 432 nt, Artificial Sequence
  derived and/or modified sequence opt11 from anti-HIV_cap256-119-052404_VR-Chain
caaaugcaauuggucgagagcgggggcggggucgugcaaccgggcaggagcuugaccuugagcuguaucgcgagccaguucaauuucgcgagcuauggcaugcacugggucaggcaagcgcccgggaaagggcucgaguggguggccucgaucucgcacgauggcacgaaaaaguaccaugccgagagcgugugggggcgcuuuaccauaagcaaggacaauagcaagaacacgcuauuucuccagaugaauagccugcgaguggaagauaccgcgcucuauuucugugucaaggaccagcgcgaggacgagugcgaggaaugguggucggacuauuacgauuucgggaaacagcucccgugcaggaaaucgcgcggggucgcgggcguguucgauaacuggggacagggcacgauggugaccgugagcucg

SEQ ID NO: 55409 - RNA, 432 nt, Artificial Sequence
  derived and/or modified sequence opt11 from anti-HIV_cap256-119-051123_VR-Chain
caagugcaauuggucgagagcgggggcgggguagugcaaccgggcgggagcuugcgauugagcugugucgggagccaguucauacucuaucgcuauggcaugcacugggucagacaagcgcccgggaaagggcucgaguggguggccgcggucucauucgauggaacggacaaguaccaugccgaugacgugugggggcgcuuuaccauaagcagggacaauagcaagaacauacuauaucuccagaugaauagcuugcgcgcggaagauacagcgcucuauuacugugcaaaggacuugcgcgaggacgagugcgaggaaugguggucggacuauuacgaucucgggaaacagcucccgugcaggaagucgcgcggggucgcgggcguguucgauaaauggggauugggcacgauggugaccgugagcucg

SEQ ID NO: 55410 - RNA, 438 nt, Artificial Sequence
  derived and/or modified sequence opt11 from anti-HIV_cap256-119-051077_VR-Chain
gaagugcaauuggucgagagcgggggcggggucgugcaaucgggcaggagcuugcgcuugagcugugccgcgagccauuucacguucucgcgauauggaaugcacugggucaggcaagcgcccgggaaagggcucgaguggguggccucgaucucguacgauggcagggacuuuuaccacgccaggagcgugugggggcgcuuuacuauaagcagggacaauagcaagaacacgcuauuucuccagaugaauagcuugcgcauagaagauaccgcgcucuauuucugugucaaggaccagcgagaggacgagugcgaggaaugguggucggacuauuacgauuucgggagagagcuaccgugcaggaaaucgcgcgggcuagggcucgcgggcauauucgauauguggggacauggcacgauggugacagugagcucg

SEQ ID NO: 55411 - RNA, 432 nt, Artificial Sequence
  derived and/or modified sequence opt11 from anti-HIV_cap256-119-050442_VR-Chain
caagcgcaaauggucgagagcgggggcggggucgugcaaccgggcaggagcuugcgcuugagcugugccgcgagcggguucucguucucguacuuugccaugcacugggucaggcaagcgcccgggaaagggcucgaguggguggccgggaucucguucgcggccacgaaaacguacuauggcgggagcgugaaagggcgauuuaccgugagcagggacauaagcaagaacacgcuauaucuacagaugaauagccugcgcccggaagauaccgcgauguauuacugugccagagaccagcgcuauuacgagugcgaggaaugggccucggacuauuacgauuucgggcgcgagcaaccgugccaggacccgcgcggggucgugggcguguucgauauguggggccagggcacgauggugaccguaagcucg

SEQ ID NO: 55412 - RNA, 432 nt, Artificial Sequence
  derived and/or modified sequence opt11 from anti-HIV_cap256-119-049433_VR-Chain
caagugcaauuggucgagagcgggggcggggucgugcaaccgggcaggagcuugcgcgugagcugucgagcgagcggguucgcguucucgagcuaugccaugcacugggucaggcaagcgccagugaaagggcucgaguggguggccuugaccucgagcgauggcgcggacaaguaccaugccgaugacgugugggggcgcuuuaccauaagcagggacaauagcaagaacacgcucuaucuacagaugaauagcuugcgcccggaagauaccgcgcucuauuacugugccaaggacuugcgcgaggacgagugcgaggaaagguggucggacuauuacgauuucgggaaacagcucccgugcaggaaaucgcgcggggucgcgggcguguucgacaacuggggccagggcacgauggugaccgugagcucg

SEQ ID NO: 55413 - RNA, 432 nt, Artificial Sequence
  derived and/or modified sequence opt11 from anti-HIV_cap256-119-047532_VR-Chain
cucgggcgccuggucgcgagcgggggcggggucgugcccccgggcaggagcuugaccuugagcugugucgcaagccaguucacguucucgggcuguggcuugcacugggucaggcaagcgcccgggaaagggcucgaguggguggccucgaucucguucgcgggcacgaaaaagcacuauaccaauagcgugcgcgggcgcuuuaccauaagcagggacaauagcaagaacacggucuaucuccagaugaauagcuugcgcgcggaagauaccgcgcucuauuacugugccaaggacaugggcgaguacgagugcgaggaauggaccucggacuauuacgauuucgggcgcccgcaaccgugcauagacucgcgcggggucgugggcauacucgauaucuggggccagggcacgauggugaccgugagcucg

SEQ ID NO: 55414 - RNA, 432 nt, Artificial Sequence
  derived and/or modified sequence opt11 from anti-HIV_cap256-119-047489_VR-Chain
caagugcacuuggucgagagcgggggcggggucgugcaaccgggcaagagcuugcgcuugagcugugccgcgagccaguucacguucaaucgcuuuggaaugcacugggucaggcaagcgcccgggaaagggcucgaguggguggccgggaucucguacgauggcucggacaaguaccaugccgauaaagugugggggcgcuuuaccauaagcagggacaauagcaagaacacgcucuaucuccagaugaauagcuugcgcgcggaagauaccgcgcucuauuacugugccaaggacuugcgcgaggacgagugcgaggaaugguggucggacuauuacgauuucgggaaaaggcucccgugcaggaaaucgcgaggggucgcgggcguguucgauaaauggggacagggcacgauggugaccgugagcucg

SEQ ID NO: 55415 - RNA, 438 nt, Artificial Sequence
  derived and/or modified sequence opt11 from anti-HIV_cap256-119-046020_VR-Chain
gaagugcaauugcuccagagcgggggcgggcucgugcaaccgggcgggagccugcgcuugagcugugccgcgagcggguucucguucucgagcuaugccaugagcuggaucaggcaagcgcccgggaaagggcucgaguggguggccucgaucucgcacgauggcacgaaaaaguaccaugccgagagcgugugggggcgcuuuaccauaagcaaggacaauagcaagaacacgcucuuucuccagaugaauagccugcgcguggaagauaccgcgcucuauuucugugucaaggaccagcgcgaggacgagugcgaggaaugguggucggacuacuacgauuucgggcgagagcucccgugcaggaaaucgcgcgggcucgggcucgcgggaauauucgauauguggggacauggcacgauggugaccgugagcucg

SEQ ID NO: 55416 - RNA, 432 nt, Artificial Sequence
  derived and/or modified sequence opt11 from anti-HIV_cap256-119-044746_VR-Chain
caagugcaacuggucgagagcgggggcggggucgugcaaccgggcaggagccugcgcuugagcugugccgcgagcggguucacguucucgagcuaugccaugcacugggucaggcaagcgccagggaaagggcucgaguggguggccgugaucucauacgauggcucgaacaaguacuaugccgauagcgugaaagggcgcuuuaccauaagcagggacaauagcaagaacacggucuaucuagagaugaauagcuugcgcgcggaagauaccgcgcucuauuacugugccaaggacuugcgcgaguacgagugcgaggaauggaccucggacuauuacgauuucgggcgcccgcaaccgugcauagacucgcgcggggucgugggcauacucgauaucuggggccagggcacgauggugaccgugagcucg

SEQ ID NO: 55417 - RNA, 432 nt, Artificial Sequence
  derived and/or modified sequence opt11 from anti-HIV_cap256-119-044740_VR-Chain
caaaugcacuuggucgagagcgggggcggggucgugcaaccgggcaugagcuugcgcuugagcugugccgcgagccaguucaauuucgggagcuuuggcaugcacugggucaggcaagcgcccgggaaagggcucgaguggguggccacgaucucguacgauggcacgaaaaaguaccauagcgauagcgugugggggcgcuugagcauaagcagggacaauagcaagaacacgcucuuucuccagaugaauagcuugcgcacggaagauaccgcgcucuauuucugugucagggaccagcgcgaggacgauugcgaggaaugguggucggacuauuacgauuucgggaaaaagcucccgugcaggaaaucgcgcgggcucgcgggcauauucgauaucuggggccauggcacgauggugaccgugagcucg

SEQ ID NO: 55418 - RNA, 432 nt, Artificial Sequence
  derived and/or modified sequence opt11 from anti-HIV_cap256-119-043790_VR-Chain
cucuugcaauuggucgagagcgggggcggggucgugcaaccgggcaauagcuugcgcuugagcugugccgcggccggguucacguucucggacuauagcuugcacugggucaggcaagcgcccgggaaagggcucgaguggguggccaugaucucggacgauggcaaucucgauuucuaugccgcgagcgugaaaggacgcuuuaccauaagcagagacaauagcauaaacacggucuaucuccagaugaauagcuugcgcgcggaagauaccgcgcuauauuacugugccaaggacuugcgcgaguacgagugcgaggaauggaccucggacuauuacgauuucgggcgcccgcaaccgugcauagacucgcgcggggucgugggcauacucgauaucuggagccagggcacgauggugaccgugagcucg

SEQ ID NO: 55419 - RNA, 432 nt, Artificial Sequence
  derived and/or modified sequence opt11 from anti-HIV_cap256-119-042880_VR-Chain
gaagugcgcuuggucgagagcgggggcgggcucgugcaaccgggcgggagcuuacgcuugagcugugccgcgagcggguucacgcucucggacuauuacaugagcuggaucaggcaagcgcccgggaaagggcucgaguggguggccgcgaucucguucgcgggcacgaaaaagcacuauggcaauagcgugaaagggcgcuuuaccauaagcagggacaauagcaagaacacgcucuaucucgagaugaauagcuugcgcguggaagauaccgcgcucuauuacugugccaaggaccugcgcgaguacgagugcgaggaauggaccucagacuauuacgauuucgggcgaccgcaaccgugcauagacucacgcggggucgugggcauacuagauaucuggggccagggcacgauggugaccgugagcucg

SEQ ID NO: 55420 - RNA, 432 nt, Artificial Sequence
  derived and/or modified sequence opt11 from anti-HIV_cap256-119-042606_VR-Chain
caaaugcaauuggucgagagcgggggcggggucgugcaaccgggcaggagcuuacgauugagcugugccgcgagccaguucacguucgggagcuauggcaugcacugggucaggcaaauacccgggaaagggcucgagugggugaccgggaucucguucgcggccacgaaaacguacuauggcgauagcgugcgcgggcgcuuuaccgugagcagggacauaagcaagaacacgcucuaucuccagaugaauagcuugcgaccggaagauaccgcgauguacuacugugccagggaccagcgcuauuacgagugcgaggaaugggccucggacuauuacgauuucgggcgcgagcaaccgugccaggacccgcgaggggucgugggcauacucgaucucuggggccagggcacgauggugaccgugagcucg

SEQ ID NO: 55421 - RNA, 432 nt, Artificial Sequence
  derived and/or modified sequence opt11 from anti-HIV_cap256-119-042444_VR-Chain
caaguacaauuggucgagagcgggggcgaugucgugcacccgggcgggagcuugcgcuugagcugugccgcgagcggguucacguucucgagcuauggcauacacugggucaggcaagcgcccgggaaagggcucgaguggguggccgcgaucucguacgauggaucggacaaguaccauaccaauagugugugggggcgcuuuaccgugagcagggacaauagcaagaacacgguauaucuccagaugaauagcuugcgcgcggaagauaccgcgcucuauuucugugucagggacagacgcgagagcgagugcgaacucugggaaucggacuauuacgauuucgggaaaaggcucccgugcgugaaaccgcgaggggucgcgggcguguucgauaucuggggacagggcacgauggugaccgugagcucg

SEQ ID NO: 55422 - RNA, 432 nt, Artificial Sequence
  derived and/or modified sequence opt11 from anti-HIV_cap256-119-040328_VR-Chain
caagugcaauuggucgagagcgggggcggggucgugcaaccgggcgggagcuugcgcuugagcugugccgcgagcggguucacguucucgagcuauagcaugaacugggucaggcaagcgcccgggaaagggcucgaguggguggccucgaucucguucgcgggcacgaaacagcacuauggcaauagcgugaaagggcgcuuuaccauaagcagggacaauagcaagaacacggucuaucuccagaugaauagcuuacgcuuggaagauaccgcgcucuauuacugugccaaggacuugcgagaguacgagugcgaggaauggacaucggacuauuacgauuucgggcgcccgcaaccgugcauagacucgcgaggggucgugggcauacucgauaucuggggccagggaacgauggugaccgugagcucg

SEQ ID NO: 55423 - RNA, 432 nt, Artificial Sequence
  derived and/or modified sequence opt11 from anti-HIV_cap256-119-040164_VR-Chain
caaaugcacuuggucgagagcgggggcggggucgugcaaccgggcaugagccugcgcuugagcugugccgcgagccaguucaauuucgggagcuuuggcaugcacugggucagacaagcgcccgggaaaggacuagaguggguggccacgaucucguacgauggcacgaaaaaguaccauagcgauagcgugugggggcgcuuuagcauaagcagggacaacagcaagaacacgcucuaucuccagaugaauagcuuacgcacggaagauaccgcgcucuauuucugugccaaggacuugcgcgaguacgagugcgaggaauggaccucggacuauuacgauuucgggcgcccgcaaccgugcauagacucgcgcggggucgugggcauacucgauaucuggggccagggcacgauggugaccgugagcucg

SEQ ID NO: 55424 - RNA, 432 nt, Artificial Sequence
  derived and/or modified sequence opt11 from anti-HIV_cap256-119-039130_VR-Chain
gaggaacaauuggucgagagcgggggcgggcucgugcaaccgggaaggagcuugcgauugagcuguaccgggagcggguucagguucggggacuaugccaugaacugggucaggcaagcgcccgggaaagggcucgagugggugaccuuuaucucguacgauggcucgaacaagcacuaugcagauagcgugaaagggcgauuuaccgugagcagggacaauagcaagaacacgcuccaucuccagaugaauagcuugcgcccggaagauaccgcgcucuauuucugugcaagggacuugcgcgagagcgagugcgaggaaugggaaucguacuauuacgauuucgggaaaaagggcccgugcgugaaaccgcgcggggucguaggcgugcucgauauauggggccagggcacgcucgugaccgugagcucg

SEQ ID NO: 55425 - RNA, 432 nt, Artificial Sequence
  derived and/or modified sequence opt11 from anti-HIV_cap256-119-038138_VR-Chain
caagugcaauuggucgagagcgggggcgggguagugcaaacgggcaggagcuugcgauugagcuguaccgggagccaguucacauucgggcgcuauggcauguacugggucaggcaagcgcccgggaaagggcucgaauggguggccucgaucucguacgauggcagggacuuuuaccaugccaggagcgugugggggcgcuuuaccauaagcagggacaauagcaagaacacgcuacaucuccagaugaauagcuugcgcccggaagauaccgcgcuauauuucugugccagggacuugcgagagagcgagugcgaggaaugggaaucguacuauuacgauuucgggaaaaagggcccgugcgugaaaccgcgcggggucgugggcgugcucgauaucuggggccagggcacgcucgugaccgugaguucg

SEQ ID NO: 55426 - RNA, 432 nt, Artificial Sequence
  derived and/or modified sequence opt11 from anti-HIV_cap256-119-037868_VR-Chain
caagugcaauuggucgagagcgggggcggggucgugcaaccgggcaggagcuugcgauugagcugugccgcgagccaguucacguucucgaaauauggcaugcacugggucaggcaagcgcccgggaaagggcuccaguggguggccgggaucucauacgauggcucggacaaguaccaugcccauuucgugugggggcgcuuuagcauaagcagggacaauagcaagaacgcgcucuaucuccagaugaauagcuugcgaacagaagauaccgcgcucuauuucugugucagggacuugcgcgagagcgagugcgaggaauggaaaucggacuauuacgauuucgggcgcaagggcccgugcuugaaaccgcgcggggucgcgggcucguucgauaucuggggccagggcacggucgugaccgugagcucg

SEQ ID NO: 55427 - RNA, 432 nt, Artificial Sequence
  derived and/or modified sequence opt11 from anti-HIV_cap256-119-037102_VR-Chain
caagugaaauuggucgagagcgggggaggggucgugcaaccgggcaagagcuugcgcuugagcuguaccgcgagccaguucacguucucaaacuuuggcaugcacuggguaagacaagcgcccgggaaaggacucgaguggguggccucgauaucguucgugggcaucaaaaagcacuaugccaauuucgugcgcgggcgcuuuaccauaagcagggaccagagcaagaacacgcucuaucuacagaugaauagcgugcgcguggaagauaccgcgcgcuauuacugugccagagacaugcgcgaguacgagugcgagcucugggccucggacuauuacgauuucgggaaaccgcaaccgugcgaggacccgcgcggggucgugggcacguucgauauguggggcuugggcacgcuagugaccgugagcucg

SEQ ID NO: 55428 - RNA, 438 nt, Artificial Sequence
  derived and/or modified sequence opt11 from anti-HIV_cap256-119-036683_VR-Chain
ggcgugcaauuggucgagagcgggggcgcggucguacgcccgggcgggagccugaccuugagcugugccgcgagccaguucauacucucgagcuauggaaugcacugggucaggcaagcgccagggaaagggcucgaguggguggccucgaucucgaacgauggcacgaaaaaguaccaugccgagagcgugugggaucgauuuagcauaagcaaggacaauagcaagaacacacucuuucuccagaugaauagccugcgcguggaagauaccgcgcucuauuucugugucaaggaccagcgcgaggacgagugcgaggaaugguggucggacuauuacgauuucgggcgcgagcucccgugcaggaaaucgcgagggcucgggcucgcgggcauauucgauauguggggccauggcacgauggugaccgugagcucg

SEQ ID NO: 55429 - RNA, 432 nt, Artificial Sequence
  derived and/or modified sequence opt11 from anti-HIV_cap256-119-036495_VR-Chain
caagugcaauuggucgagagcgggggcggggucgugcaaccgggcaggagcuugcgccugagcugugccgcgagcggguucucguucucgagcuauggcaugcacugggucaggcaagcgcccgggaaagggcucgaguggguggccucgaucucguucgugggcauaaaaacgcacuaugccaauagcgugcgcgggcgcuuuaccauaagcagggaccagagcaagaacacgcuauaucuccagaugaauagcgugcgcauagaagauaccgcgcgcuauuucugugccagggacaugcgcgaguacgagugcgagcucugggccucggacuauuacgauuucgggaaaccgcaaccgugcgaggacccgcgcggggucgugggcacguucgauauguggggcuugggcacgcuagugaccgugagcucg

SEQ ID NO: 55430 - RNA, 438 nt, Artificial Sequence
  derived and/or modified sequence opt11 from anti-HIV_cap256-119-035375_VR-Chain
gaagugcaauuggucgagagcgggggcgggcucgugcaaccgggcaggagcuugcgcuugagcugugccgcgaguggguucacacucgaggacuauggcaugcacugggucaggcaagcgcccgggaaagggcucgaguggguggccucgaucucgaacgauggcacgaaaaaguaccaugccgagagcgugugggaucgcuuuagcauaagcaaggacaauagcaagaacacgcucuuucuccagaugaauagcuugcgcguggaagauaccgcacuauauuucugugucaaggaccagcgcgaggacgagugcgaggaaugguggucagacuauuacgauuucgggcgcgagcucccgugcaggaaaucgcgcgggcucgggcucgcgggcauauucgauauguggggccauggcacgauggugaccgugagcucg

SEQ ID NO: 55431 - RNA, 438 nt, Artificial Sequence
  derived and/or modified sequence opt11 from anti-HIV_cap256-119-035165_VR-Chain
caagugcacuuggucgagagcgggggcggggucgggcaaccggccaggagcuugcgcuugagcugugccgcgagcggguucauacucucgagcuauggcuugcacugggucaggcaagcgcccgggaaagggcucgaguggguggccuugaucucguacgauggaaauaacgaguacuaugccgagagcgugugggggcgcuuuaccauaagcaaggacaauagcaagaacacgcucuuucuccagaugaauagcuugcgcguggaagauaccgcgcucuacuucugugucaaggaccagcgcgaggacgagugcgaggaaugguggucggacuauuacgauuucgggcgcgagcucccgugcaggaaaucgcgcgggcucgggcucgcgggcauauucgauauguggggccauggcacgauggugaccgugagcucg

SEQ ID NO: 55432 - RNA, 432 nt, Artificial Sequence
  derived and/or modified sequence opt11 from anti-HIV_cap256-119-035109_VR-Chain
caagugcaauuggucgagagcgggggcgggguagugcaaccgggcaggagcuugcgcuugagcugugccacggccggguucacguucucgagcuaugcaaugcacuggguaaggcaagcgcccgggaaagggcucgaguggguggccucgauaucguacgauggcucggacaaguaccaugccgaucucgugugggggcgcuuuaccauaagcagggacaauagcaagaacacgcucuaucuccagaugaauagcuugcgcgcggaagauaccgcgcucuauuacugugucagggacgcgcgcgagagcgagugcgagcucugggaaucggacuauuacaauuucgggcgaaagcucccgugcgugaaaccgcgcggggucgcgggcacgcucgauaucuggggccagggcacgauggugaccgugagcucg

SEQ ID NO: 55433 - RNA, 339 nt, Artificial Sequence
  derived and/or modified sequence opt11 from anti-HIV_cap256-119-033789_VR-Chain
caagucuaccucgucgaauccggcggcggagucguccaacccggccgcucccuccgccucuccugcgccgccucccacuucucccucuccuccuacggcaugcacuggguccgccaagcccccgacaucuccaaaaacacccucuaccuccaagucaacucccuccgccccgaagacacagccauguacuacugcgcccgagaccaacgcuacuacgaaugcgaagaaugggccucagacuacuacgacuucggcaaagaacaacccugccucgacccccgcggcgucgucggcaucuucgacaucuggggccaaggaaccauggucacagucuccucc

SEQ ID NO: 55434 - RNA, 432 nt, Artificial Sequence
  derived and/or modified sequence opt11 from anti-HIV_cap256-119-033641_VR-Chain
caagugcaauuggucgagagcgggggcggggucgugcaaacgggcaggagcuugcgcuugagcuguaccgggagccaguucacguucgggcgcuauggcauguacugggucaggcaagcgcccgggaaagggcucgaguggguggccgcgaucucguacgauggcucggacaaguaccauaccaauagcgugugggggcgcuuuaccgugagcagggacaauagcaagaacacggucuaucuccagaugaauagcuugcgcgcggaagauaccgcgcucuauuucugugucagggacaggcgcgagagcgagugcgagcucugggaaucggacuauuacgauuucgggaaaaggcucccgugcgugaaaccgcgcggggucgcgggaguguucgauaucuggggccagggcacgauggugaccgugagcucg

SEQ ID NO: 55435 - RNA, 432 nt, Artificial Sequence
  derived and/or modified sequence opt11 from anti-HIV_cap256-119-032113_VR-Chain
cagguccagcucguggaaucgggcgggggcgugguccagcccgggcgcccgcucaggcucucgugcgugggcucgggcuuuagcuuuaucacgagcgcgaugcauugggugcgccaggccccggacaagggcuuggaaugggucgcgaucauaagcgacggcgggaacaaucgccauuacgcggacucggucaagggcagguucacgaucucgcgagauaacucgaaaaauaccguguuccuggaagugaacaaucucaggcccgaggacacggccauguacuauugcgcgcgagaucaaagauacuaugaaugugaagagugggcaagcgauuacuaugacuuuggcagggaacagcccugucaagaucccaggggcguggucggggucuuugacaugugggggcaagggaccauggucacggucucgagc

SEQ ID NO: 55436 - RNA, 432 nt, Artificial Sequence
  derived and/or modified sequence opt11 from anti-HIV_cap256-119-031739_VR-Chain
caagugcaauuggucgagagcgggggcggggucgugcaaccgggcaggagcuugcgcauaagcugugccgcgagccaguucacguucaaucgcuauggcaugcacugggucagacaagcgccagggaaagggcuagaguggguggccucaaucucguacgauggaucggacaaguaccaugccggacucgugugggggcgcuuuaucauaagcagggacaauagcaagaacacgcucuaucuacagaugaauagcuugcgcgcggaagauaccgcgcucuauuacugugucagggacgagcgcgagagcgagugcgagcucugggaaucggacuauuacgauuucgggaaaaagcucccgugcgugaaaccgcgcggggucgcgggcacgcucgauaucuggggccagggcacgcgcgugaccgugagcucg

SEQ ID NO: 55437 - RNA, 432 nt, Artificial Sequence
  derived and/or modified sequence opt11 from anti-HIV_cap256-119-030932_VR-Chain
gaagugcaauugcucgagagcgggggcggagucgugcaaccgggcaggagcuugcgcuugagcugugccgcgagcggguucgcguucucgcacuacggcauauucugggucaggcaagcgccagggaaagggcucgagugggugaccgugaucucgggagauggcucgacccagugguaugccgauagcgugcaagggcgcuuuaccauaagcagggacucgagcaagaacacgcuauaucuccagauggauggauugcgcggggaagauaccgcgcucuauuacugugccaaggacuugcgcgagcucgagugcgaggaaugggccucggacuauuacgauuucgggcgcccgcaaccgugccuggacccgcgcggggucucgggcauaagcaaugucuggggccagggcacgauggugaccgugagcucg

SEQ ID NO: 55438 - RNA, 438 nt, Artificial Sequence
  derived and/or modified sequence opt11 from anti-HIV_cap256-119-030740_VR-Chain
caagugcaauuggucgaguucgggggcggggucgugcaaacgggcaggagcuugcgcuugagcugugccgcgagcggguucacguucucggacuauggaaugcacugggucaggcaagcgcccgggaaagggcucgaguggguggccucgaucucgaacgauggcucgaaaaaguaccauggcgauagcgugugggcgcgcuuuaucauaagcagggacaauagcaagaacacgcucuuucuccagaugucgagcuugcgagcggaagauaccgcgcucuauuucugugucagggaccaucgcgaggacgagugcgaggaaugguggucggacuauuacgauuucgggcgcgagcuaccgugcaggaaauuucgcgggcucgggcucgcgggcauauucgauaucuggggccauggcacgauggugaccgugagcucg

SEQ ID NO: 55439 - RNA, 438 nt, Artificial Sequence
  derived and/or modified sequence opt11 from anti-HIV_cap256-119-030197_VR-Chain
caagugcacuuggucgagagcgggggcggggucgugcaaccgggcaagagcuugagauugagcugugccgcgagccaguucacguucugccgcuauggaaugcacugggucaggcaagcgcccgggaaagggcucgaguggguggccucgaucucgaacgauggcacggacaaguaccaugccgauaacgugugggggcgcuuuaccauaagcagggacaauagcaagaacacgcucuaucucgagaugaauagcuugcgcggggaagauaccgcgcucuauuacugugccaaggacaugcgcgaggacgagugcgaggaaugguggucagacuauuacgauuucgggaaagagcucccgugcaggaaauggaaaacgcgcggggucgcgggcauacucgauaacuggggccagggcacgauggugaccgugagcucg

SEQ ID NO: 55440 - RNA, 438 nt, Artificial Sequence
  derived and/or modified sequence opt11 from anti-HIV_cap256-119-027047_VR-Chain
caaaugcaauuggucgagagcgggggaggggucgugcaaccgggcaggagcuugaccuugagcugugccgcgagccaguucacguucagaaacuauggcaugcacugggucaggcaagcgcccgggaaagggcucgaguggguggccucgaucucgaaagauggcacgaaaaaguaccauggcgauagcgugugggggcgcuuuaucauaagcagggacaauagcaagaacacgcucuuucuccagaugucgagccugcgcgcggaagauaccgcgcucuauuucugugucagggaccagcgcgaggccgagugcgaggaaugguggucggacuauuacgauuucgggcgcgagcuaccgugcaggaaauuucgcgggcucgggcucgcgggcauauucgauaucuggggccauggcacgaugguaaccgugagcucg

SEQ ID NO: 55441 - RNA, 432 nt, Artificial Sequence
  derived and/or modified sequence opt11 from anti-HIV_cap256-119-026950_VR-Chain
caagugcaacuggucgagagcgggggcggggucgugcaaccgggcaagagcuugcgcauaagcugugccgcgagcagguucacguucgggcgcuuuggcaugcacugggucaggcaagcgccagggaaagggcucgaguggguggccucgaucucguacgauggcucggacaaguaccaugccgggcucgugugggggcgcuuuaucauaagcagggacaauagcaagaacacgcuauaucuccagaugaauagcuugcgcgcggaagauaccgcgcucuauuacugugucagggacgagcgcgagagcgagugcgagcucugggaaucggacuauuacaauuucgggaaaaauuacccgugcgugaaaccgcgcggggucgcgggcacgcucgauaucuggggccagggcacgaccgugaucgugagcucg

SEQ ID NO: 55442 - RNA, 438 nt, Artificial Sequence
  derived and/or modified sequence opt11 from anti-HIV_cap256-119-026279_VR-Chain
caaaugcaauuggucgagagcgggggcggggucgugcaaccgggcacgagccugaccuugagcugugccgcgagccaguucucguucacgagcuauggaaugcacugggucaggcaagcgcccgggaaagggcucgaguggguggccucgaucucgaacgauggcacgaaaaaguaccaugccgagagcgugugggggcgcuuuaccauaagcaaggacaauagcaagaacacgcucuuucuccagaugaauagcuugcgcguggaagauaccgcgcucuauuucugugucaaggaccagcgcgaggacgagugcgaggaaugguggucggacuauuacgauuucgggcgcgagcucccgugcaggaaaucgcgcgggcucgggcucgcgggcauauucgauaucuggggccauggcacggucgugaucgugagcucg

SEQ ID NO: 55443 - RNA, 432 nt, Artificial Sequence
  derived and/or modified sequence opt11 from anti-HIV_cap256-119-025355_VR-Chain
gaagugcaauuggucgagagcgggggcgggcucgugcaaccgggcaggagcuugcgcuugagcugugcagcgagcggguucucguucucggacuaugccaugcacugggucaggcaagcgcccgggcaagggcucgaguggguggccuuuaucucguacgauggcacgaaaaaguaccauagcgauagcgugugggggcgcuugaccauaagcagggacaauagcaggaacacgcucuuucuccagaugaauagccugcgcacggaagauaccgcgcucuauuucugugucagggaccagcgcgaggacgauugcgaggaaugguggucggacuauuacgauuucgggaaaaagcucccgugcaggaaaucgcgcgggcuagcgggcauauucgauaucuggggccauggcacgauggugaccgugagcucg

SEQ ID NO: 55444 - RNA, 432 nt, Artificial Sequence
  derived and/or modified sequence opt11 from anti-HIV_cap256-119-025301_VR-Chain
caagugcacuuggucgcgagcgggggcggggucgugccaccgggcaggagcuugcgcuugagcugugucgcgagccaguucacguucucgggcuuuggcuuguacugggucaggcaagcgcccgggaaagggcucgaguggguggccgcgaucucauucgcgggcacgaaaaagcacuaugccaauagcgugaaagggcgcuuuaccauaagcagagacaauagcaagaacacgcucuaucuccagaugaauagcuugcgcccggacgauaccgcgcucuauuacugugccaaggacuugcgcgaguacgagugcgaggaauggaccucggacuauuacgacuucgggcgcccgcaaccgugcauagacucgcgcggggucgugggcauacucgauaucuggagccagggcacgauggugacagugagcucg

SEQ ID NO: 55445 - RNA, 438 nt, Artificial Sequence
  derived and/or modified sequence opt11 from anti-HIV_cap256-119-025010_VR-Chain
caagugcaauuggucgagagcgggggcggggucgugcaaccgggcaggagcuugcgcuugagcugucccgcgagcggguucucguucucgaccuauggcaugcacugggucaggcaagcgcccgggaaagggcucgaguggguggccucgaucucgaacgauggcaauaaaaaguaccauggcgagagcgugugggaucgcuuuaccauaagcagggacaauagcaagaacacgcucuuucuccagaugaaucgauugcgcguggaagauaccgcgcucuauuucugugucaaggaccagcgcgaggacgagugcgaggaaugguggucggacuauuacgauuucgggcgcgagcucccgugcaggaaauuucgcgggcucgggcucgcgggcauauucgaugucuggggccauggcacgauggugaccgugagcucg

SEQ ID NO: 55446 - RNA, 432 nt, Artificial Sequence
  derived and/or modified sequence opt11 from anti-HIV_cap256-119-024631_VR-Chain
caagugcaacugauggagagcgggggcggggucgugcaaccgggcgggagcuugcgauugagcugugccgcgagcggguucacguucucgagcuauggcaugcacugggucaggcaagcgcccgggaaagggcucgaguggguggccgggaucucguacgauggcucggacaaguaccaugcccauuucgugugggggcgauuuaucauaagcagggacaauagcaagaacgcgcucuaucuccagaugaauagcuugcgcccggaagauaccgcgcucuauuucugugucagggacuugcgcgagagcgagugcgaggaauggcaaucguacuauuacgauuucgggcgcaagggcccgugcuugaaaccgcgcggggucgcgggcucguucgauaucuggggccagggcacggucgugaccgugagcucg

SEQ ID NO: 55447 - RNA, 432 nt, Artificial Sequence
  derived and/or modified sequence opt11 from anti-HIV_cap256-119-024467_VR-Chain
gaagugcaauuggucgagagcgggggcgggcucgugcaaccgggcgggagccugaacgugagcugugccgcgagcggguucacauucaggaccuaugccaugcacugggucaggcaagcgcccgggaaagggcucgaguggguggccgcgaucucguacgauggcgauaacaaguacucggccgauagcgugaaagggcgcuuuaccauaagcagggaccagagcaagaacacgcucuaucuccagaugaauagcgugcgcguagaagauaccgcgcgcuauuacugugccagggacaugcgagaguacgagugcgagcuaugggccucggacuauuacgauuucgggaaaccgcaaccgugcgaggacccgcgcggggucgugggcacguucgauauguggggcuugggcacgcuagugaccgugagcucg

SEQ ID NO: 55448 - RNA, 432 nt, Artificial Sequence
  derived and/or modified sequence opt11 from anti-HIV_cap256-119-023805_VR-Chain
caagugcaauuggucgagagcgggggcggggucgugcaaccgggaaagagcuugcgcuugagcugugccgcgagccaguucggguucgggagcuauggcaugcacugggucaggcaagcgcccgggaaagggcucgaguggguggccacgaucucguucgauggcgcggacaaguaccaugccgaugacgugugggggcgcuuuagcauaagcagggacaauagcaagaacacgcucuaucuccagaugaauaacuugcgcccggaagauaccgcgcuauacuacugugccaaggacuugcgcgaggacgagugcgaggaaagguggucggacuauuacgauuucgggaaacagcucccgugcaggaaaucgcgcggggucgcgggcguguucgauaacuggggacagggcacgauggugaccgugagcucg

SEQ ID NO: 55449 - RNA, 432 nt, Artificial Sequence
  derived and/or modified sequence opt11 from anti-HIV_cap256-119-021736_VR-Chain
caagugcaacuggucgagagcgggggcggggucgugcaaccgggcaggagcgugcgauugagcugugucgcgagccaguucucguucgaucgauauggcaugcacugggucaggcaagcacccgggaaagggcucgaguggguggccucgaucucguacgauggcacggacaaguaccaugccgauaaagugugggggcgauuuaccauaagcagggacaauagcaagaaaacgcuauaucuccagaugaauagccugcgcccggaagaugccgcgcucuauuacugugccaaggacuugcgcgaggacgagugcgaggaaugguggucggacuauuacgauuucgggaaacagcucccgugcaggaaaucgcgcggagucgcgggcauauucgauagcuggggccagggcacgauggugaccgugagcucg

SEQ ID NO: 55450 - RNA, 438 nt, Artificial Sequence
  derived and/or modified sequence opt11 from anti-HIV_cap256-119-021203_VR-Chain
caaaugcaauuggucgagagcgggggcggggucgugcaaccgggcaggagcuugacccugagcugugccgcgagccaguucacguucucgaacuauggcaugcacugggucaggcaagcgcccgggaaagggcucgaguggguggccucggucucgaacgauggaacgaaaaaguaccauggcgauagcgugugggaucgcuuuaccauaagcagggacaauagcaagaacacgcucuuucuccagaugucgagcuugcgcgcggaagauaccgcggucuauuucugugucagggacgagcgcgaggacgagugcgaggaaugguggucggacuauuacgauuucgggcgcgagcucccgugcaggaaauuucgcgggcucgggcuagcgggcauauucgauaucuggggccauggcacacucgugaccgugagcucg

SEQ ID NO: 55451 - RNA, 432 nt, Artificial Sequence
  derived and/or modified sequence opt11 from anti-HIV_cap256-119-020569_VR-Chain
caagugcaauugguagagagcgggggcggggucgugcaaccgggcgagagcuugcgcauaagcugugccgcgagccaguucacguucucgcgcuauggaaugcacugggucaggcaagcgcccggaaaagggcucgaguggguggccucgaucucguucgauggcagggacaaguaccauagcucgcucgugugggggcgccugaccauaagcagggacaauagcaagagcacgcucuuucuccagaugaauagcuugcgaccggaagauaccgcgcucuauuacugugccagggacgugcgcgagagcgagugcgaggaauggcaaucggacuauuacgcguucuaucgcaagcucccgugcgugaaaccgcgcggggucgcgggcacgcucgauaucuggggccagggcacgauggugaccgugagcuca

SEQ ID NO: 55452 - RNA, 432 nt, Artificial Sequence
  derived and/or modified sequence opt11 from anti-HIV_cap256-119-019432_VR-Chain
caagugcaacugguccagagcgggggcggggucgugcaaccgggcaggagccugcgcauaagcugugccgcgcccuauuucacguucgggcgcuacggcuuucacugggucaggcaagcgcccgggaaagggcucgaguggguggccucgaucucguucgauggcagggacuauuaccauagcccgcacgugugggggcgccugaccauaagcagagacaauagcaagaacacgcucuaucuccagaugaauagcuugcgcgcagaagauaccgcgcucuauuacugugccagggacuugcgcgagagcgagugcgaggaaugggaaucagacuauuacgauuucgggaaaaagggcccgugcgugaaaccgcgcggggucgcgggcucgcucgauauguggggccagggcacgauggugaccguaagcucg

SEQ ID NO: 55453 - RNA, 432 nt, Artificial Sequence
  derived and/or modified sequence opt11 from anti-HIV_cap256-119-018827_VR-Chain
caagcgcaauuggucgagagcgggggcggggucgugcaaccgggcaggagccugcgcuugagcugugccgcgagccauuucucguucaaccgcuauggcaugcacugggucaggcaagcgcccgggaaagggcucgaguggguggccgggaucucguacgauggcagggacuuuuaccaugccgauaucguaugggggcgcuugaccauaagcagggacaauagcaagaacacgguauaucuccagaugaauagccugcgcgcggacgauaccgggcucuauuacugugccagagacgugcgagagagcgagugcgaggaaugggaaucguacuauuacgauuucgggcgcaagggcccgugcuugaaaccgcgcggggucgcgggcacguucgauauguggggccagggcacgaucgugagcgugagcgcg

SEQ ID NO: 55454 - RNA, 432 nt, Artificial Sequence
  derived and/or modified sequence opt11 from anti-HIV_cap256-119-018483_VR-Chain
cucguacaacuggucgagagcgggggcggggucgugcaaccgggcaagagccugcgcuugagcugugucgcgagccaguucacguucaaucgcuauggcaugcacugggucaggcaagcgcccgggaaagggcucgaguggguggccgggaucucguacgauggcagggacaaguaccaugcccauuucgugugggggcgcauaaccauaagcagggacaauagcaagaacacgcucuaucuccagaugaauagcuugcgcgcggaagauaccgcgcucuaucacugugucagggacuugcgcgagagcgagugcgagcucugggaaucggacuauuacgauuucgggaaaaagcucccgugcgugaaaccgcgcggggucgcgggcauauucgaucucuggggccagggcacgauggugaccgugagcucg

SEQ ID NO: 55455 - RNA, 432 nt, Artificial Sequence
  derived and/or modified sequence opt11 from anti-HIV_cap256-119-018118_VR-Chain
caagugcacuuggucgcgagcgggggcggggucgugccaccgggcaggagccugaccuugagcugugucgcgagccaguucacguucucaggcuguggcuugcacugggucaggcaagcgcccgggaaagggcucgaguggguggccucgaucucauucgcgggcacgaaaaagcacuauggcaauagcgugaaagggcgcuuuaccauaagcagggacaauagcaagaacacgcucuaucuccagaugaauagcuugcgcccggaagauaccgcgcucuauuacugugccaaggacuugcgcgaguacgagugcgaggaauggaccucggacuauuacgauuucgggcgcgaucaaccgugcauagacucgcgcggggucgugggcauacuagauaucuggggccagggcacgauggugaccgugagcuca

SEQ ID NO: 55456 - RNA, 432 nt, Artificial Sequence
  derived and/or modified sequence opt11 from anti-HIV_cap256-119-017782_VR-Chain
caagugcaauuggucgagagcgggggcggggucgugcaaccgggcaagagcuugcgauugagcugugccgcgagcggauucccguucucgaacuaugccaugcacugggucaggcaaacgcccgggcgcgggcuagaguggguggccgggaucucguucgcggccacgaaaaaguacuaucgcccgagcgugcgcgggcgauuuaccgugagcacggacauaagcaagaacacgcucuaucucgagaugaauagcuugcgcccggaagauaccgcgcucuauuucugugccagggaccagcgcuauuacgagugcgaggaaugggccucggacuauuacgauuucgggcgcgagcaaccgugcuuggacccgcgcggggucgugggcauauucgaucucuggggccagggcacgauggugacagugagcuca

SEQ ID NO: 55457 - RNA, 432 nt, Artificial Sequence
  derived and/or modified sequence opt11 from anti-HIV_cap256-119-017669_VR-Chain
caagugcaauuggucgagagcgggggcggggucgugcaaccgggcucgagcuugcgcuugagcugugccgcgagccauuucgcguucaaucgcuacggcaugcacugggucaggcaagcgcccgggaaaggacucgaguggguggccgggaucucguucgauggcgcggacaaguuccaugccgauaaagugugggggcgcuuuaccauaagcagggacaauagcaagaacacgcucucgcuccagaugaauagcuuacgcccggaagauaccgcgcucuauuacugugccaaggacuugcgagaggacgagugcgaggaaugguggucggacuauuacgauuucgggcgaaggcucccgugcaggaaaucgcgcggggucucgggaauauucgauaacuggggccagggaacgauggugaccgugagcucg

SEQ ID NO: 55458 - RNA, 432 nt, Artificial Sequence
  derived and/or modified sequence opt11 from anti-HIV_cap256-119-016976_VR-Chain
caagugcaauuggucgagagcgggggcggggucgugcaaccgggcaggagcuugcgcuugagcugugccgcgagccaguucucguucggggacuuuggcaugcacugggucaggcaagcgcccgggaaagggcucgaguggguggccgcgaucucguucgcgggcacgaaaaagaacuaugccgauagcgugcgcgggcgcuucaccauaagcagggacucgaguaagaacacgcuauaucuccagaugaauagcuugcgcccggaagauaccgcgcucuauuacugugucaaggacaugcgcggguacgagugcgaggaauggaccucggacuauuacgauuucgggcgcccgcaaccgugcauagacucgcgcggggucgugggcacauucgaugucuggggccagggcacgauggugaccgugagcucg

SEQ ID NO: 55459 - RNA, 432 nt, Artificial Sequence
  derived and/or modified sequence opt11 from anti-HIV_cap256-119-015432_VR-Chain
gaagugcaauugcucgagagcgggggcgggcucgugcaaccgggcgggagcuugcgcuugagcugugccgcgagcggguucacguucucgggcuauagcuugaacugggucaggcaagcgcccgggaaagggcucgaguggguggcaucgaucucguacgauggcucggacaaguaccaugccgaucgcgugugggggcgcuuuaccauaagcagggacaauagcaagaacacgcucuaucuccagaugaauagcuugcgagcggaagauaccgcgcucuauuacugugucagggacgcgcgcgagagcgagugcgagcucugggaaucggacuauuacaauuucgggcgcaagcucccgugcgugaaaccgcgcggggucgcgggcacgcucgauaucuggggccagggcacgauggugaccgugagcucg

SEQ ID NO: 55460 - RNA, 432 nt, Artificial Sequence
  derived and/or modified sequence opt11 from anti-HIV_cap256-119-015281_VR-Chain
cucgggcgcuuggucgcgagcgggggcggggucgugcccccgggcaggagcuugcgcuugagcugugucgcgagccaguucacguucucgggcuguggccugcacugggucaggcaagcgcccgggaaagggcucgaguggguggccucaaucucauucgcgggcacgaaaaagcacuauggcaauagcgugaaagggcgcuuuaccauaagcagggacaauagcaagaacacggucuaucucgagaugaauagcuugcgcgcggaagauaccgcgcucuauuacugugccaaggacuugcgcgaguacgagugcgaggaauggaccucggacuauuacgauuucgggcgaccgcaaccgugcauagacucgcgcggggucgugggcauacuagauaucuggggacagggcacaauggugaccgugagcucg

SEQ ID NO: 55461 - RNA, 432 nt, Artificial Sequence
  derived and/or modified sequence opt11 from anti-HIV_cap256-119-014957_VR-Chain
caagugcaaguggucgagagcgggggcggggucgugcaaccgggcacgagccugcgccugagcuguaccgugagcggguucucguucucaaacuaugacuugcacuggguaaggcaaacgcccgcgaaagggcucgaguggguggccguggucucguacgauggcucgcgcgaguacuauaccgauagcguaaaagggcgcuuuaucauaagcagggaccagagcaagaacacgcucuaucuccagaugaauagcgugcgcuuggaagauaccgcgcgcuauuacugugccagggacaugcgcgaguacgagugcgagcucugggccucggacuauuacgauuucgggaaaccgcaaccgugcgaggacccgcgcggggucgugggcacguucgauauguggggcuugggcacgcucgugaccgugagcucg

SEQ ID NO: 55462 - RNA, 432 nt, Artificial Sequence
  derived and/or modified sequence opt11 from anti-HIV_cap256-119-014777_VR-Chain
caagugcacuuaguagagagcgggggcggggucgugcaaccgggcaggagcuugcgcuugagcugugcagcgagccauuucucgcucucgagcuauggcaugcacugggucaggcaagcgcccgggaaagggcucgaguggguggccgggaucucguucgcggccacgaaaacguacuauggcgggagcgugaaagggcgcuuuaccguaagcagggacauaagcaagaacacgcuauaucuccagaugaauagcuugcgcccggaagauaccgcgauguauuacugugccagggaccagcgcuauuacgagugcgaggaaugggccucggacuauuacgauuucgggcgcgagcaaccaugccaggacccgcgcggggucgugggcguguucgauauguggggccagggcacgauggugaccgugagcucg

SEQ ID NO: 55463 - RNA, 432 nt, Artificial Sequence
  derived and/or modified sequence opt11 from anti-HIV_cap256-119-014313_VR-Chain
caagugcaauuagucgagagcgggggcggggucguacaaccgggcaggagcuugcgaauaagcugugccgcgagccaguucacguucucgcgcuauggcaugcacugggucaggcaagcgcccgggaaagggcuagaguggguggccucgaucucauacgauggcagggacuaucaccaugccggggcagugugggggcgcuuuaucauaagcagggacaauagcaagaacucgcuccaucuccagaugaauagccugcgaccggaagauaccgcgcucuauuucugugccagggaccugcgagagagcgagugcgaggaaugggaaucagacuauuacaauuucuggaaaaagcucccgugcguaaaaccgcgcggggucgugggcauacucgauaucuggggccagggcacggucgugaccgugagcucg

SEQ ID NO: 55464 - RNA, 438 nt, Artificial Sequence
  derived and/or modified sequence opt11 from anti-HIV_cap256-119-014219_VR-Chain
caaaugcaauuggucgagagcgggggcggggucgugcaaccgggcucaagccucaccuugagcugugccgcgagccaguucacguucucgaacuauggcaugcacugggucaggcaagcgcccgggaaagggcucgaguggguggccucaaucucgaacgauggcacgaaaaaguaccauggcgauagcgugugggaucgcuuuaccauaagcagggacaauagcaagaacacguuguuccuccagaugaauagcuugcgcgcggaagauaccgcgcucuauuucugugucaaggaccagcgcgaggacgagugcgaggaaugguggucggacuauuacgauuucgggcgcgagcucccgugcaggaaauuucgcgggcucgggcuagcgggcacguucgauaucuggggccauggcacgauguugaucgugagcuca

SEQ ID NO: 55465 - RNA, 432 nt, Artificial Sequence
  derived and/or modified sequence opt11 from anti-HIV_cap256-119-013631_VR-Chain
caagugcaauuggucgagagcgggggcggggucgugcaaccgggcaggagccugcgcuugagcugugccgcgagccaguucacguucgggagcuauggcaugcacugggucaggcaaauacccgggaaagggcucgaguggguggccacgaucucguacgauggcacgaaaaaguaccaugccgauagcgugugggaucgcuuuaucauaagcagggacaauagcaagaacacgcucuuucuccagaugaauagcuugcgcccggaagauaccgcgcucuauuucugugucaaggaccagcgccaggacgagugcgaggaaugguggucggacuauuacgauuucgggcgcaggcucccgugcaggaaaucgcgcgggcuagcgggcauauucgaugucuggggccauggcacgauggugaccgugagcucg

SEQ ID NO: 55466 - RNA, 432 nt, Artificial Sequence
  derived and/or modified sequence opt11 from anti-HIV_cap256-119-012924_VR-Chain
caagugaccuuggucgagagcgggggcggguucgugcaaccgggcgggagcuugcgcuugagcugugccacgagcggguucacguucucgagcuaugccaugcacugggucaggcaagcgcccgggaaagggcucgaguggguggccgcgauaucguucgauggcgcggacaaguaccaugccgauaacgugugggggcgcuugagcauaagcagggacaauagcaagagcacgcucuaucuccagaugaauagcuugcgcccggaagauaccgcggucuauuucugugccaaggacuugagagaggacgagugcgaggaaagguggucggacuauuacgauuucgggaaacagcucccgugcaggaaaucgcgcggggucgcgggcauauucgauaacuggggccagggcacgauggugaccgugagcgcg

SEQ ID NO: 55467 - RNA, 432 nt, Artificial Sequence
  derived and/or modified sequence opt11 from anti-HIV_cap256-119-011793_VR-Chain
caagugcaauuggucgagagcgggggcggggucgugcaaccgggcgggagcuugcgauugagcugugucgcgagccaguucacguucucgcgauauggcaugcacugggucaggcaagcgcccgggaaagggcucgaguggguggccucgaucucguacgauggcagggacaaguaccaugccgauuucgugugggggcgcuugaccauaagcagggacgauagcaagaaaacgcucuaucuccagauggauagcuugcgcguggacgauaccgcgcucuauuacugugucagggacaugcgcgagagugagugcgagcucugggaaucggacuauuacgauuucgggaaaaggcucccgugcgugaaaccgcgcggggucgcgggcauauucgauaucuggggccagggcacgauggugaccgugagcucg

SEQ ID NO: 55468 - RNA, 432 nt, Artificial Sequence
  derived and/or modified sequence opt11 from anti-HIV_cap256-119-011413_VR-Chain
caagugcaauuggucgagagcgggggagaugucgugcaaccgggcaggagcuugcgcuugagcugugccgcgagcggguucacguucucgaccuauggcaugcacugggucaggcaagcgcccgggaaagggcucgaguggguggccgcgaucucguucgcgggcacgaaaaagaacuaugccgauagcgugcgcgggcgauuuaccauaagcagggacucgagcaagaacacgcuauaucucgagaugaauagcuugcgcccggaagauaccgcgcucuauuacugugccaaggacaugcgcggguacgagugcgaggaauggaccucggacuauuacgauuucgggcgcccgcaaccgugcauagacucgcgcggggucgugggcacguucgaugucuggggccagggcacgauggugaccgugagcucg

SEQ ID NO: 55469 - RNA, 432 nt, Artificial Sequence
  derived and/or modified sequence opt11 from anti-HIV_cap256-119-011323_VR-Chain
caagugaaauuggucgagagcgggggcggggucgugcccccgggcaagagccugcgauugagcuguaccgcgagccaguucacguucucgaacuuuggcaugcacugggucaggcaagcgcccgggaaagggcucgaguggguggccucgaucucguucgugggaauaaaaacgcacuaugccaauagcgugcgagggcgcuuuaccauaagcagggaccagagcaagaacacgcucuaucuccagaugaauagcgugcgaguggaagauaccgggcguuauuacugugccagagacaugcgcgaguacgagugcgagcucugggccucggacuauuacgauuucgggaaaccgcaaccgugcgaggacccgcgcggggucgugggcacguucgauauguggggccugggcacgcucgugaccgugagcucg

SEQ ID NO: 55470 - RNA, 432 nt, Artificial Sequence
  derived and/or modified sequence opt11 from anti-HIV_cap256-119-011233_VR-Chain
caagugcacuuggucgagagcgggggcggggucgugcaaccgggcaggagcgugcgcuugagcugugccgcgagccauuucucgcucucgagcuauggcaugcacugggucaggcaagcgcccgggaaagggcuagagugggugaccggaaucucguucgcgggcacgaaaacguacuauggcgauagcgugcgagggcgcuuuaccguaagcagggacauaagcaagaacacgcucuuucuccagaugaauagcuugcgcccggacgauaccgcgauguauuacugugccagggaccagcgcuauuacgagugcgaggaaugggccucggacuauuacgacuucgggcgcgagcaaccgugcuuggacccgcgcggggucgugggcauauucgaucucuggggccagggcacgauggugaccgugagcucg

SEQ ID NO: 55471 - RNA, 432 nt, Artificial Sequence
  derived and/or modified sequence opt11 from anti-HIV_cap256-119-009038_VR-Chain
caagagcaacuggucgagagcgggggcggggucgugcaaccgggcaggagcuuacgcuugagcugugucgcgagcagguucacguucucggccuucggcaugcacugggucaggcaagcgcccgggaaagggcucgaguggguggccucgauaucguucgcgggcaucaaaaaguacuauggcgauagcgugaaagggcgauuuaccauaagcagggacaauagcaagaacacgcucuaucuccagauggauggccugcgcggggaagacaccgcgcuauauuacugugccaaggacuugcgcgagcucgagugcgaggaaugggccucggacuauuacgauuucgggcgcccgcaaccgugcuuggacccgcgcggggucucgggcauaagcaaugucuggggccagggcacgaugguaaccgugagcucg

SEQ ID NO: 55472 - RNA, 432 nt, Artificial Sequence
  derived and/or modified sequence opt11 from anti-HIV_cap256-119-008756_VR-Chain
caagugcaauuggucgagagcgggggcggggucgugcaaccgggcaagagcuugcgcuugagcugugucgugagccaguucacguucgggcgcuauggcaugcacugggucaggcaagcgcccgggaaagggcucgaguggguggccucgauaucguacgauggcucggacaaguaccauaccagcucauugugggggcgauuuaucgugagcagggacaauagcaagaacacgcucuaucuccagaugaauagcuugcgaccggaagauaccgcgcucuauuacugugucagggacaggcgcgagagcgagugcgaggaaagguggucggacuauuacgauuucgggaaacagcucccgugcgugaaaccacgcggggucgcgggcauauucgauaucuggggccagggcacgauggugacagugagcucg

SEQ ID NO: 55473 - RNA, 438 nt, Artificial Sequence
  derived and/or modified sequence opt11 from anti-HIV_cap256-119-008055_VR-Chain
caaaugcaauuggucgagagcgggggcggggucgugcaaccgggcaggagcuugaccuugagcugugccgcgagccaguucucauucgcgaacuauggcaugcacugggucaggcaagcgcccgggaaagggcucgaguggguggccucgaucucgaacgauggcacgaaaaaguaccaugaagagagcgugugggggcgcuuuaccauaagcaaggacaauagcaagaacacgcucuuucuacagaugaauagcuugcgcauagaagauaccgcacucuauuucugugucaaggaccagcgcgaggacgagugcgaggaaugguggucggacuauuacgauuucgggcgcgagcucccgugcaggaaaucgcgcgggcucgggcucgcgggcauauucgauauguggggccauggcacgauggugaccgugagcucg

SEQ ID NO: 55474 - RNA, 435 nt, Artificial Sequence
  derived and/or modified sequence opt11 from anti-HIV_cap256-119-006949_VR-Chain
cagguccaccucguggaaucgggcgggggcgugguccagcccgggcgcucgcucaggcucucgugcgcggccucgggcuuuagcgugagcaauaacuauaugaauugggugcgccaggccccgggcgagggcuuggaaugggucgcgcucaucagcuuugacgggcgccagaaagaucucgcggacucggucaagggcagguucgcgauaucgcgcgauaacucgaaaaauaccuuguacuugcaaaugaacucgcucaggcucgaggacacggccuuguacuauugcgcgcgcgaucucagagaauuggacugugaagaguggacgcuauauaacuauuacgauuucgggagcaggggcccgugcguggacccgcgcggggucgggggcucguucgaugucuggggccagggcacgauggugaccgugagcucg

SEQ ID NO: 55475 - RNA, 432 nt, Artificial Sequence
  derived and/or modified sequence opt11 from anti-HIV_cap256-119-006685_VR-Chain
caaguacaauuggucgagagcgggggcggggucgugcaaccgggcaggagcuugcgcgugagcugugccgcgagccauuucacguucucgcgcuauggcaugcacugggucaggcaagcgcccgggaaaggacucgaguggguagccucgaucucguacgauggaagggacuuuuaccaugccagaagcgugugggggcgcuuuaccauaagcagagacaauagcaagaacacgcuccaucuccagaugaauagcuugcgcccggaagauaccgcgcucuauuucugugccagggacuugcgagagagcgagugcgaggaaugggaaucguacuauuacgauuucgggaaaaagggcccgugcgugaaaccgcgcggggucgugggagugcuagauaucuggggccagggcacgcucgugaccgugagcucg

SEQ ID NO: 55476 - RNA, 432 nt, Artificial Sequence
  derived and/or modified sequence opt11 from anti-HIV_cap256-119-006015_VR-Chain
caagugcaacuggucgagagcgggggcggggucgugcaaccgggcaagaguuugcgcuugagcugugccgcgagcagauucacguucaaucgcuauggcaugcacugggucagacaagcgcccgggaaagggcucgaguggguggcagcgaucucguucgauggcacggacaaguaccauagcgaugacgugugggggcgcuuuaccauaagcagggacaauagcaagaacacgcucuaucuccagaugaauagcuugcgcccggaagauaccgcgcucuauuacugugccaaggacuugcaagaggacgagugcgaggaaugguggucggacuauuacgauuucgggaaacagcuaccgugcaggaaaucgcgcggggucgcgggcauauucgaugacuggggccagggcacgauggugaccgugagcucg

SEQ ID NO: 55477 - RNA, 432 nt, Artificial Sequence
  derived and/or modified sequence opt11 from anti-HIV_cap256-119-005841_VR-Chain
caagugcaauuggucgagagcgggggcggggucgugcaaccgggcaggagcuugcgcuugagcugugccgcgagccaguucucguucgggaacuuuggcaugcacugggucaggcaagcgcccgggaaagggcucgaguggguggccgcgaucucguucgcgggcacgaaagagaacuaugccaauagcgugcgcgggcgcuuuaccauaagcagggacaauagcaagaacacgcucuaucuccagaugaauagcuugcgcgcagaagauaccgcgcucuauuacuguaccaaggacaugcgcgaguacgagugcgaagaauggaccucggacuauuacgauuucgggcgcccgcaaccgugcauagacucgcgcgggguagugggcacguucgaugucuggggccagggcacgauggugaccgugagcucg

SEQ ID NO: 55478 - RNA, 432 nt, Artificial Sequence
  derived and/or modified sequence opt11 from anti-HIV_cap256-119-005824_VR-Chain
caagugcaacuggucgagagcgggggcggggucgugcaaccgggcgggagcuugcgcuugagcugugccgcgagcggguucacguucaggcgcuaugccaugcacugggucaggcaagcgcccgggaaagggcucgaguggguggccucgaucucguacgauggcucggacaaguaccauaccucgagcuugugggggcgcuuuaucgugagcagggacaauagcaagaacacgcuauaucuccagaugaauagcuugcgcccggaagauaccgcacucuauuacuguguaagggacaggcgcgagagcgagugcgaggaaagguggucggacuauuacgauuucgggaaacagcucccgugcgugaaaccgcgcggggucgcgggcauauucgauaucuggggccagggcacgauggugaccgugagcuca

SEQ ID NO: 55479 - RNA, 432 nt, Artificial Sequence
  derived and/or modified sequence opt11 from anti-HIV_cap256-119-005494_VR-Chain
caagugcgccuggucgagagcgggggcggggucgugcaaccgggcaggagcuugcgcauaagcugugccgcgagccaguucauguucaauaaauauggcaugcacugggucaggcaagcgcccgggaaagggcucgaguggguggccucgaucucguacgauggcucggacaaguaccaugccgaucucgugugggggcgcuuuaccauaagcagggacaauagcaagaacacgcucuaucuccagaugaauagccugcgcgcggaagauaccgcgcucuauuacugugucagggacgcgcgcgagagcgagugcgagcucugggaaucggacuauuacaauuucgggcgcaagcucccaugcgugaaaccgcgcggggucgcgggcacgcucgauaucuggggccagggcacgauggugaccgugagcucg

SEQ ID NO: 55480 - RNA, 432 nt, Artificial Sequence
  derived and/or modified sequence opt11 from anti-HIV_cap256-119-004949_VR-Chain
caagugcaauuggucgagagugggggcggggucgugcaaccgggccgcagcuugagacugagcugugccgcgagcaaguucucgcuaucgagcuauggcaugcacugggucaggcaagcgcccgggcgcgggcucgaguggguggccgggaucucguucgcggccacgaaaaaguacuaucgcccgagcgugcgcgggcgcuuuaccgugagcacggacauaagcaagaacacgcucuaucucgagaugaauagcuugcgcccggaagauacagcgcucuauuucugugccagggaccagcgcuauuacgagugcgaagaaugggcaucggacuauuacgauuucgggcgcgagcaaccgugcuuggacccgcgcgggguagugggcauauucgaucucuggggccagggcacgauggugaccgugagcucg

SEQ ID NO: 55481 - RNA, 432 nt, Artificial Sequence
  derived and/or modified sequence opt11 from anti-HIV_cap256-119-004422_VR-Chain
cacguacaauuggucgagagcgggggaggggucgugcaaccgggcaggagcuugcgcuugagcugugccgcgagcgggcucucguucucgagcuaugccaugcacugggucaggcaagcgcccgggaaagggcucgaguggguggccguggucucguacgauggcacgaccaaguucuaugccgauagcgugaaagggcgcuuuaccauaagcagagacaauagcaagaacacgcucuaucuccagaugaauagcuugcgcggggaagauaccgcgcucuauuacugugccaaggacuugcgcgaguacgagugcgaggaauggaccucggacuauuacgauuucgggcgcccgcaaccgugcauagacucgcgcggggucgugggcauacucgauaucuggagccagggaacgauggugaccgugagcucg

SEQ ID NO: 55482 - RNA, 432 nt, Artificial Sequence
  derived and/or modified sequence opt11 from anti-HIV_cap256-119-003932_VR-Chain
caagugcaauuacucgagagcgggggcggggucgugcaaccgggcgggagcuugcgccugagcuguaaagcgagccauuucucguucgaucgcuauggcaugcacugggucaggcaagcgcccgggaaagggcucgaguggguggccgcgaucucguucgauggcgcggacaaguaccaugccgauaacgugugggggcgauugagcauaagcagggacaauagcaagagcacgcucuaucuccagaugaauagcuugcgcccggaagauaccgcggucuauuucugugccaaggaccugcgcgaggacgagugcgaggaaagguggucggacuauuacgauuucgggaaacagcucccgugcaggaaaucgcgcggggucgcgggcauauucgauaacuggggccagggcacgauggugaccgugagcgcg

SEQ ID NO: 55483 - RNA, 438 nt, Artificial Sequence
  derived and/or modified sequence opt11 from anti-HIV_cap256-119-003577_VR-Chain
caagugcaauuggucgagagcgggggcgggggcgugcaaccgggaaggagcuugcgcuugagcugugccgcgagcggguucacguucaggagcuaugccaugcacugggucaggcaagcgcccgggaaagggcucgaguggguggccgugaucucgaacgauggcacgaaaaaguaccaugccgagagcgugugggaucgcuuuagcauaagcaaggacaauagcaagaacacgcuuuuucuccagaugaauagcuugagaguggaagauaccgcgcucuauuucugugucaaggaccagcgcgaggacgagugcgaggaaugguggucggacuauuacgauuucgggcgcgagcucccgugcaggaaaucgcgcgggcucgggcucgcgggaauauucgauauguggggccauggcacgauggugacagugagcucg

SEQ ID NO: 55484 - RNA, 432 nt, Artificial Sequence
  derived and/or modified sequence opt11 from anti-HIV_cap256-119-002155_VR-Chain
cucgggcgcuuggucgcaagcgggggcggggucgugcccccgggcaggagccugcgcuugagcugugucgcgagccaguucacguucucgggcuguggccugcacugggucaggcaagugcccgggaaagggcucgaguggguggccucgauaucguucgcgggcacgaaaacacacuauggcaauagugugaaagggcgcuuuagcauaagcagggacaauagcauaaacacgguauaucuacagaugaauagccugcgagcggaagauaccgcgcucuauuacugugccaaggacuugcgcgaguacgagugcgaggaauggaccucggacuauuacgauuucgggcgaccgcaaccgugcauagacucgcgcggggucgugggaauacucgauaucuggagccagggcacgauggugaccgugagcucg

SEQ ID NO: 55485 - RNA, 432 nt, Artificial Sequence
  derived and/or modified sequence opt11 from anti-HIV_cap256-119-002017_VR-Chain
caagugcaauuggucgagagcgggggcggggucgugcaaccaggcaggagcuugcgcuugagcugugccgcgagcggguucacguucucguacuauggcauacacugggucaggcaagcgcccgggaaagggcucgaguggguggccucgaucucguacgaugaaagggacuuuuaccaugcaaggagcgugugggggcgcuuugccauaagcagggacaauagcaagaacacgcuccaucuccagaugaauagcuugcgaccggaagauaccgcgcucuauuucugugccagggacuugcgcgagagcgagugcgaggaaugggaaucguacuauuacgauuucgggaaaaagggcccgugcgugaaaccgcgcggggucgugggcgugcucgauaucuggggacagggcacgcuagugaccguaagcucg

SEQ ID NO: 55486 - RNA, 432 nt, Artificial Sequence
  derived and/or modified sequence opt11 from anti-HIV_cap256-119-001312_VR-Chain
caagugcaauugauggagagcgggggcggggucgugcaaccgggcaggagcuugcgcuuggccugugccgcgagcggguucacguucucgagcuaugccauacacugggucaggcaagcgccagggaaagggcucgaguggguggccgcgaucucguucgcgggcacgaaaaagaacuaugccgauagcgugcgcgggcgcuuuacaauaagcagggacucgagcaagaacacgcucuaccucgagaugaauagcuugcgcccggaagauaccgcacucuauuacugugccaaggacaugcgaggauacgagugcgaggaauggaccucggacuauuacgauuucgggcgaccgcaaccgugcauagacucgcgcggggucgugggcacguucgaugucuggggccagggcacgauggugaccgugagcucg

SEQ ID NO: 55487 - RNA, 438 nt, Artificial Sequence
  derived and/or modified sequence opt11 from anti-HIV_cap256-119-001017_VR-Chain
caaaugcaauuggucgagagcgggggcggggucgugcaaccgggcaggagcuugaccuugaguugugccgcgagccaguucucguucacgaacuauggcaugcacugggucaggcaagcgcccgggaaagggcucgaguggguggccucgaucucaaacgauggcaauaaaaaguaccauggcgagagcgugugggaucgauuuaccauaagcagggacaauagcaagaacacgcucuuucuccagaugaaucgcuugcgaguggaagauaccgcgcucuauuucugugucaaggaccagcgcgaggacgagugcgaggaaugguggucagacuauuacgauuucgggcgcgagcucccgugcaggaaauuucgcgggcuagggcucgcgggcauauucgaugucuggggccauggcacgauggugaccgugagcucg

SEQ ID NO: 55488 - RNA, 432 nt, Artificial Sequence
  derived and/or modified sequence opt11 from anti-HIV_cap256-119-000594_VR-Chain
caagugcaauuggucgagagcgggggcgggcucgugcaaccgggcacgagcuugcgcuugagcugugccgcgagcgcguucacguucaagaacuauggcaugcacugggucaggcaagcgcccgggaaagggcucgauuggguggccucaaucucguacgauggaagggacaaguaccauagcucgcucgugugggggcgccugaccauaagcagagacaauagcaagagcacgcucuuucuccagaugaauagcuugcgcgcggaagauaccgcgcucuauuacugugccagggacuugcgcgagagcgagugcgaggaauggcaaucggacuauuacgcguucuauaaaaagcuaccgugcgugaaaccgcgcggggucgcgggcacgcucgauauauggggccagggcacgauggugaccgugagcucg

SEQ ID NO: 55489 - RNA, 432 nt, Artificial Sequence
  derived and/or modified sequence opt11 from anti-HIV_cap256-059-241099_VR-Chain
caagugcaauuggucgagagcgggggcggggucgugcaaccgggcaggagcuugcgcuugagcugugccgcgagcggguucacguucucgagcuauggcaugcacugggucaggcaagcgcccgggaaagggcucgaguggguagcagugaucucguacgauggcucgaacaaguacuaugucgauagcgugcaagggcgcuuuaccauaagcagggacaauagcaagaacacgauguuucuccagaugaauagccugcgcacggaagauaccgcggucuauuacugugccagagacuugggcgagagcgagguagaggaaugggccacggacuauuacgauuucucgaucgcguacccggucgagggcccgcgaggggucgugggcauauucgauaucuggggccagggcacgauggugaccgugagcucg

SEQ ID NO: 55490 - RNA, 432 nt, Artificial Sequence
  derived and/or modified sequence opt11 from anti-HIV_cap256-059-207529_VR-Chain
caagugcaauuggucgagagcgggggcggggucgugcaaccgggcaggagcuugcgauugagcugugccgcgagcggguucacguucucgagcuauggcaugcacugggucaggcaagcgcccgggaaagggcucgaguggguggccgggaucucguucgcgggcauaaacaaguacuauggcaauagcgugaaagggcgcuuuaccauaagcagggacaauagcaggaacacgcucuaucuacagaugaauagcuugcgcgcggaagauaccgcgcucuauuacugugccagggacuugcgcgagauggagugcgaggaaugggccucggacuauuacgauuucgggcgcgggggcccgugccaggacccgcgcggggucgugggcacguucgauaucuggggccagggcacgauggugaccgugagcucg

SEQ ID NO: 55491 - RNA, 435 nt, Artificial Sequence
  derived and/or modified sequence opt11 from anti-HIV_cap256-059-205541_VR-Chain
cagaugcagcucguggaaucgggcgggggcgugguccagcccgggggcucgcucaggcucucgugcgcggccucgggcuuuagcuuuagcuauuacgcgauggauugggugcgacaggccccgggcaagggcuuggaaugggucgcguucauaagcucggacgggagcgauaaaaauuacgcggacucggucaagggcagguucacgaucucgcgcgauaacucgaaaaauaccuuguacuugcaaaugaacucgcucagggccgaggacacggccguguacuauugcgcaaaagaugucgggggccauaaaaaugacgagugggcgaccaauuacuauuacgauaucucgaucgcguacccgauccaggacccgcgcgcggucgcaggcgcguucgaugucuggggccagggcacgauggugaccgugagcuca

SEQ ID NO: 55492 - RNA, 432 nt, Artificial Sequence
  derived and/or modified sequence opt11 from anti-HIV_cap256-059-188439_VR-Chain
caagugcaauuggucgagagcgggggcggggucgugcaaccgggcaggagcuugcgcuugagcugugccgcgagccaguucacguucucgaacuauggcaugcacugggucaggcaagcgcccgggaaagggcuagaguggguggccgcgaucucguucgcgggcauaaacaaguacuauaccgauagcgugaaagggcgcuuuaccauaagcagggacaauagcaagaacacgcucuaucuccagaugaauagcuugcgcgcggaagauaccgcacucuauuacugugccaaggacuugcgcggauucgagugcgaggaaugggccucggacuauuacgauuucgggcgcgaucucccgugccaggacccgcgcggggucgugggcacguucgaugucuggggacagggcacgaaagugaccgugagcucg

SEQ ID NO: 55493 - RNA, 432 nt, Artificial Sequence
  derived and/or modified sequence opt11 from anti-HIV_cap256-059-187234_VR-Chain
caagugcaacuggucgagagcgggggcggggucgugcaagcgggcaggagcuugcgccugagcugugccgcgagccaguucacguucgggagcuauggcaugcacugggucaggcaagcgcccgggaaagggcucgaguggguggccgcgaucucguucgcgggcacgaaaauacacuaugccgauagcgugaaagggcgcuuuaccauaagcagggacaauagcaagaacgcgcuauaucuccagaugcauagcuugcgcgcggaagauaccgcgcucuauuacugugccaaggacuugcgcgaguacgagugcgaggaaugggcaucggacuauuacgauuucgggcgcgaucaaccgugccaggacccgcgcggggucgugggcauauucgauaucuggggccagggcacgauggugaccgugagcucg

SEQ ID NO: 55494 - RNA, 432 nt, Artificial Sequence
  derived and/or modified sequence opt11 from anti-HIV_cap256-059-187047_VR-Chain
caagugcaacuggucgagagcgggggcggggucgugcaaccgggcaggagcuugcgccugaguugugccgugagccagcucacguucucgagcuauggcaugcacugggucaggcaagcgcccgggaaagggcucgaguggguggccgcaaucucguucgugggcaucaaaaaguacuaugccgacagcgugaaagggcgcuuuaccauaagcagggacaauagcaagaacacgcucuaucuccagaugaauagcuugagaguggaagauaccgcgcucuauuacugugccaaggacuugcgcgaguacgagugcgaggaaugggccucggacuauuacgauuucgggcgcgaucaaccgugccaggacgcgcgaggggucgugggcacgagcgauauauggggccagggcacgauggugaccgugagcucg

SEQ ID NO: 55495 - RNA, 432 nt, Artificial Sequence
  derived and/or modified sequence opt11 from anti-HIV_cap256-059-186068_VR-Chain
caagugcaauuggucgagagcgggggcggggucgugcaaccgggcaggagcuugcgauugagcugugccgcgagccaguucucguucucgaacuauggaaugcacugggucaggcaagcgcccgggaaagggcucgaguggguggccgggaucucguucgcggccacgaaaaaguacuaugccgauagcgugaaagggcgcuuuagcgugagcagggacaauagcaagaacgcgcucuaucuccagaugaauagccugcgcgcggaagauaccgcgcucuauuacugugccagggacuugcgagauuacgagugcgaggaaugggccucggacuauuacgauuucgggcgcgaguacccgugccaggacccgcgcggggucgugggcacguucgauaucuggggccagggcacgauggugaccgugagcacg

SEQ ID NO: 55496 - RNA, 435 nt, Artificial Sequence
  derived and/or modified sequence opt11 from anti-HIV_cap256-059-182835_VR-Chain
caaguccaacucgucgaauccggcggcggccuaguccaaccuggccgcucccuccgccucuccugcgcagccucaggcuucagcuucaacaacuucgccauggacuggguccgccaagcccccggcaaaggccuagaaugggucgccuucgucuccuccgacggaagcaacaaaaacuacgcagacuccgucaaaggccgauucaucaucucccgcgacaacuccaaaaacaccgucuaccuccaaaugaacucccuccgagucgaagacaccgccgucuacuacugcgcaaaagaccucggcgccaacaaagacgacgaaugggccaccgacuacuacuacgaccucuccgucgcccgccccguccccgacccccgcgccgucgucggcgccuucgacgucuggggccaaggcaccauggucaccgucagcucc

SEQ ID NO: 55497 - RNA, 432 nt, Artificial Sequence
  derived and/or modified sequence opt11 from anti-HIV_cap256-059-176659_VR-Chain
cgcgugcaauuggucgagagcgggggcggggucgugcaaccgggcaggagcuugcgcuugagcugugccgcgagccaguucucguucucgaacuauggaaugcacugggucaggcaagcgccagggaaagggcucgaguggguggccgggauaucguucgcggccaucaaaaaguacuaugccgauagcgugaaagggcgcuuuaccauaagcagggacaauagcaagaacgcgcucuaucuccagaugaauagcuugcgcgcggaagauaccgcgcuauauuacugugcaagggacuugcgcgaguacgagugcgaggaaugggccucggacuauuacgauuucgggcgcgagcucccgugccaggacccgcgcggggucgugggcacguucgauaccuggggccagggcacgauggugaccgugagcacg

SEQ ID NO: 55498 - RNA, 432 nt, Artificial Sequence
  derived and/or modified sequence opt11 from anti-HIV_cap256-059-172956_VR-Chain
caagugcaauuggucgagagcgggggcggggucgugcaaccgggcaggagcuugcgcuugagcugugccgcgagccaguucucguucucgagcuauggcaugcacugggucaggcaagcgcccgggaaaggacuagaguggguggccgcgaugucguucgcgggcacgaaccaguacuaugccgcgagcgugaaagggcgcuuuaccauaagcagggacaauagcaagaacacgcucuaucuccauaugaauagcuugcgcccggaagauaccgcgcucuauuacugugccagggacuugcgcgaguacgagugcgaggaaugggccgcggacuauuacgauuucgggcgcgaguacccgugccaggacccgcgcggggucgugggcauauucgauguauggggccagggcacgcucgugacagugagcucg

SEQ ID NO: 55499 - RNA, 432 nt, Artificial Sequence
  derived and/or modified sequence opt11 from anti-HIV_cap256-059-171272_VR-Chain
caagugcucuuggucgagagcgggggcggggucgugcaaccgggcaggagcuugcgcuugagcugugccgcgagccaguucacguucucgaacuauggcaugcacugggucagacaagcgcccgggaaagggcucgaguggguggccgcgaucucguucgcgggcaugaaaaaguacuaugccgauagcgugaaaggacgcuuuaccauaagcagggacaauagcaagaacacgcucuaucuccagaugaauagcuugcgcgcggaagauaccgcgcucuauuacugugccaaggaccugcgcgaguucgagugcgaggaaugggccucggacuauuacgauuucgggcgagcgcaaccgugccaggacccgcgcggggucgugggcacguucgaucucuggggccagggcacaauggugaccgugagcucg

SEQ ID NO: 55500 - RNA, 432 nt, Artificial Sequence
  derived and/or modified sequence opt11 from anti-HIV_cap256-059-168734_VR-Chain
caagugcaauuggucgagagcggaggcggggucguacaaccgggcaggagccugcgcuugagcuguaccgcgagccaguucucguucucgagcuauggcaugcacugggucaggcaagcgcccgggaaagggcucgaguggguggcagcgaucucguucgcgggcacgaaaaaguacuaugucgggaccgugaaagggcgcuuuaccauaagcagggacaauagcaagaacacgcucuaucuccagaugaauagcuugcgcgcggaagauaccgcgcucuauuacugugccaaggacaugcgcgaguacgagugcgaggaaugggccucggacuauuacgauuucgggcgcgaguacccgugccaggacccgcgcggggucgugggcacguucgauaucuggggccagggcacgauggugaccgugagcuca

SEQ ID NO: 55501 - RNA, 432 nt, Artificial Sequence
  derived and/or modified sequence opt11 from anti-HIV_cap256-059-155838_VR-Chain
caagugcaauuggucgagagcgggggcggggucgugcaaccgggcaggagcuugcgcuugagcugugccgugagccaguucacguucucgaacuauggcaugcacugggucaggcaagcgcccgggaaagggcucgaguggguagccgcgaucucguucgcgggcaccaaaaagagcuaugccgcgagcgugaaagggcgcuuuacaauaagcagggacaauagcaagaacacgcucuaucuccagaugaauagcuugcgcccggaagauaccgcgcucuauuacugugccaaggacaugcgcggguucgagugcgaggaaugggccucggacuauuacgauuucggacgcgagcaaccgugccaggacccgcgcggggucgugggcauauucgaucucuggggccagggcacgauggugagcgugagcucg

SEQ ID NO: 55502 - RNA, 432 nt, Artificial Sequence
  derived and/or modified sequence opt11 from anti-HIV_cap256-059-149799_VR-Chain
caagugcacuuggucgagagcgggggcggggucgugcaaccgggcaggagcuugcgauugagcugugccgcgagccaguucacguucucgaacuauggcuuucacugggucaggcaagcgcccgggaaagggcucgaguggguggccgcgaucucguucgcgggcgugaaaaagcacuaugccgauagcgugaaaggacgcuuuaccauaagcagggacaauagcaagaacacgcucuaucuccagcucaauagcuugcgcgcggaagauaccgcacucuauuacugugccaaggacuugcgcgaguacgagugcgaggaaugggccucagacuauuacgauuucggacgcgauuucccgugccaggacccgcgcggggucgugggcacguucgauaucuggggccagggcacaauggugaccguaagcucg

SEQ ID NO: 55503 - RNA, 432 nt, Artificial Sequence
  derived and/or modified sequence opt11 from anti-HIV_cap256-059-148168_VR-Chain
caagugcaacuggucgagagcgggggcggggucgugcaaccgggcaggagcuugcgcuugagcuguaccgcaagccaguucacguucucgaacuacggcaugcacugggucaggcaagcgcccggaaaagggcucgaguggguggccgggaucucguucgcggccacgaaaaaguacuacagcgauagcgugaaagggcgcuuuaccauaagcagggacaacagcaagaacgcgcucuaucuccagaugaauagcuugcgcgcggaagauaccgcgcucuaucacugugccaaggacuugcgcgaguacgagugcgaggaaugggccucggacuauuacgacuucgggcgcgagcaaccgugccaggacccgcgcggggucgugggcacguucgauaucuggggccagggaacgauggugaccgugagcacg

SEQ ID NO: 55504 - RNA, 435 nt, Artificial Sequence
  derived and/or modified sequence opt11 from anti-HIV_cap256-059-144685_VR-Chain
cagguccaucucguagaaucgggcgggggcguaguccagcccgggcgcucgcucaggcucucgugcgcggccucaggcuuuaccuuuagcaauuucgcgauggauugggugcgccaggccccgggcaagggcuuggaaugggucgcguucgugagcucggacgggaacaauaaaaauuacggggacucgguaaagggcagguucacgaucucgcgcgauaacucgaaaaauacccuguuccugcaaaugaacucgcucagggccgaggacacggcccuguacuauugcgugaaagaugucggggacuauaaaucggacgagugggcgacacauuacuauuacgaucucucgaucgcggacccgauccaggacccgcgcgcggucgugggcgcguucgauaucuggggcaggggcacgaugguggccgugagcucg

SEQ ID NO: 55505 - RNA, 432 nt, Artificial Sequence
  derived and/or modified sequence opt11 from anti-HIV_cap256-059-140017_VR-Chain
caagugcaauuggucgagagcgggggcggggucgugcaaccgggcaggagcuugcgcuugagcugugccgcgagccaguucucguucgggaacuuuggcaugcacugggucaggcaagcgcccggaaaagggcucgaguggguggccggaaucucguucgcgggcacgaaaaaguacuaugccgauagcgugaaagggcgauuuacaauaagcagggacaauagcaagagcgcgcucuuucuccagaugaauagcuugcgcgcggaagauaccgcgcucuauuacugugccaaggacuugcgcuauuacgagugcgaggaaugggccucggacuauuacgauuucgggcgcgaucaaccgugccaggacccgcgcggggucgugggcacguucgauauguggggccagggcacgauggugaccgugagcucg

SEQ ID NO: 55506 - RNA, 432 nt, Artificial Sequence
  derived and/or modified sequence opt11 from anti-HIV_cap256-059-137547_VR-Chain
caagugcaauuggucgagagcgggggcggggucgugcaaccgggcaggagcuugcguuugagcugugccgcgagccaguucacguucucgcgcuauggcaugcacugggucaggcaagcgcccgggaaagggcucgaguggguggccgcgaucucguucgcgggcaucaaaaagaacuaugccgauagcgugaaagggcgcuuuaccauaagcagggacaauagcaagaacacgcucuaucuccagaugaauagcuugcgcgcggaagauaccgcgcucuauuacugugccagggacuugcgcgaguucgagugcgaggaaugggccucggacuauuacgauuucgggcgcgauuucccgugccaggacccgcgcggggucgugggcauauucgauauauggggccagggcacgauggugaccgugagcucg

SEQ ID NO: 55507 - RNA, 435 nt, Artificial Sequence
  derived and/or modified sequence opt11 from anti-HIV_cap256-059-131908_VR-Chain
caaguccaacucgucgaauccggcggcggcgucguccaacccggccgcucccuacgccucuccugcaccgccagcggcuucaccuucuccaacuacggaauccacuggguccgccaagcccccggcaaaggccucgaauggguagccgccaucucauacgaaggcuccaucaaauacuacgucgacuccgucaaaggccgcuucaccaucucccgcgacgacuccaaaaacacccucuuccuccaaaugaacucccuccgcaccgaagacaccgccguauacuacugcacccgcgacguccgcgaaugggaaaccgaagaaugggccaccaacuacuacuacgaccucuccaucgccuaccccauccgacacccccgaggcgucgucggcaucuucgacgucuggggacucggcacccgcgucaccgucuccucc

SEQ ID NO: 55508 - RNA, 432 nt, Artificial Sequence
  derived and/or modified sequence opt11 from anti-HIV_cap256-059-116006_VR-Chain
caagcgcaauuggucgagagcgggggcggagucgugcaaccgggcaggagcuugcgcuugagcugugccgcgagccaguucucguucucgagcuauggcaugcacugggucaggcaagcgcccgggaaagggcuagaguggguggccucgaucucguucgcgggcgugaaaaagaccaaugccgauagcgugaaagggcgauuuaccauaagcagggacaauagcaagaacacgcuccaucuccagaugaauggcuugcgcaaugacgauaccgcgcucuauuacugugccagggacuugcgcgauuucgagugcgaggaaugggccucggacuauuacgauuucgggcgagaguucccgugccaggacccgcgcgggguagugggcacguucgauaucuggggccagggcacgaaagugaccgugagcucg

SEQ ID NO: 55509 - RNA, 411 nt, Artificial Sequence
  derived and/or modified sequence opt11 from anti-HIV_cap256-059-115783_VR-Chain
caagugcaauugguagagagcgggggcggggucgugcaaccgggcaggagccugcgcuugagcugugccgcgagccaguucacguucucgagcuauggcaugcacugggucaggcaagcgcccgggaaagggcucgaguggguggccgcgauaucguacgcggacucggucaagggaagguucacgaucucacgagauaacucgaaaaauacccuguacuugcaaaugaacucgcucagggccgaggacacggccuuguacuauugcgcgaaagaucucagggaaauggaaugugaagagugggcgagcgauuacuaugacuuuggcagggacuugcccugucaagauccaaggggcgugguagggacccuggacauaugggggcaagggaccauggucacggucucaagc

SEQ ID NO: 55510 - RNA, 432 nt, Artificial Sequence
  derived and/or modified sequence opt11 from anti-HIV_cap256-059-114609_VR-Chain
caagugcaauuggucgagagcgggggcggggucgugcaaccgggcaggagcuugcgcuugagcugugccgcgagccagcucacguucucgaacuuuggcaugcacugggucaggcaagcgcccgggaaagggcucgaguggguggccgggaucucguucgcgggcacgaaaaaguacuaugccgauagcgugaaagggcgcuuuaccauaagcagggacaauagcaagaacgcgcucuaucuccagaugaauaccuugcgcgcggaagauaccgcgcucuauuucugugccaaggacuugcgcgaguacgagugcgaggaaugggccucggacuauuacgauuucgggcgagaucaaccgugccaggacccgcgcggggucgugggcauauucgauaucuggggccagggcacgauggugaccgugagcuca

SEQ ID NO: 55511 - RNA, 432 nt, Artificial Sequence
  derived and/or modified sequence opt11 from anti-HIV_cap256-059-113952_VR-Chain
caagcgcaauuagucgagagcgggggcggggucgugcaaccgggcaggagcuugcgcuugagcugugccgcgagccauuucacguucucgagcuauggcuuucacugggucaggcaagcgcccgggaaagggcucgaguggguggccgggaucucguucgcggccacgaaaaaguacuaugccgauagcgugaaagggcgcuuuaccauaagcagagacaauagcaaggacgcgcucuaucuccagaugaauagccugcgcgcggaagauaccgcgcucuauuacugugccagggacuugcgcggguacgagugcgaggaaugggccucggacuauuacgacuucgggcgcgaucaaccgugccaggacccgcgcggggucgugggcauauucgaucucuggggccagggcacgauggugaccgugagcucg

SEQ ID NO: 55512 - RNA, 432 nt, Artificial Sequence
  derived and/or modified sequence opt11 from anti-HIV_cap256-059-113878_VR-Chain
cagguacagcucguggaaucgggcgggggcgugguccagcccgggcgcucacucaggcucucgugcgcggccucgggcuuuaccuuuagcacguacgcgaugcauugggugcgccaggccccgggcaagggccuagaaugggucgcgcucauaagcuaugacgcgaccaauaaauauuacguggacucggucaagggcagguucacgaucucgcgcgauaacucgaaaaauacccuguacuugcaaaugagcucgcucacggccgaggacacagccguguacuauugcgcgaaagaucucgggggcauaaaaauagacgagugggggaccgauuacuaugacauaagcgugagcuaucccgugcaagaucccagggccguggccgggaucuucgacgugugggggcacgggaccauggucucggucucaagc

SEQ ID NO: 55513 - RNA, 432 nt, Artificial Sequence
  derived and/or modified sequence opt11 from anti-HIV_cap256-059-113622_VR-Chain
caagugcaauuggucgagagcgggggcggggucgugcaaccgggcaggagcuugcgauugagcugugcagcgagccaguucacguucacgagcuauggaaugcacugggucaggcaagcacccgggaaagggcucgaguggguggccgggaucucguucgcgggaacgaaaaagcacuaugccgauagcgugaaagggcgauuuaccauaagcagggacaauagcaagagcacgcucuaucuccagaugaauagcuugcgcgcggaagauaccgcgcucuauuacugugcaaaggacaugcgcgaguacgagugcgaggaaugggccucggacuauuacgauuucgggcgcgaucaaccgugccaggacccgcgcggggucgugggcauauucgaucuauggggccagggcacgauggugaccgugagcucg

SEQ ID NO: 55514 - RNA, 432 nt, Artificial Sequence
  derived and/or modified sequence opt11 from anti-HIV_cap256-059-109427_VR-Chain
caagugcaauugguagagagcgggggcggggucgugcaaccgggcaggagccugcgcuugagcugugccgcgagccaguucacguucucgaacuauggcaugcacugggucagacaagcgcccgggaaagggcucgaguggguggccucgaucucguucgcgggcaucaaaaagcacuauaccgauagcgugaaagggcgcuuuaccauaagcagggacaauagcaagaacacgcucuuucuccagaugaauagcuugcgcgcggaagauaccgcgcucuauuacugugccagggaccugcgcgaguacgagugcgaggaaugggccucagacuauuacgauuucggacgcgaucaaccgugccaggacccgcgaggggucgugggcacgagcgauauauggggccagggaacgaaagugaccgugagcucg

SEQ ID NO: 55515 - RNA, 432 nt, Artificial Sequence
  derived and/or modified sequence opt11 from anti-HIV_cap256-059-109081_VR-Chain
caagagcaauuggucgagagcgggggcggggucgugcaaccgggcaggagccugcgcuugagcugugccgcgagccaguucucguucucggccuauggcaugcacugggucaggcaagcacccgggaaagggcucgaguggguggccgggaucucguucgcggccacgaaaaaguacuaugaagauagcgugaaagggcgcuuuaccauaagcagggacaauagcaagaacacgcucuaucuccagaugaauagcuugcgcggggaagauaccgcgcucuauuacugugccaaggacaugcgcgagauggagugcgaggaaugggccucggacuauuacgauuucgggcgcccgcaaccgugccaggacccgcgcggggucgugggcauauucgauauguggggccagggcacgauggugaccgugagcucg

SEQ ID NO: 55516 - RNA, 432 nt, Artificial Sequence
  derived and/or modified sequence opt11 from anti-HIV_cap256-059-107590_VR-Chain
caagagcaauuggucgagagcgggggcggagucgugcaaccgggcaggagcuugcgcuugagcugugccgcgagccaguucucgaucucggccuauggcaugcacugggucaggcaagcgcccgggaaagggcuagaguggguggccgggaucucguucgcgggcacgaaaaaguacuaugccgauagcgugaaagggcgcuuuacaauaagcagggacaauagcaagaacacgcucuaucuccagaugaauagccugcgcggggaagauaccgcgcucuauuacugugccaaggacaugcgcgagauggagugcgaggaaugggccucggacuauuacgauuucgggcgagaucaaccgugccaggacccgcgcggggucgugggcauauucgauauguggggccagggcacgauggugaccgugagcucg

SEQ ID NO: 55517 - RNA, 435 nt, Artificial Sequence
  derived and/or modified sequence opt11 from anti-HIV_cap256-059-107504_VR-Chain
caagugcucuuggucgagagcgggggcggggucgugcaaccgggcaagagcuugcgcuugagcuguagcgcgagcagguucacguucucgaacuauggcaugcacugggucaggcaagcgcccgggaaagggcucgaguggguggccgcggucucguucgcgggaauaaagaaaaccaaugccgauagcgugaaagggcgcuuuaccauaagcagggacaauagcaagaacacgcucuaucuccagaugaauagcuugcgcgcggaagauaccgcgcuauauuacugugccagggaccugcgagauuucgagugcgaggaaugggccucagacuauuacgauuucuggggcgauccccagcccugucaagaucccagaggcguggucgggaccuuugacuugugggggcaagggacaauggucacggucucgagc

SEQ ID NO: 55518 - RNA, 432 nt, Artificial Sequence
  derived and/or modified sequence opt11 from anti-HIV_cap256-059-099614_VR-Chain
gaagugcucuugcucgagagcgggggcgggcucgugcaaccgggcaggaguuugcgcuugagcugugccgcgagccaguucacguucucgagcuacggcaugcacugggucaggcaagcgcccgggaaagggcucgaguggguggccgggaucucguucgugggcaucaaaaaguacuaugccgauagcgugaaagggcgcuuuaccauaagcagggacaauagcaagaacacgcucuaucuccagaugaauagcuugcgcgcggaagauaccgcgcucuauuacugugccagggacuugcgcgaguacgagugcgaggaaugggccucagacuauuacgauuucgggcgcgaucaaccgugccaggacccgcgcggggucgugggcacguucgauauauggggccagggcacgauggugacagugagcucg

SEQ ID NO: 55519 - RNA, 432 nt, Artificial Sequence
  derived and/or modified sequence opt11 from anti-HIV_cap256-059-098972_VR-Chain
caagugcaauuggucgagagcgggggcggagucgugcaaccgggcaggagcuugcgcuugagcugugccgcgagccaguucacguucucgagcuauggcaugcacugggucaggcaagcgcccgggaaagggcucgaguggguggccucgauaucguucgcgggcaucaaaaagaacuaucgcgauagcgugaaagggcgcuuuaccauaagcagggacaauagcaagaacacgcucuaucuccagaugacgagcuugcgcccggaagauaccgcgcuauauuacugugccaaggacuugcgcggguucgagugcgaggaaugggccucggacuauuacgauuucgggcgcgagcuaccgugccaggacccgcgcggggucgugggcacguucgauauguggggccagggcacgaugguaaccgugagcucg

SEQ ID NO: 55520 - RNA, 432 nt, Artificial Sequence
  derived and/or modified sequence opt11 from anti-HIV_cap256-059-097236_VR-Chain
caagugcaacuggucgagagcgggggcggggucgugcaaccgggcaggagcuugcgcuugagcugugccgcgagcggguucucguucucgaacuuuggcuuucacugggucaggcaagcgcccgggaaagggcucgaguggguggccgcgaucucguucgugggcaauaaaaaguacuaugccgagagcgugaaagggcgcuuuaccauaagcagggaaaauagcaagaacaugcucuuucuccagaugaauagcuugcgcggggaagauaccgcggucuauuacugugccaaggacuugcgcgaguucgagugcgaggaaugggccucggacuauuacgauuucgggcgcgagcaaccgugccaggacccgcgcggggucgugggcucgaucgaugucuggggccauggcucgcucgugaccgugagcucg

SEQ ID NO: 55521 - RNA, 432 nt, Artificial Sequence
  derived and/or modified sequence opt11 from anti-HIV_cap256-059-091487_VR-Chain
caagugcaauuggucgagagcgggggaggggucgugcaaccgggaaggagccugcgcuugagcugugccgcgagccaguucacguucaaucgcuauggcaugcacugggucaggcaagcgcccgggaaagggcucgaguggguggcagugaucucguacgauggaacgaacaaguacuauggcgagagcgugaaagggcgcuucaccauaagcagggacaauagcaagaacacgcucuaucuccagaugaauagcuugcgcgcggaagauaccgcgcucuauuacugugccaaggacuugcgagaggacgagugcgaggaaugguggucggacuauuacgauuucgggcgcgagcuaccgugcaggaaaucgcgcggggucgcgggcauauucgauaucuggggccagggcacgauggugaccgugagcucg

SEQ ID NO: 55522 - RNA, 432 nt, Artificial Sequence
  derived and/or modified sequence opt11 from anti-HIV_cap256-059-089812_VR-Chain
caagugcaauuggucgagagcgggggcggggucgugcaaccgggccggagcuugcgcuugagcugugccgcgagccagcucacguucucgagcuauggcaugcacugggucagacaagcgcccgggaaagggcucgaguggguggccgggaucucguucgcgggcacgaaaaagcacuauagcgauagcgugaaagggcgcuuuaccauaagcagggacaauagcaagaacgcgcucuaucuccagaugaauagcuugcgcgcggaagauaccgcgcuauauuacugugccaaggacuugcgcgaguacgagugcgaggaaugggccucggacuauuacgauuucgggcgcgagcaaccgugccaggacccgcgcggggucgugggcauauucgauauguggggccagggcacgauggugaccgugagcuca

SEQ ID NO: 55523 - RNA, 432 nt, Artificial Sequence
  derived and/or modified sequence opt11 from anti-HIV_cap256-059-088468_VR-Chain
caagugcaauuggucgagagcgggggcggggucgugcaaccgggcaggagcuugcgccugagcugugccgcgagccaguucacguucucgagcuauggcaugcacugggucaggcaagcgcccgggaaagggcucgaguggguggccgcgaucucguucgugggcaucaaaaaguacuaugccaauagcguaaaagggcgcuuuaccauaagcagggacaauagcaagaacacgcucuaucuccagaugaauagcuuacgcgcagaagauaccgcgcucuauuacugugccagggacuugcgagaguacgagugcgaggaaugggccucagacuauuacgauuucgggcgcgggggcccgugccaggacccgcgcgggguagugggcucguucgauauauggggccagggcacgauggugaccgugagcucg

SEQ ID NO: 55524 - RNA, 432 nt, Artificial Sequence
  derived and/or modified sequence opt11 from anti-HIV_cap256-059-088341_VR-Chain
caagugcaauuggucgagagcgggggaggggucgugcaaccgggcaggagcuugcgccugagcugugccgcgagccaguucacguucucgagcuauggcaugcacugggucaggcaagcgcccgggaaagggcucgaguggguggccgcgaucucguucgcgggcaucaaaaagcacuaugccgauagcgugaaagggcgcuuuaccauaagcagggacaauagcaagaacauggucuuucuacagaugaauagcuugcgcgcggaagauaccgcgcucuauuacugugcaagggacuugcgcgaguacgagugcgaggaaugggccucggacuauuacgauuucgggcgcgaucaaccgugccaggacccgcgaggggucgugggcacgagcgauauauggggccagggcacgauggugaccgugagcucg

SEQ ID NO: 55525 - RNA, 432 nt, Artificial Sequence
  derived and/or modified sequence opt11 from anti-HIV_cap256-059-086533_VR-Chain
caagugcucuuggucgagagcgggggcggggucgugcaaccgggcaggagcuugcgcuugagcugugccgcgagccaguucacguucucaaacuuuggcaugcacugggucaggcaagcgcccgggaaagggcuagaguggguggccgggauaucguucguaggcaucaaaaaguacuaugccgggagcgugaaagggcgcuuuaccauaagcagggacaauagcaaaaacacgcucuaucuccagaugaauagcuugcgcgcggaagauaccgcgcucuauuacugugccaaggacuugcgcgaguucgagugcgaggaaugggccucggacuauuacgauuucgggcgcccgcaaccgugccaggacccgcgcggggucgugggcacguucgaccucuggggccugggcacgcucgugaccgugagcucg

SEQ ID NO: 55526 - RNA, 432 nt, Artificial Sequence
  derived and/or modified sequence opt11 from anti-HIV_cap256-059-086043_VR-Chain
gaagugcacuuggucgagagcgggggcgggcucgugaaaccgggcgggagcuugcgccugagcugugccgcgagcggguucacguucucgaccuauagcaugaacugggucaggcaagcgcccgggaaagggcucgaguggguggccuuugucgcguucgaugaaucggacaaguacuaugccgauagcgugaaagggcgcuuuaccauaagcagggacaauagcaagaacacgcucucgcuccagaugaauagcuugcgcguggaagauaccgcgaucuauuacugugccaaggaagugggcgauaacaaggacgaugaaugggcaucggacuauuacgaucucucgaucgcguacccgauccaggacccgcgcgcggucgggcgcggguacgauaucuggggccagggaacgauggugaccgugagcucg

SEQ ID NO: 55527 - RNA, 432 nt, Artificial Sequence
  derived and/or modified sequence opt11 from anti-HIV_cap256-059-084191_VR-Chain
caagugcaacugguagagagcgggggcggggucgugcaaccgggcaggagcuugcgcuugagcugugccgcgagccaguucacguucucgagcuauggcaugcacugggucaggcaagcgcccggaaaagggcucgaguggguggcagcgaucucguucgugggcaucaaaaaguacuaugccgauagcgugaaagggcgcuuuaccgugagcagggacaauagcaagagcacgcucuaucuacagaugaauagcuugcgcgcggaagauaccgcgcuauauuacugugccagagacuugagagaguacgagugcgaggaaugggccucggacuauuacgauuucgggcgcgaucaaccgugccaggacccgcgcggggucgugggcauauucgauauauggggccagggcacggccgugaccgugagcucg

SEQ ID NO: 55528 - RNA, 417 nt, Artificial Sequence
  derived and/or modified sequence opt11 from anti-HIV_cap256-059-082135_VR-Chain
cagguccagcucguggaaucgggcgggggcgugguccagccagggcgcucgcucaggcucucgugcacggccucgggcuuuaccuuucgcucguacgcgauccauugggugcgccaggccccgggcaagggcuuggaaugggucgcgcucauaagcuaugacgggagcaauaaauauuacgcggacucagucaagggcagguucacgaucucgcgcgauaacucgaaaaauaccuuguacuugcaaaugaacucgcuaacgagcgaggacacggccguguacuauugcgcgaaagaucucggaggcucaaaaacggacgagugggggaccgauuacuguuacccgguccaggacccacgcguggucgugggcgcguucgauaucuggggacauggcacgauggugaccgugagcucg

SEQ ID NO: 55529 - RNA, 432 nt, Artificial Sequence
  derived and/or modified sequence opt11 from anti-HIV_cap256-059-079417_VR-Chain
cagguccagcucguggaaucgggcgggggcgugguccagcccggacgcucgcucagacucucaugcgcggccucgggcuuuagcuuuagcaauuacgcgauggauugggugcgccaggccccgggaaagggcuuggaaugggucgcguucgugagcucggacgggaacaacaaaaaguacgcggacucggucaaaggcagguucacgcucucgcgcgauaacuauaaaaauaccguguacuugcaaaugaacucgcucacggucgaggacacggccguguacuauugcgcgaaagaucucggggccaauaaagaugacgagugggggaccgacuacuacgacaugagcgugagcuaucccauacccgaucccagggccguggucggggccuuugacgugugggggcaagggaccuuggucacggucucaagc

SEQ ID NO: 55530 - RNA, 435 nt, Artificial Sequence
  derived and/or modified sequence opt11 from anti-HIV_cap256-059-076027_VR-Chain
cagguccagcucguggaaucaggcgggggcgugguccagcccgggcgcucgcucaggcucucgugcgcggccucgggcuuuagcuuuagcaaguacgggaugcauugggugcgccaggccccgggcaagggauuggaaugggucgcguucguggccuuugacgagagcgagaaauauuacgcggccucggucaagggcagguucacgaucucgcgcgauaacucgaaaaauacccugagcuugcaaaugaacucgcucaggaccgaggacacagccauauacuauugcgcgaaagaggucggggacaauaaagaugacgaguggacgagcccguacuauuacgacaucucgaucgcguacccgguacaugacccgcgcgcggucgugggcgugagcgaugucuggggccagggcacgauggugaccgugagcuca

SEQ ID NO: 55531 - RNA, 432 nt, Artificial Sequence
  derived and/or modified sequence opt11 from anti-HIV_cap256-059-075082_VR-Chain
caagugcaauuggucgagagcgggggcggggucgugcaaccgggcaggagcuugcgccugagcugugccgcgagccaguucacguucucgagcuauggcaugcacugggucaggcaagcgcccgggaaagggcucgaguggguggccgcgaucucguucgugggcaucaaaaaguacuaugccgauagcgugaaagggcgauuuaccauaagcagggacaauagcaagaacacgcucuaucuccagaugaauagcuugcgcgcggaagauaccgcgcucuauuacugugccaaggacuugcgcgagauggagugcgaggaaugggccucggacuauuacgauuucgggcgcgaucucccgugccaggacccgcgcggggucgugggcacgcucgauauauggggccagggcacgauggugaccgugagcucg

SEQ ID NO: 55532 - RNA, 432 nt, Artificial Sequence
  derived and/or modified sequence opt11 from anti-HIV_cap256-059-072575_VR-Chain
caagggcaauuggucgagagcgggggcggggucgugcaaccgggcaggagcuugcgcuugagcugugccgcgagccaguucacguucucgaacuuuggcaugcacugggucaggcaagcgcccgggaaagggcucgaguggguggccgugaucucguacgauggcacgaaaaaguacuaugccgauagcgugaaagggcgcuuuaccauaagcagggacaauagcaagaacacgcucuaucuccagaugaauagcuugcgcgcggaagauaccgcgcucuauuacugugccaaggacaugcgcgaggacgagugcgaggaauggggcgcggacuauuacgauuucgggaaagauuacccgugccaggccucgcgcggggucgugggcauauucgauaucuggggccagggcacgauggugaccgugagcgcg

SEQ ID NO: 55533 - RNA, 432 nt, Artificial Sequence
  derived and/or modified sequence opt11 from anti-HIV_cap256-059-071926_VR-Chain
caagugcaacuggucgagagcgggggcggggucgugcaaccgggcaggagcuugcgcuugagcugugcagcgagccagcucucguucucgaacuauggcaugcacugggucaggcaagcgcccgggaaagggcucgaguggguagccgggaucucguucgugggcaucaaaaaguacuaucgcgauagcgugaaagggcgcuuuaccauaagcagggacaauagcaagaacacgcucuaucuccagaugaauagcuugcgcacggaagauaccgcgcucuauuacugugucaaggacuugcgcgaguucgagugcgaggaaugggccucggacuauuacgauuucgggcgagaucaaccgugcuuagacccgcgcggagucgugggcacguucgauauauggggccagggcacgauggugaccgugagcucg

SEQ ID NO: 55534 - RNA, 432 nt, Artificial Sequence
  derived and/or modified sequence opt11 from anti-HIV_cap256-059-069638_VR-Chain
caagugcaacuggucgagagcgggggcggggucgugcaaccgggcaggagcuugcgcuugagcugugccgcgagcggguucacguucucgaaaaacgccaugcacugggucaggcaagcgcccgggcgcgggcucgaguggguggccucggucgcguucgauggcucggacaaguacuaugccgauagcgugaaagggcgcuuuaccauaagcagggacaauagcaagaacacgcucucgcuacagaugaauagccugcgcgcggaagauaccgcggucuauuacugugccaaggaaguggacuuguacaaggacgaugaauggggcucggacuauuacgaucucucgaucgcguacccgauccaggacccgcgcgcgguagugggcggguucgggaucuggggccagggcacgauggugaccgugaguucg

SEQ ID NO: 55535 - RNA, 432 nt, Artificial Sequence
  derived and/or modified sequence opt11 from anti-HIV_cap256-059-069165_VR-Chain
cucgugcaauuggucgagagcgggggcggggucgugcaaccgggcaggagcuugcgauugagcugugccgcgagcagguucacguucucgaacuauggcaugcacugggucaggcaagcacccgggaaagggcucgaguggguggccgggaucucguucgcgggcacgaccaaguacuaugccgauagcgugcgcgggcgcuuuacaauaagcagggacaauagcaagaacacgcucuaucuccagaugaauagcuugcgcgcggaagauaccgcgcuauauuacugugccaaggacaugcgcgagauggagugcgaggaaugggccucggacuauuacgauuucgggcgaccgcaaccgugccaggacccgcgcggggucgugggcauauucgauaucuggggccagggcacgauggugaccgugagcucg

SEQ ID NO: 55536 - RNA, 432 nt, Artificial Sequence
  derived and/or modified sequence opt11 from anti-HIV_cap256-059-068956_VR-Chain
caaguacaacucgucgaauccggcggcggcgucguccaacccggccgcucccuacgccucuccugcgccgccuccggcuucaccuucuccaccuacgccaugcacuggguccgccaagcccccggccgcggccucgaaugggucgcccucaucuccuacgacggcuccaacaaauacuacgucgacuccgucaaaggccgcuucaccaucucccgcgacaacuccaaaaacacccucuaccuccaaaugaacucccucaccgccgaagacaccgccgucuacuacugcgccaaagaccucggcggcuccaaagacgacgaaugggccaccgacuacuacgaccucucaaucgccuaccccauccaagacccccgagccgucgccggcauauucgacgucuggggccgcggcaccgucgucaccgucuccucc

SEQ ID NO: 55537 - RNA, 432 nt, Artificial Sequence
  derived and/or modified sequence opt11 from anti-HIV_cap256-059-068876_VR-Chain
caagugcaacuggucgagagcgggggcggggucgugcaaccgggcaggagcuugcgcuugagcugugccgcgagccaguucacguucucgagcuacggcaugcacugggucaggcaagcgcccgggaaagggcucgaguggguggccgcgaucucguucgcgggcacgaaaaaguacuaugccaauagcgugaaagggcgcuuuaccauaagcagggacaauagcaagaacacgcucucgcuccagaugaauagcuugcgcggggaagauaccgcgcgcuauuacugugccagggacccgcgcgaguacgagugcgaggaaugggccucggacuacuacgauuucgggcgcgaucaaccgugccaggacccgcgcggggucauuggcauauucgauaucuggggccagggcacgauggugaccgugagcucg

SEQ ID NO: 55538 - RNA, 432 nt, Artificial Sequence
  derived and/or modified sequence opt11 from anti-HIV_cap256-059-067733_VR-Chain
caagugcaauuggucgagagcgggggcggggucgugcaaccgggcaggagcuugcgcuugagcuguaccgcgagccaguucucguucucgagcuauggcaugcacugggucaggcaagcgcccgggaaagggcucgaguggguggccgcgaucucauucgcgggcacgaaaaagaacuaugucgauagcgugaaagggcgcuuuaccauaagcagggacaauagcaagaacacgcucuaucuccagaugaauagcuugcgcgcggacgauaccgcgcucuauuacugugccaaggacaugcgcgaguacgagugcgaggaaugggccucggacuauuacgauuucgggagagaguacccgugcacggacccgcgcggggucgugggcacguucgaugucuggggacagggaacgauggugaccgugagcucg

SEQ ID NO: 55539 - RNA, 432 nt, Artificial Sequence
  derived and/or modified sequence opt11 from anti-HIV_cap256-059-067450_VR-Chain
caagugcaauuggucgagagcgggggcggggucgugcaaccgggcaggagcuugcgcuugagcugugccgcgagccaguucacguucucgaacuauggcaugcacugggucaggcaagcgcccgggaaagggcucgaguggguggccgggaucucguucgcgggcaucaaaaaguacuaugccgauagcgugaaagggcgcuuuaccauaagcagggacaaugccaagaacacgcuauaucuccagaugaauagccugcgcgcggaagauaccgcgcucuauuacugugccaaggacuugcgcgaguacgagugcgaggaaugggccucggacuauuacgauuucgggcgagagcucccgugccaggacccgcgaggggucgugggcacguucgauauauggggccagggaacgauggugaccgugagcucg

SEQ ID NO: 55540 - RNA, 432 nt, Artificial Sequence
  derived and/or modified sequence opt11 from anti-HIV_cap256-059-065694_VR-Chain
caagugcaauuggucgagagcgggggcggggucgugcaaccgggcaggagcuugcgcuugagcugugccgcgagccagcucacguucaauaacuauggcaugcacugggucaggcaaacgcccgggaaagggcucgaguggguggccgggaucucguucgcgggcauaaacaaguacuaugccgauagcgugaaagggcgcuuuaccauaagcagggacaauagcaagaacgcgcucuaucuacagaugacgagcuugcgcgcggaagauaccgcgcucuauuacugugucaaggacuugcgcgagauggagugcgaggaaugggcaucggacuauuacgauuucggacgagaucaaccgugccaggacccgcgcggggucguaggcacguucgauaucuggggccagggcacgauggugaccgugagcucg

SEQ ID NO: 55541 - RNA, 432 nt, Artificial Sequence
  derived and/or modified sequence opt11 from anti-HIV_cap256-059-065109_VR-Chain
caagugcaauuggucgagagcgggggcggggucgugcaaccgggcaagagcuugcgcuuaagcugugccgcgagcggguucacguucacgaacaaugccaugaacugggucaggcaagcgcccgggaaagggcuagaguggguggccuuugucucgagcgauggcagaaacaagaacuaugccgauagcguaaaagggcgcuuuaccauaagcagggacaauagcaagaacacggucuaucuccagaugaauagcuugcgcguggaagauaccgcgcucuauuacugugccaaggacuugggcgcgaacaaggacgaugaaugggccacggacuauuacgaucucucaguagcguacccgaucccggacccgcgcgcggucgugggcgcguucgaugucuggggccagggcacgauggugaccgugagcucg

SEQ ID NO: 55542 - RNA, 432 nt, Artificial Sequence
  derived and/or modified sequence opt11 from anti-HIV_cap256-059-065060_VR-Chain
caagugcaauuggucgagagcgggggaggggucgugcaaccgggcacgagcuugcgcuugaguugugccgcgagcggguucacguucucgaacuaugccaugggcugggucaggcaagcgcccgggaaagggcucgaguggguggccguggucucguacgauggcucgaaaaagagcuaugccgauagcgugaaagggcgauuuaccauaagcagggacaauagcaggaacacgcucuaucuccagcucaauagcuugcgcgcggaagauaccgcgauguuuuacugugccaaggacuugggcaagggcgagaucgaggaaugggccacggacuauuacgauuggucgaaagcguacccgaucgagggcccgcgcgaugucgugggcgcguucgauaccuggggccagggcacgcucgugaccgugagcucg

SEQ ID NO: 55543 - RNA, 432 nt, Artificial Sequence
  derived and/or modified sequence opt11 from anti-HIV_cap256-059-064001_VR-Chain
caagugcaauuggucgagagcgggggcggggucgugcaaccgggcaggagcuugcgcuugagcugugccgcgagccaguucacguucucgaacuauggcaugcacugggucaggcaagcgcccgggaaagggcucgaguggguggccgggaucucguucgcgggcaccaaaaauuacuaugccaagagcgugaaagggcgcuuuacaauaagcagggacaauagcaagaacgcgcucuaucuccagaugaauagcuugcgagcggaagauacagcgcuauauuacugugccaaggacaugcgcgaguacgagugcgaggaaugggccucggacuauuacgauuucgggcgagaucaaccgugccaggacccgcgcggggucgugggcacguucgauaucuggggccagggcacgaugguggccgugagcucg

SEQ ID NO: 55544 - RNA, 432 nt, Artificial Sequence
  derived and/or modified sequence opt11 from anti-HIV_cap256-059-063270_VR-Chain
caagugcaauuggucgagagcgggggcggggucguacaaccgggcaggagcuugcgccugagcugugccgcgagccaguucacguucucgaacuauggcaugcacugggucaggcaagcgcccgggaaagggcucgaguggguggccgcgaucucguucgcgggcacgaaaaagcacuaugccgauagcgugaaagggcgcuuuaccauaagcagggacaauagcaagaacgcgcuauaucuccagaugaauagcuugcgcgcggaagauaccgcgcucuauuacugugccaaggacuugcgcgaguacgagugcgaggaaugggccucggacuauuacgauuucgggcgcgaucaaccgugccuggacccgcgcggggucgugggcauauucgauaucuggggccagggcacgcucgugaccgugagcucg

SEQ ID NO: 55545 - RNA, 432 nt, Artificial Sequence
  derived and/or modified sequence opt11 from anti-HIV_cap256-059-061357_VR-Chain
caagugcaauuggucgagagcgggggaggggucgugcaaccgggcaggagcuugcgcuugagcugugccgcgagcggguucacguucucgaacuuuggcuuucacugggucaggcaagcgcccgggaaagggcucgaguggguggccgggauaucguucgcgggaacgaaaauauacuaugccgauagcgugaaagggcgcuuuaccauaagcagggaaaauagcaagaacaugcucuaucuccagaugaauagcuugcgcggggaagauaccgcggucuauuucugugccaaggacuugcgcgaguucgagugcgaggaaugggccucggacuauuacgauuucgggcgcgaguucccgugccaggacccgcgcggggucgugggcacguucgaugucuggggccauggcgcggucgugaccgugagcucg

SEQ ID NO: 55546 - RNA, 435 nt, Artificial Sequence
  derived and/or modified sequence opt11 from anti-HIV_cap256-059-059834_VR-Chain
caaguccaacucgucgaaucaggcggcggcguaguccaacccggccgcucacuccgccucuccugcgccgccuccggcuucaccuucagcaacuucggcaugcacuggguccgccaagcccccggcaaaggccucgaaugggucgccuucgucgccuucgacgaauccgacaaauacuacgccgccucagucaaaggccgcuucaccgucucccgcgacaacuccaaaaacaccgucucccuccaaaugaacucccucagaaccgaagacaccgccgucuacuacugcgccaaagaagucggcgacaacaaagacgacgaauggaccagccccuacuacuacgacuucuccaucgccuacccaguacacgacccacgcgcagucgucggcggcuacgacgucuggggccaaggcaccauggucaccgucuccuca

SEQ ID NO: 55547 - RNA, 432 nt, Artificial Sequence
  derived and/or modified sequence opt11 from anti-HIV_cap256-059-059313_VR-Chain
caagugcaccuggucgagagcgggggcggggucgugcaaccaggcaagagcuugcgcuugagcugugccgcgagccaguucacguucucgaacuuuggcaugcacugggucaggcaagcgcccgggaaagggcucgaguggguggccgggaucucguucgcgggcacgaaaaaguacuaugccgauagcgugaaagggcgcuuuaccauaagcagggacaauagcaagaacacgcucuaucuccagaugaauagcgugcgcgcggaagauaccgcgcucuauuacugugccaaggacaugcgcgaguacgagugcgaggaaugggccucagacuauuacgauuucgggaaaccgcaaccgugccaggacccgcgcggggucgugggcacguucgauauguggggauugggcacgcucgugaccgugagcuca

SEQ ID NO: 55548 - RNA, 432 nt, Artificial Sequence
  derived and/or modified sequence opt11 from anti-HIV_cap256-059-057130_VR-Chain
caagugcaauuggucgagagcgggggcgggguagugcaaccgggcaggagcuugcgcuugagcugugccgcgagccaguucucguucucgagcuauggcaugcacugggucagacaagcgcccgggaaagggcucgaguggguggccgcgaucucguucgcgggcaucaaaaagcacuaugccgauagcgugaaagggcgcuuuaccauaagcagggacaauagcaagaacacgcucuaucuccagaugaauagcuugcgcguggaagauaccgcgcucuauuacugugcaaaggacuugcgagaguacgagugcgaggaaugggccucggacuauuacgauuucgggcgcccgcaaccgugccaggacccgagaggggucgugggcacgagcgauauauggggccagggcacgauggugaccgugagcucg

SEQ ID NO: 55549 - RNA, 411 nt, Artificial Sequence
  derived and/or modified sequence opt11 from anti-HIV_cap256-059-050520_VR-Chain
cagguccagcucguggaaucgggcgggggcgugguccagcccgggcgcucgcucaggcuaucgugcgcagccucacaauuuaccuuuaacagguacgggaugcauugggugcgacaggccccgggcaagggcuuggaaugggucgcggucauaagcuaugccgauagcgugaaagggcgcuuuaccauaagcagggacaauagcaagaacacgcucuaucuccagaugaacagcuugcgcgcggaagauaccgcgcucuauuacugugccaaggaccugcgcgaggacgagugcgaggaaugguggucggacuauuacgauuucgggcgcgagcucccgugcaggaaaucgcgcggggucgcgggcauauucgauaucuggggccagggcacgauggugaccgugagcucg

SEQ ID NO: 55550 - RNA, 432 nt, Artificial Sequence
  derived and/or modified sequence opt11 from anti-HIV_cap256-059-049839_VR-Chain
caagugcaacuggucgagagcgggggcggggucgugcaaccgggcaggagcuugcgccugaguugugccgcgagcggguucucguucucgaacuaugccauggacugggucaggcaagcgcccgggaaagggcucgaguggguggccguggucucgagcgauggcaagaccaagaacuaugccgauagcgugaaagggcgcuuuaccauaagcagggacaauagcaagaacacggucuaucuccagaugaauagcuugcgcccggaagauaccgcagucuauuacugugccaaggacuugggcgcgaacaaggacgaugaauggaccacggacuauuacgauuggucgguagcguacccggucccggacccgcgcgcggucgugggcgcguucgauguauggggccagggcacgauggugaccgugagcucg

SEQ ID NO: 55551 - RNA, 432 nt, Artificial Sequence
  derived and/or modified sequence opt11 from anti-HIV_cap256-059-048503_VR-Chain
caagugcaauuggucgagagcgggggcggggucgugcaaccgggcaggagcuugcgcuugagcugugccgcgagccagcuaucguucucgaacuauggcaugcacugggucaggcaagcgcccgggaaagggcucgaguggguggccgggaccucguucgcgggcacgaaaaaguacuaugccgauagcgugaaagggcgcuuuaccauaagcagggacaauagcaagaacgcgcucuaucuccagaugaauagcuugcgcgcggaagauaccgcgcucuacuacugugccaaggacuugcgagaguacgagugcgaggaaugggccucggacuauuacgauuucgggcgcgaucaaccgugccaggacccgcgcggggucgugggcacguucgauaucuggggccagggcacgauggugaccgugagcgcg

SEQ ID NO: 55552 - RNA, 432 nt, Artificial Sequence
  derived and/or modified sequence opt11 from anti-HIV_cap256-059-045516_VR-Chain
caagugcaauuggucgagagcggaggcggggucgugcaaccgggcaggagcuugagauugagcugugccgcgagccaguucacguucucgggcuauggcaugcacugggucaggcaagcgcccgggaaagggcucgaguggguggccgcgaucucguucgcgggcaauaaaagguacuuugccgauagcgugaaagggcgcuuuaccauaagcagagacaauagcaagaacacgcucuuucuacagaugaauagcuugcgcgcggaagauaccgcgcucuauuacugugccagggacaugcgagaguacgagugcgaggaaugggccucagacuauuacgauuucgggcgcccgcaaccgugccaggacccgcgcggggucgugggcguguucgauauauggggccagggcacgauggugaccgugagcucg

SEQ ID NO: 55553 - RNA, 432 nt, Artificial Sequence
  derived and/or modified sequence opt11 from anti-HIV_cap256-059-044188_VR-Chain
caagugcaccuggucgagagcgggggcggggucgugcaaccgggcaggagcuugcgcuugagcugugccgcgagccaguucacguucucgagcuauggcaugcacugggucaggcaagcgcccgggaaagggcucgaguggguggccgggaucucguucgcgggcacgaacaaguacuaugccgauagcgugaaagggcgcuuuaccgugagcagggacaauagcaagaacacgcucuauguccagaugaauagcuugcgagcggaagauaccgcgcuauauuacugugccagggacuugcgcgaguacgagugcgaggaaugggcaucggacuauuacgauuucgggcgcgagcaaccgugccaggacccgcgcggggucgugggcauauucgauaucuggggcccgggcacgauggugaccgugagcucg

SEQ ID NO: 55554 - RNA, 435 nt, Artificial Sequence
  derived and/or modified sequence opt11 from anti-HIV_cap256-059-044105_VR-Chain
caaggacaacugguagaaagcgggggcggaguaguacaaccgggaaggagccuaagccuaagcugcgccgcaagcggauucagcuucaacaacuacgcaauggacuggguaaggcaagcgccaggaaaaggacuagaauggguagcaguagucagcagcgacggaaacaacaaaaacuacgcagacagcguaaaaggaagauucacaauaagcagagacaacagcaaaaacacaguauaccuacaaaugaacagccuaagagcagaagacacagcaauauacuacugcgcaaaagacguaggagcaaacaaagacgacgaaugggcaacaaacuacuacuacgacuggagcguggccuacccagugccagacccaagagcaguaauaggagcauucgacguauggggacaagggacaaugguaacagucagcagc

SEQ ID NO: 55555 - RNA, 432 nt, Artificial Sequence
  derived and/or modified sequence opt11 from anti-HIV_cap256-059-042100_VR-Chain
caagugcaauuggucgagagcgggggcggggucgugcaaccgggcaggagccagcgccugagcugugccgcgagccaguucacguucucgagcuauggcaugcacugggucagacaagcgcccgggaaagggcucgaguggguggccgcgaucucguucgcgggcacgaacaaguacuauggcgauagcgugaaagggcgcuuuaccauaagcagggacaauagcaagaacacgcucuaucuccagaugaauagcuugcgcgcggaagauacagcgcucuaucacugugcaagggacaugcgcgaguacgagugcgaggaaugggccucggacuauuacgauuucgggcgcgaucaaccgugccaggacccgcgcggggucgugggcauauucgaucucuggggccagggcacgauggugaccgugagcucg

SEQ ID NO: 55556 - RNA, 432 nt, Artificial Sequence
  derived and/or modified sequence opt11 from anti-HIV_cap256-059-040742_VR-Chain
caagugcaauuggucgagaccgggggcggggucgggcaaccgggcaagagcuugcgcuugagcugugccgcgagcggguucacguucucgaacuuugccauggacugggucaggcaagcgcccgggaaagggcuagaguggguagcauuuaucucgagcgacggcauaaacaagaaauauggagacuucgugaaagggcgcuuuaccauaagcagggacaauagcaagaacacgcucuuucuccagaugaauagcuugcgcgcggaagauaccgcgcucuauuacugugccaaggacgugggcgauuacaagagcgaugaauggggcacggacuauuacgaucucucgaucgaguacccgauccaggacccgcgcgcggucgugggcgcguucgauaacuggggccagggcacgauggugaucgugagcucg

SEQ ID NO: 55557 - RNA, 432 nt, Artificial Sequence
  derived and/or modified sequence opt11 from anti-HIV_cap256-059-040554_VR-Chain
caagugcaauuggucgagagcgggggcggaguaguacaaccgggcaggagcuugcgauugagcugugccgcgagccaguucacguucucgagcuauggcaugcacugggucaggcaagcgcccgggaaagggcuagaguggguggccgggaucucguucgcggccacgaacaaguacuauggcgggagugugaaagggcgcuuuaccauaagcagggacaauagcaagaacacgcucuaucuccagaugaauagccugcgcgcggaagauaccgcgcucuauuacuguaccagggacaugcgcgaguacgagugcgaggaaugggccucggacuauuacgauuucgggaaagaucaaccgugccaggacccgcgcggggucgugggcacgcucgauaucuggggccagggcacgauggugaccgugagcucg

SEQ ID NO: 55558 - RNA, 432 nt, Artificial Sequence
  derived and/or modified sequence opt11 from anti-HIV_cap256-059-039660_VR-Chain
caagugcaacuggucgagagcgggggcggggucgugcaaccgggcaggagcuugcgcuugagcugugccgcgagccaguucucguucucgaacuauggcaugcacugggucaggcaagcgcccggaaaagggcucgaguggguggccucgaucucguucgcgggcacgaaaaagaaauaugccgauagcgugaaagggcgauuuaccauaagcagggacaauagcaagaacacgcucuuucuccagaugaauagccugcgcacggaagaugccgcgcucuauuacugugccaaggacaugcgcgaguucgagugcgaggaaugggccucggacuauuacgauuucgggcgcgagcaaccgugccaggacacgcgcgaugucgugggcauauucgacaucuggggccagggcacgauggugaccgugagcucg

SEQ ID NO: 55559 - RNA, 435 nt, Artificial Sequence
  derived and/or modified sequence opt11 from anti-HIV_cap256-059-039298_VR-Chain
cagguccagcucguggaaucgggcgggggcgugguccagcccgggcgcucgcuaagacucucgugcgcggccucgggcuuuaccuuuagcaaguacgggaugcauugggugcgccaggccccgggcaagggcuuggaaugggucgcguucguggccuuugacgagagcgauaaauauuacgcggccucggccaagggcagguucauaaucucgcgcgauaacagcaaaaauacccugucacugcaaaugaacucgcucagaaccgaggacacggccguguacuauugcgcgaaagaggucggggacaauaaagaugacgaguggacgagcccguacuauuacgauaucucgaucgcguacccgguacaggacccgcgcgcggucgugggcggguacgacgucuggggccagggcacgauggugaccgugagcucg

SEQ ID NO: 55560 - RNA, 432 nt, Artificial Sequence
  derived and/or modified sequence opt11 from anti-HIV_cap256-059-037873_VR-Chain
caagugcaauuggucgagagcgggggcggggucgugcaaccgggcaggagccugcgcuugagcugugccgcgagccaguucacguucucaaacuauggcaugcacugggucaggcaagcgcccgggaaagggcucgaguggguggccgcgaucucguucgcaggcauaaacaaguacuaugccgauagcgugaaagggcgauuuaccuugagcagagacaauaccaagaacacacucuaucuccagaugaauagccugcgcgcggaagauaccgcgcucuauuacugugccagggacuugcgcgaguacgagugcgaggaaugggccucagacuauuacgauuucgggcgcccgcaaccgugccaggacccgcgcggggucgugggcacgagcgauaucuggggccagggcacgauggugaccgugagcucg

SEQ ID NO: 55561 - RNA, 432 nt, Artificial Sequence
  derived and/or modified sequence opt11 from anti-HIV_cap256-059-037633_VR-Chain
caagugcaauuggucgagagcgggggcggggucgugcaaccgggcaggagcuugcgcuuaagcugugccgcgagccaguucacguucucgaacuuuggcaugcacugggucaggcaagcgcccgggaaagggcucgaguggguggccgcgaucucguucgcgggcauaaacaagaacuaugcagauagcgugaaagggcgcuuuaccauaagcagggacaauagcaagaacacgcuccaucuccagcucaauagcuugcgcgcggaagauaccgcgcucuauuacugugccaaggacuugcgcgaguacgagugcgaggaaugggccucagacuauuacgauuucgggcgcgaucaaccgugccaggacccgcgcggggucgugggcacguucgauaucuggggccagggcacgauggugaccgugagcucg

SEQ ID NO: 55562 - RNA, 432 nt, Artificial Sequence
  derived and/or modified sequence opt11 from anti-HIV_cap256-059-036817_VR-Chain
caagugcaauugcucgagagcgggggcggagucgugcaaccgggcaggagcuugcgcuugagcugugaagcgagccaguucacguucucgaacuuuggcaugcacugggucaggcaagcgcccgggaaagggcucgaguggguggccgcgaucucguucgcgggcaucaaaaagaacuacgccgauagcgugaaagggcgcuuuaccauaagcagggacaauagcaagaacacgcucuaucuccagaugaauagcuugcgcguggaagauaccgcgcucuauuacugugccaaggacuugcgcgaguacgagugcgaggaaugggcaucggacuauuacgauuucgggcgcgagcaaccgugccaggacccacgcggggucauaggcacguucgauauauggggccagggcacgauggugaccguaagcucg

SEQ ID NO: 55563 - RNA, 432 nt, Artificial Sequence
  derived and/or modified sequence opt11 from anti-HIV_cap256-059-032787_VR-Chain
caagugcaauuggucgagagcgggggcggagucgugcaaccgggcaggagcuugcgauugagcugugccgcgagcggguucacguucucaaaauaugccaugcacugggucaggcaagcgcccgggaaaggacucgaguggguggccuuugucgcauucgaugaaucggacaaguacuaugucgauagcgugaaagggcgcuuuaccauaagcagggacaauagcaagaacacgcucucacuccagaugaauagccugcgcgcggaagauaccgcggucuacuacugugccaaggaagugcacgugaacaaggacgaugaaugggccucggacuauuacgaucucucgaucgcguacccgauccaggacccgcgcgcggucgugggcgggcucgauaucuggggccagggcacgauggugaccgugagcucg

SEQ ID NO: 55564 - RNA, 432 nt, Artificial Sequence
  derived and/or modified sequence opt11 from anti-HIV_cap256-059-032427_VR-Chain
caagugcaauugguagagagcgggggcggggucgugcaaccgggcaggagccugcgcuugagcugugccgcgagccaguucacguucucgaacuuuggcaugcacugggucaggcaagcgcccgggaaagggcucgaguggguggccgggaucucguucccgggcacgaaaaaguacuaugccgauagcgugaaagggcgcuuuaccauaagcagggacaauagcaagaacgcacucuaucuccagaugaauagcuugcgcgcggaagauaccgcgcucuauuacugugccagggaccugcgcgaguacgagugcgaggaaugggccucggacuauuacgauuucgggaaaccgcaaccgugccuggacccgcgcggggucgugggcacguucgauaucuggggccagggcacgauggugaccgugagcucg

SEQ ID NO: 55565 - RNA, 435 nt, Artificial Sequence
  derived and/or modified sequence opt11 from anti-HIV_cap256-059-029390_VR-Chain
cagguccagcucguggaaucgggcgggggagugguccagcccgggcgcucgcuaaggcucucgugcgcggccucgggcuuuaccuuuaaccagcacgggaugcauugggugcgccaggccccggacaagggcuuggaaugggucgcguucgugggcuuugacgagagcgagaaauauuacgcggacucggucaagggcagguucacgaucucgcgcgauaacucgaaaaauaccuugagccugcaaaugaacucgcucagacccgaggacacggccguguacuauugcgcgaaagaggucggggacaauaaagaggacgagugggcgagcgauuacuauuacgaucucucgaacgcguacccgauccaugacccgcgcgcggucgugggcggguacgauaucuggggccagggcacgaugguaaccguaugcucg

SEQ ID NO: 55566 - RNA, 435 nt, Artificial Sequence
  derived and/or modified sequence opt11 from anti-HIV_cap256-059-027877_VR-Chain
cagguccagcucguggaaucgggcgggggcgugguccagcccgggcgcucgcucaggcucucgugcucggccucggccuuuagcuuuagcuauuucgcgauggauugggugcgccaggccccgggcaagggcuuggaauggguagcauucgugagcucggacgggaacaauaaaaauuacgcggacucggucaagggcagguucacgaucucgcgcgauaacucgaaaaauaccguguucuugcaaauggacucgcucaggcccgaggacacggccguauacuauugcgcgaaagaucucgggggcaauaaagaugacgaguggucgaccaauuacuauuacgauaucucgaucgcggacccggucccggacccgcgcgcggucgcgggcgcguucgaugucuggggccagggcacgauggugaccgugagcucg

SEQ ID NO: 55567 - RNA, 435 nt, Artificial Sequence
  derived and/or modified sequence opt11 from anti-HIV_cap256-059-026640_VR-Chain
cagguccagcucguggaaucgggcgggggcgugguccagcccgggcgaucgcucaggcucucgugcgcggccucgggcuuuagcuuuagcaaguacgggaugcauugggugcgccaggccccgggcaagggcuuggaaugggucgcguucguggccuuugacgagagcgaccgauauuacgcggccucggucaagggcagauucacgaucucacgcgauaacucgaaaaauaccuugagccugcaaaugaacucgcucaggaccgaggacacggccauauacuauugcgcgaaagaggucggggacaauaaagaugacgaguggacgagcccguacuauuacgauaugucgaucgcguacccgguccaggacccgcgcgcggucgugggcggguacgauaucuggggccagggcacgauggugaccgugagcucg

SEQ ID NO: 55568 - RNA, 432 nt, Artificial Sequence
  derived and/or modified sequence opt11 from anti-HIV_cap256-059-026017_VR-Chain
caaguacaacucgucgaauccggcggcggcgucguacaacccggccgcucccuacgccucuccugcgccgccuccggcuucaccuucuccaccuacgccaugcacuggguccgccaagcccccggcaaaggccucgaaugggucgcccucaucuccuacgacggcaccaacaaauacuacgucgacuccgccaaaggccgcuucaccaucucccgcgacaacuccaaaaacacccucuaccuccaaaugaacucacucacccccgaagacaccgccgucuucuacugcgccaaagaccucggcggcuacaaagacgacgaauggggcaccgaauacuacgacaucuccgucuccuaccccguccaagacccccgcgccgucgccggcgucuucgacgucuggggccacggcacaauggucacagucuccucc

SEQ ID NO: 55569 - RNA, 432 nt, Artificial Sequence
  derived and/or modified sequence opt11 from anti-HIV_cap256-059-024100_VR-Chain
ugccagguccuggucgagagcgggggcggagucgugcaaccgggcaggagcuugcgcuugagcugugccgcgagccaguucacguucucgagcuauggaaugcacugggucaggcaagcgccagggaaagggcucgaguggguggccgcgaucucguucgcgggcacgaaaaaguacuaugccgauagcgugaaagggcgcuuugccauaagcagagacacgagcaagaacgcgcucuaucuccagaugaauacccugcgcgcggaagauaccgcgcucuauuacugugccagggacuugcgcgaguucgagugcgaggaaugggccucggacuauuacgauuucgggcgaccgcaaccgugccaggacccgcgcggggucguaggcucauucgauaucuggggccagggcacgauggugaccgugagcuug

SEQ ID NO: 55570 - RNA, 432 nt, Artificial Sequence
  derived and/or modified sequence opt11 from anti-HIV_cap256-059-023966_VR-Chain
caagugcaauuggucgagagugggggcggggucgugcaaccgggcaggagcuugcgcuuaagcugugccgcgagccaguucucguucucgagcuauggcaugcacugggucaggcaagcgcccgggaaagggcucgaguggguggccgcgaucucguucgcgggaaucaaaaagcacuauaccgauagcgugaaaggacgcuuuaccauaagcagggacaauagcaagaacacgcucuaucuccagaugaauagccugcgcgcggaagauaccgcgcucuauuacugugccaaggaccugcgcggguucgagugcgaggaaugggccucggacuauuacgauuucgggcgcgaucaaccgugccaggacccgcgcggggucgugggcacguucgauauauggggccagggcacgcucgugaccgugagcucg

SEQ ID NO: 55571 - RNA, 432 nt, Artificial Sequence
  derived and/or modified sequence opt11 from anti-HIV_cap256-059-020534_VR-Chain
caagugcaauuggucgagagcgggggcggggucgugcaaccgggaaggagcuugcgcuugagcugugccgcgagccaguucacguucucgaacuacggcaugcacugggucaggcaagcgcccgggaaagggcucgaguggguggccgggaugucguucgcgggaacgaacacguacuaugccgauagcgugaaagggcgcuuuacaauaagcagggacaauagcaagaacacgcucuaucuccagaugaauagccugcgcgcggucgauaccgcgcucuauuacugugccagggacaugcgcgaguacgagugcgaggaaugggccucggacuauuacgauuucgggcgcgaguacccgugccaggacccgcgaggggucgugggcauauucgaucucuggggccagggcacgauggugaccguaagcucg

SEQ ID NO: 55572 - RNA, 435 nt, Artificial Sequence
  derived and/or modified sequence opt11 from anti-HIV_cap256-059-019513_VR-Chain
caagugcaacuggucgagagcgggggaggggucgugcaaccgggcaggagcuugcgacugagcugcgccgcgagcggguucacguucucgaacuucgccaugggcugggucaggcaagcgcccgggaaagggcucgaguggguggccgugaucucgagcgacggcacaaacaagaacuacggcgacagcguaaaaggacgcuucaccauaagcagggacaacagcaagaacacccucuuccuccagaugaacagccugcgcgcggaagacacgucgcucuacuacugcgccaaggaccugggcggguacaagaccgacgaaugggccacgaacuacuacuacgacauaagcauagccucacccauacaagaccccagggccguggucggggccuucgacauauggggacaagggacaauggucacagucacaagc

SEQ ID NO: 55573 - RNA, 432 nt, Artificial Sequence
  derived and/or modified sequence opt11 from anti-HIV_cap256-059-012963_VR-Chain
caagugcaauuggucgagagcgggggcggggucgugcaaccgggcaggagcuugcgccugagcugugucgcgagcggguucucguucucgagcuauggcauggccugggucaggcaagcgccagggaaagggcucgagugggugaccgugaucucguucgcgggcgugaaaacguacuaugccgauagcgugaaagggcgauuuaccauaagcagggacaauagcaagggcacgcucuaucuccagauggauggcuugcgcccggaagauaccgcgcucuauuacugugccaaggacuuggccgagcgagagugcgaggaaugggccucggacuauuacgauuucgggcgcgagcucccgugccaggacccgcgcggggucgugggcacguucgaugucuggggccagggcacgauggugaccgugagcucg

SEQ ID NO: 55574 - RNA, 435 nt, Artificial Sequence
  derived and/or modified sequence opt11 from anti-HIV_cap256-059-010396_VR-Chain
caaguccaacucgucgaaucaggaggcggcgucguccaacccggacgcucccuccgccucuccugcgccgccuccggcuucuccuucaacaacuacgccaugaacuggguccgacaagccccaggcaaaggccucgaaugggucgccuucgucuccuccgacggcuccaacaaaaacuacgccgacuccgucaccggccgcuucacccucucccgcgacaacuccaaaaacaccgucuuccuccaaaugaacucccuccgcgucgaagacaccgccgucuacuacugcgccaaagacgucggcgccaacaaagacgacgaauggaccaccaacuacuacuacgacaucuccaucgccgaccccguccccgaccccagagcagucaucggcgcauucgacgucuggggccaaggcaccauggucaccgucuccuca

SEQ ID NO: 55575 - RNA, 432 nt, Artificial Sequence
  derived and/or modified sequence opt11 from anti-HIV_cap256-059-008136_VR-Chain
caaguccaacucgucgaauccggcggcggcgucguccaacccggccgcucacuccgccucuccugcgccgccuccggcuucaccuucaacaccuacgccaugcacuggguccgccaagcccccggcaaaggccucgaaugggucgcacucaucuccuacgacggcaccgaaaaauacuacgccgacucagucaaaggccgauucaccaucucccgagacaacucccgcaacacccucuaccuccaaaugaacucacuccgccucgaagacgccgcccucuaccaaugcgcaaaagaccucggcggaucaaaauccgacgaauggggcaccgacuacuacgacauguccaucuccuaccccauccaagacccccgcgccgucgccggcguauucgacaucuggggccaaggcacccuagucaccgucuccucc

SEQ ID NO: 55576 - RNA, 432 nt, Artificial Sequence
  derived and/or modified sequence opt11 from anti-HIV_cap256-059-006147_VR-Chain
caagugcaaguggucgagagcgggggcggggucgugcaaccgggcaggagcuugcgauugagcuguaccgcgagcggguucacguucucgaacuuugccaugggcugggucaggcaagcgcccgggaaagggcucgaguggguggccuuuaucucgagcgauggcucgaacaagaacuauggcgauagcgugaaagggcgcuuuaccauaagcagggacaauagcaagaacacggucuuucuccagaugaauagcuugcgcguggaagauaccgcacucuauuacugugccaaggacgugggcgauuacaagagcgaugaauggggcacggaauauuacgauaucucgaucucguacccgauccaggacccgcgcgcgauggugggcgcguucgaucucuggggccagggcacgauggugaccgugagcccg

SEQ ID NO: 55577 - RNA, 432 nt, Artificial Sequence
  derived and/or modified sequence opt11 from anti-HIV_cap256-059-005081_VR-Chain
caagugcaacuggucgagagcgggggcggggucgugcaaccgggcaggagcuugcgauugagcugugccgcgagccaguucacguucucgagcuauggcaugcacugggucagacaagcgcccgggaaagggcucgaguggguggccgggaucucguucgcggcaacgaaaaaguacuauagcgagagcgugaaaggacgcuuuaccauaagcagggacaauagcaagaacgcgcuccaucuccauaugaauagcuugcgcgcggaagauaccgcgcucuauuacugugccaaggacuugcgcgaguucgagugcgaggaaugggccucggacuauuacgauuucgggcgcgaucaaccgugccaggacccgcgcggggucgugggcauauucgauauguggggccagggcacgauggugaccgugagcucg

SEQ ID NO: 55578 - RNA, 432 nt, Artificial Sequence
  derived and/or modified sequence opt11 from anti-HIV_cap256-059-005006_VR-Chain
caagcccaacucgucgaauccggcggcggcgucguccaacccgccaaaagccuaagacuaucaugcgccgcauccggcuucaccuucaacaaauacgccaugcacuggguccgacaagcccccggcaaaggccucgaaugggucgccuucgucgccuucgacgaauccgacaaauacuacgccgacucagucaaaggccgcuucaccaucucccgagacaacuccaaaaacacccucucccuacaaaugaacaaccuccgcgccgaagacaccgcagucuacuacugcgccaaagaagucggcgacaacaaagacgacgaaugggccucagacuacuacgaccucagcaucgccuaccccauccaagacccccgagccgucggccgcggcuacgacaucuggggccaaggaaccauggucaccgucuccucc

SEQ ID NO: 55579 - RNA, 432 nt, Artificial Sequence
  derived and/or modified sequence opt11 from anti-HIV_cap256-059-004451_VR-Chain
caaguacacuuggucgagagcggaggcggggucgugcaaccgggcaagagcuugcgcuugagcuguaccgcgagcggguucacguucacgaacuuugccauggacugggucaggcaagcgcccgggaaagggcucgaguggguggccuuuaucucgagcgauggcucgaacaaguacuauagcgagagcgugaaagggcgcuuuaccauaagcagggacaauagcaagaacacgcucuauguacagaugaauagcuugcgcacggaagauaccgcggucuauuacugugccaaggaccugggcggguacaaggacgaugaauggagcacggacuauuacgauuggucgaccgcguacccgguccaggacccgcgcgcggucgcgggcgcguucgaucucuggggccagggcacgauggugagcgugagcucg

SEQ ID NO: 55580 - RNA, 432 nt, Artificial Sequence
  derived and/or modified sequence opt11 from anti-HIV_cap256-059-003571_VR-Chain
caagagcaauuggucgagagcgggggcggggucgugcaaccgggcaggagcuugcgcuugagcugugccgcgagccaguucacguucggggccuauggcaugcacugggucaggcaagcgcccgggaaagggcucgaguggguggccggggucucguucgugggaaauaacaaguacuaugccgauagcgugaaagggcgcuuuaccauaagcagggacaacagcaagaacacgcuauaucuccagaugaauagcuugcgcggggaagauaccgcgcucuauuacugugccagggacaugcgagagauggagugcgaggaaugggccucggacuauuacgauuucgggagaccgcaaccgugccaggacccgcgcggggucgugggcauauucgauauguggggccagggcacgauggugaccgugagcucg

SEQ ID NO: 55581 - RNA, 432 nt, Artificial Sequence
  derived and/or modified sequence opt11 from anti-HIV_cap256-059-003449_VR-Chain
caagugcaauuggucgagagcgggggcggagucgugcaaccgggcaagagcuugcgcuugagcugugccgcgagccaggucacguucucgagcuauggcaugcacugggucaggcaagcgcccgggaaagggcucgaguggguggccgggaucucguucgcgggcacgaaaaaguacuaugccgauagcgugaaagggcgcuuuaccauaagcagggacaauagcaagaacgcgcuauaucuccagaugaaucgcuugcgagcgggagauaccgcgcucuauuacugugccaaggacuugcgcgaguacgagugcgaggaaugggccucggacuauuacgauuucgggcgcgagcaaccgugccaggacccgcgcggggucgugggcauauucgauaucuggggcuugggcacgauggugaccgugagcucg

SEQ ID NO: 55582 - RNA, 432 nt, Artificial Sequence
  derived and/or modified sequence opt11 from anti-HIV_cap256-059-002712_VR-Chain
caagugcaauuggccgagagcgggggcggggucgugcaaccgggaaggagcuugcgcuugagcugugccgcgagccaguucacguucucgagcuauggcaugcacugggucaggcaagcgcccgggaaagggcuagaguggguggcagcgaucucguucgcgggcacgaaaaagcacuaugccgauagcguaaaagggcgcuuuaccauaagcagggacaauagcaagaacacgcucaaucuccagaugaauagcuugcgcgcggaagauaccgcgcucuauuacugugccagggacaugcgcgaguacgagugcgaggucugggccucggacuauuacgauuucgggcgcgagcaaccgugccaggacccgcgcggggucgugggaacguucgauaucuggggccagggcacgauggugaccgugagcccg

SEQ ID NO: 55583 - RNA, 432 nt, Artificial Sequence
  derived and/or modified sequence opt11 from anti-HIV_cap256-059-001573_VR-Chain
caagugcaauuggucgagagcgggggcgggguagugcaaccgggcaggagcuugcgcuugagcugugccgcgagccaguucacguucucgagcuauggcaugcacugggucaggcaagcgcccgggaaagggcucgaguggguggccgggaucucguacgauggaacgagcaaguacuaugccgauagcgugaaagggcgcuuuaccauaagcagagacaauagcaagaacacgcucuaucuacagaugaauagcuugcgcgcggaagauaccgcgcucuauuacugugccaaggacuugcgcgaggacgagugcgaggaaugguggucggacuauuacgauuucgggcgcgagcucccgugcaggaaaucacgcggggucgcgggaacguucgauaucuggggccauggcacgauggugaccgugagcucg

SEQ ID NO: 55584 - RNA, 432 nt, Artificial Sequence
  derived and/or modified sequence opt11 from anti-HIV_cap256-059-001379_VR-Chain
caaguccgccucgucgaauccggcggcggcgucguccaacccggccgcucacuccgccucuccugcgccgccucuggcuucaccuucaacuccuaccccaugcacuggguacgccaagcccccggcaaaggccucgacuggguagcccucaucuccuacgacggcaccaacaaauucuacgucgacuccgucaaaggccgcuucaccaucucacgcgacaacuccaaaaacacacucuaccuccaaaugaacucccucaccgccgaagacaccgccauguacuacugcgccaaagaccucggcggcaacaaagacgacgaauggggaaccgacuacuacgacaucuccgucgccuaccccauccacgacccccgcgccgucgccggcaucuucgacgucuggggccacggcaccauggucaccguauccucc

SEQ ID NO: 55585 - RNA, 432 nt, Artificial Sequence
  derived and/or modified sequence opt11 from anti-HIV_cap256-059-001029_VR-Chain
caagagcaauugguccagagcgggggcggggucgugcaaccgggcaggagccugcgcuugagcugugccccgagccaguucacguucucggcccauggcaugcacugggucaggcaagcgcccgggaaagggcucgaguggguggccgggaucucguucgcgggcacgaaaaauuacuaugccgauagcgugaaagggcgcuuuaccauaagcagggacaauagcaagaacacgcuauaucuccagaugaauagccugcgcguggaagauaccgcgcucuauuacugugccaaggacaugcgcgagauggagugcgaggaaugggccucggacuauuacgauuucgggcgccaucaaccgugccaggacccgcgcggggucgugggcauauucgauaucuggggccagggcacgauggugaccgugagcucg

SEQ ID NO: 55586 - RNA, 432 nt, Artificial Sequence
  derived and/or modified sequence opt11 from anti-HIV_cap256-048-165087_VR-Chain
gaagugaaauugcuagagagcgggggcgggcucgugcaaccgggcggguacaggcgcuugagcugugccgcgagcggguucacguucucgcgauaugcaaugcacugggccaggcaagcgcccgggaaagggcucgaguggguggccguggucucggacgauggcgugaaaaaguacuauccagauagcgugcgcgggcgcuuuaccauaagcagggacaauagcagaaacacggucucgcuccagaugaauagcuugcgcccggaagauaccgcggucuauuacugugccaaggacgugggcgcgaacaaggacgaugaaugggccacggacuauuacgaucucucgauagcguacccggucccggacccgcgcgcggucgugggcgcguucgauaucuggggacagggcacgauggugaccgugagcucg

SEQ ID NO: 55587 - RNA, 432 nt, Artificial Sequence
  derived and/or modified sequence opt11 from anti-HIV_cap256-048-158861_VR-Chain
gaagugcaauuggucgagagcgggggcgggcucgugcaaccgggcgggagcuugcgauugagcugugucgauuucggguucagguucucggaauauuggaugagcugggucaggcaagcgccaggaaaagggcucgaguggguggccgugaucucguacgauggcacgaacaaguacuaugccgauagcgugaaagggcgcuuuaccauaagcagggacaauagcaagaacacgcucuaucuccagaugaauagcuugcgcgcggaagauaccgcgcucuauuacugugccaaggacaugcgcgagagcgagugcgaggaaugggccucggacuauuacgauuucgggaaagauuacccgugccaggacccgcgcggggucgugggcacguucgauaucuggggccagggcacgauggugaccgugagcucg

SEQ ID NO: 55588 - RNA, 435 nt, Artificial Sequence
  derived and/or modified sequence opt11 from anti-HIV_cap256-048-158280_VR-Chain
caagugcaccuagucgagagcgggggcggagucgugcaaccgggcaggagccuacgcauauacugcgccgugagcgaguucacguucaggaacuacgccaugcacugggucaggcucgcacccgggaaagggcuccaguggguggccgugaucucgcacgacggcauaaacgacuacuacgccgacagcgugaaagggcgauucacaauaagcagggacaacagcaagaacacggucucgcuccagaugaacagccugcgcccggaagacaccgcggucuacuacugcgccaaggaccugggcgcgaacaaggacgacgaaugggccacggacuacuacgaccucucgaucgcguacccaguaccggacccaaccgggcccugguucggggccuucgacauaugggggcaaggaaccauggucacggucucgagc

SEQ ID NO: 55589 - RNA, 432 nt, Artificial Sequence
  derived and/or modified sequence opt11 from anti-HIV_cap256-048-157928_VR-Chain
caagugcaauugauggagagcgggggcggggucgugcaaccgggcaggagccugcgauugagcugugccauaagcggguucacguucucgaacuauuggaugagcugggucaggcaagcgcccgggaaagggcucgaguggguggccgugaucucgagcgauggcucgagcaagaacuaugccgauagcgugaaagggcgcuuuaccauaagcagggacaauagcaagaacacggucucgcuacagaugaauagcuugcgcccggaagauaccgcggucuauuacugugccaaggacgugggcgcgaacaaggacgaugaaugggccacggacuauuacgaucucucgaucgcguacccggucccggacccgcgcgcggucgugggcgcguucgauaucuggggccagggcacgauggugaccgugagcucg

SEQ ID NO: 55590 - RNA, 432 nt, Artificial Sequence
  derived and/or modified sequence opt11 from anti-HIV_cap256-048-157056_VR-Chain
caaguccaacucgucgaauccggcggcggcgucguccaacccggccgcucccuccgccuauccugcgccgcauccggcuucacccucuccuccuacgccaugcacuggguccgccaagccccaggcaaaggccucgaauggguagccuucaucuccaacgacggcuccaacaaauacuucgccgacucagucaaaggccgauucaccaucucacgcgacaacuccaaaaacacccuauaccuccaaaugaacucccuccgcgccgaagacaccgccgucuacuacugcgccaaagaccucggaggcaacaaagacgacgaaugggccaccgacuacuacgaccucuccaucgccuaccccguccaagacccccgcguagucgucggcaucuucgacaucuggggccaaggcaccauggucacagucuccagc

SEQ ID NO: 55591 - RNA, 432 nt, Artificial Sequence
  derived and/or modified sequence opt11 from anti-HIV_cap256-048-156422_VR-Chain
caagugcaauuggucgagagcgggggcacggucgugcaaccgggaaggagcuugcgcuugagcugugucgggagcggguucucgcucucguacuaugccauacacugggucaggcaagcgcccgggaaagggcucgaguggguggccgugaucucguacgauggcucgaacuauuacuaugccgauagcgugaaagggcgcuuuacaauaagcagggacaauagcaagaacacggucuaucuccagaugaauagcuugcgcggggucgauaccgcggucuauuacugugccaaggaccugggcgggggcgaggucgaggaaugggccacggacuauuacgauuggucgaucgcguacccgguagagcacccgcgcgcggucgugggcguguucgauaucuggggccagggcacgaaagugaccgugagcucg

SEQ ID NO: 55592 - RNA, 432 nt, Artificial Sequence
  derived and/or modified sequence opt11 from anti-HIV_cap256-048-152863_VR-Chain
gaagugcaacugcucgagagcgggggcgggcucgugcaaccgggcgggagcuugcgcuugagcugugccgggagcggguucacguucucaaaacauggcaugcacugggucaggcaagcgcccgggaaagggcucgaguggguggccuuugucgcguucgaugaaucggacaaguacuaugccgauagcgugaaagggcgcuuuaccauaagcagggacaauagcaagaacacgcucucgcuccagaugaauagccugcgcgcggaagauaccgcgauguauuacugugccaaggaagugggcgauaacaaggacgaugaaugggccucggacuauuacgaucucucgaucgcguacccgguccaugacccgcgcgcggucgugggcggguacgauaucuggggccagggcacgauggugaccgugagcucg

SEQ ID NO: 55593 - RNA, 432 nt, Artificial Sequence
  derived and/or modified sequence opt11 from anti-HIV_cap256-048-152770_VR-Chain
caagugcaauuggucgagagcgggggcggggucgugcaaccaggcaggagcuugcgauugagcugugccgcgagcggguucacguucaggagcaaugcaaugcacugggucaggcaagcgcccgggaaagggcucgaguggguggccgugaucucauacgauggcucgaaaacauacuaugccgauagcgugaaagggcgcuuuaccauaagcagggacaauagcaagaacacgcucuaccuccagaugaauagcuugagagcggaagauaccgcggucuauuacugugccaaggacuugggcgaguacaagagcgaugaaugggccacggacuauuacgaucucucgaucgcguacccgguccaggacccgcgaggggucgcgggcgcguucgauaucuggggccagggcacgauggugaccgugagcucg

SEQ ID NO: 55594 - RNA, 432 nt, Artificial Sequence
  derived and/or modified sequence opt11 from anti-HIV_cap256-048-150027_VR-Chain
gaagugcaauuggucgagagcgggggcgggcucgugcaaccgggcgggagcuugcgcuugagcugugccgugagcggguucacguucucgagcuauaucaugcacugggucaggcaagcgcccgggaaagggcuagaguggguggccgugaucucauacgauggcucgaacaaggacuaugccgauagcgugaaagggcgcuuuacaauaagcagggacaauagcaagaacacgcuauaucuacagaugaauagcuugcgcgcggaagauaccgcgcucuauuacugugccaaggacuugcgcgaguacgagugcgaggaaugggccucggacuauuacgauuucgggcgagauuacccgugccaggacccgcgcggggucgugggcacguucgauauauggggccagggcacgauggugaccgugagcucg

SEQ ID NO: 55595 - RNA, 432 nt, Artificial Sequence
  derived and/or modified sequence opt11 from anti-HIV_cap256-048-148246_VR-Chain
caagugcaauuggucgagagcgggggcggggucgugcaaccgggcaggagcuugcgauugagcugugccacgagcggauucacguucucaaccuauagcaugcacugggucaggcaagcgcccgggaaaggacucgaguggguggcagugaucucguacgauggcucgaacgaguacuaugucgauagcgugaaagggcgcuuuacaauaagcagggacaauagcaagaacacgcucuaucuccagaugaauagcuugcgcguggaagauacagcgcuauauuacugugccaaggacuugggcgggaacaaggacgaugaauggggcacggacuauuacgauuucucggucgcguacccgguccaggacccgcgcgcggucucgggcauauucgaugucuggggccauggcacgauggugaccgugagcucg

SEQ ID NO: 55596 - RNA, 432 nt, Artificial Sequence
  derived and/or modified sequence opt11 from anti-HIV_cap256-048-147428_VR-Chain
caagugcaauuggucgagagcgggggaggggucgugcaaccgggcaggagcuugcgcuugagcuguagcgcgagcggguucacguucucgaacuauggcaugcacugggucaggcaagcgcccgggaaagggcucgaguggguggccgugaucucguucgauggcucaaacaaggucuaugccgauagcgugaaagggcgcuuuaccauaagcagggacaauagcaagaacacacucuaucucgagaugaauagcuugcgcgcggaagauacagcggaauauuacugugccaaggacuugggcgagagcgauaaagaggaauggcccucggacuauuacgauuucgggcgcgauuucacgggccaggucccgcgcgcggucgugggcauauucgauauguggggccagggcacgauggugaccgugagcucg

SEQ ID NO: 55597 - RNA, 432 nt, Artificial Sequence
  derived and/or modified sequence opt11 from anti-HIV_cap256-048-146603_VR-Chain
gaagugcaauugguagagagcgggggcgggcucgugcaaccgggcaggagcuugcgccugagcugugccgcgagcggguucacguucgaugacuaugccauacacugggucaggcaagcgcccgggaaagggcucgaguggguggccuugaucucguacgauggcacggacaaguacuaugccgauagcgugaaagggcgcuuuaccauaagcagggacaauagcaagaacacgcuauaucuacagaugaauagcuugcgcguggaagauaccgcggucuaucacugugccaaggacuugggcgggaccaagagcgaugaaugggccacggacuauuacgaucucucgaucgcguacccgauccaggacccgggcgcggucgugggcguguucgacaucuggggccagggcacgauggugaccgugagcucg

SEQ ID NO: 55598 - RNA, 432 nt, Artificial Sequence
  derived and/or modified sequence opt11 from anti-HIV_cap256-048-145735_VR-Chain
caagugcaauugguccagagcgggggcggggucgugcaaccgggcaggagcuugcgcuugagcuguggagcgagcggguucacguucucgaacuaugccaugcacugggucaggcaagcgcccgggaaagggcuagauuggguggccgugaucucguacgauggcacgaacgagaaccaugccgauagcgugaaagggcgcuuuaccauaagcagagacaauagcaagaacacggucuaucuacagaugaauagcuugcgcgcggaagauaccgcggucuauuacugugccaaggacgugggcgggagcaaggacgaugaaugggccacggacuauuacgaucucucgaucgcguacccggucccggacccgcgagcggucgugggcgcguucgauaucuggggccaaggcacgauggugaccgugagcucg

SEQ ID NO: 55599 - RNA, 432 nt, Artificial Sequence
  derived and/or modified sequence opt11 from anti-HIV_cap256-048-145116_VR-Chain
caagugcacuuggucgagagcgggggcggggucgugcaaccgggcgggagcuugcgacugagcugugccgcgagcggguucacguucucgaacuauggcaugcacugggucaggcaagcgcccgggaaagggcucgaguggguggccgcgaucucguucgcgggcacgaacaaguacuaugccgauagcgugaaagggcgcuuuaccauaagcagggacaauagcaagaacgcgcuauaucuccagaugaauagcuugcgcgcggaagauaccgcgcucuauuacugugccaaggacuugcgcgagagcgagugcgaggaaugggccucggacuauuacgauuucgggcgcgauuacccgugccaggacccgcgaggggucgugggaacgcuagauaucuggggccagggcacgauggugaccgugagcucg

SEQ ID NO: 55600 - RNA, 432 nt, Artificial Sequence
  derived and/or modified sequence opt11 from anti-HIV_cap256-048-144077_VR-Chain
caagugaaauuagucgagagcgggggcggggucgugcaaccgggcaggagcuugcgcuugagcugugccgcgagcggguucacgcucucaagcuacgccaugcacugggucaggcaagcgcccgggaaagggcuagaguggguggccgugaucucguacgauggcucaaacagguacacggccgauagcgugaaagggcgcuuuaccauaagcagggacaauagcaagaacacgcucaaucuccagaugaauagccugcgcccggaagauaccgcggucuauuacugugcaaaggacgugggcgcgaacaaggacgaugaaugggccacggacuauuacgaucucucgaucgcguacccggucccggacccgcgagcggucgugggcgcguucgauaucuggggccagggcacgacagugaccgugagcucg

SEQ ID NO: 55601 - RNA, 432 nt, Artificial Sequence
  derived and/or modified sequence opt11 from anti-HIV_cap256-048-142876_VR-Chain
caagugcaauuggucgagagcgggggcggggucgugcaaccgggcgggagcuugcgcuugagcugugucgcgagcggguucacguucucaaccuauggcaugcacugggucaggcaagcgcccgggaaagggcucgaguggguggccuuuaugagguucgauggcucgaacagguacuauggagauagcgugaaagggagauuuaccauaagcagggacaauagcaagaacacgcucuaucuccagaugaucagcuugcgcgcggaagauaccgcggucuaucacugugccaaggacuugggcgggaacaagcccgaugaaugggccacggacuauuacgaucucucgauagcguacccgguccaggacccgcgagcagucgugggcguguucgauaucuggggccagggcacgaucauaaccgugagcuca

SEQ ID NO: 55602 - RNA, 432 nt, Artificial Sequence
  derived and/or modified sequence opt11 from anti-HIV_cap256-048-140582_VR-Chain
caagugcaauuggucgagagcgggggcggggucgugcaaccgggcaggagcuugcgccugagcugugccgcgagcggguucucguucucgaacuacgccauggacugggucaggcaagcgcccgggaaagggcucgaguggguggccuuugucucgagcgauggcucgaacaagaacuaugccgauagcgugaaagggcgcuuuaccauaagcagggacaauagcaagaacacggucuaucuacagaugaauagccugagaguggaagauaccgcggucuauuacugugccaaggacuugggcgcgaacaaggacgaugaaugggccacggacuauuacgaucuaucggucgcguacccggucccggacccgcgcgcggucgugggcgcguucgaugucuggggccagggcacgauggugaccgugagcuca

SEQ ID NO: 55603 - RNA, 432 nt, Artificial Sequence
  derived and/or modified sequence opt11 from anti-HIV_cap256-048-139355_VR-Chain
caagugcaauugguagagagcgggggcggggucgugcaaccgggcaggagcuugcgcuugagcugugccgcgagcggguucacguucucgagcuaugccaugcacugggucaggcaagcgcccgggaaagggcucgaguggguggccauaaucucguacgauggcucgaacaaguacuaugccgauagcgugaaagggcgcuuuaccauaagcagggacaauagcaagggcacgcucuaucuucagauggauggcccgcgcccggaagauaccgcgcucuauuacugugccaaggacuugggcgagcgcgagugcgaggaaugggccucggacuauuacgauuucgggcgcgauuucccgugccaggacccgcgcggggucgugggcacauucgauaucuggggccagggcacgauggugaccgugagcucg

SEQ ID NO: 55604 - RNA, 432 nt, Artificial Sequence
  derived and/or modified sequence opt11 from anti-HIV_cap256-048-139151_VR-Chain
caagugcaacuggucgagagcgggggcggggucgugcaaccgggcaagagcuugcgcuuaagcugugccgcgagcggguucacguucaauaccuauggcaugcacugggucagacaagcgcccgggaaagggcucgaguggguggccguaaucucguacgauggcucgauccagaaauaugccgauagcgugaaagggcgcuuuaccauaagcagggacaauagcaagaacacgcucuaucuccagaugaauagcuugagcguggaagacaccgcggucuauuacugugccaaggaccugggcaagaacaaggacgaugaaugggccacggacuauuacgauaucucgaucgcauacccggucccggacccgcgcgcggucgugggcguguucgauaucuggggccagggcacggucgugaccgugagcucg

SEQ ID NO: 55605 - RNA, 432 nt, Artificial Sequence
  derived and/or modified sequence opt11 from anti-HIV_cap256-048-137672_VR-Chain
gaagugcaauugguagagagcgggggcggggucgcgcgcccgggcgggagccugcgcuugagcugugccgcgagcggguucauauucacgcacuaugccauggacugggucaggcaagcgcccgggaaagggcucgaguggguggccgugaucucgagcgauggcucgagcaagaacuaugccgauagcguaaaagggcgauuuaccauaagcagggacaauagcaagaacacggucucgcuccagaugaauagcuugcgcccggaagauaccgcggucuauuacugugccaaggacgugggcgcgaacaaggacgaugaaugggccacggacuauuacgaucucucgaucgcguacccggucccggacccgcgcgcggucgugggcgcguucgauaucuggggccagggcacgauggugaccgugagcucg

SEQ ID NO: 55606 - RNA, 432 nt, Artificial Sequence
  derived and/or modified sequence opt11 from anti-HIV_cap256-048-137506_VR-Chain
caagugcgcuuggucgauagcgggggcggggucgugcaaccgggcgggagcuugcgcuugagcugugccgcgagcggguucacguucucgaccuauggcaugcacugggucaggcaagcgcccgggaaagggcucgaguggguggccuuuaucaggagcgauggcucgaacaaguacuaugccgauagcgugcaagggcgcuuuagcauaagcagggacaauagcaagaacacgcucuaucuccagaugaauagcuugcgagcggaagauaccgcggucuauuacugugccaaggacuugggcgagagcgauaaagaggaauggcccucggacuauuacgauuucgggcgcgauuucacgggccaggacccgcgcgcggucgugggcguguucgauaucuggggccagggcacgaccgugaucgugagcucg

SEQ ID NO: 55607 - RNA, 432 nt, Artificial Sequence
  derived and/or modified sequence opt11 from anti-HIV_cap256-048-137270_VR-Chain
caagugcaacugguagagagcgggggcggggucgugcaaccgggcaggagccuacgcuugagcugugccgcgagcggguucacguucucgagcuaugccaugcacugggucagacaagcgcccgggaaaggacucgaguggguggccgugaugucgccagauggcucgaacagauacuauaccgauagcgugaaagggcgauuuaccauaagcagggacaauagcaagaacacgcucucgcuccagaugaauagcuugcgcccggaagauaccgcggucuauuacugugccaaggacgugggcgcgaacaaggacgacgaaugggccacggacuauuacgaucucucgaucgcguacccggucccagacccgcgcgcggucgugggcgcguucgauaucuggggccagggcacgauggugaccguaagcucg

SEQ ID NO: 55608 - RNA, 432 nt, Artificial Sequence
  derived and/or modified sequence opt11 from anti-HIV_cap256-048-135447_VR-Chain
gaagugcagcuagucgagagcgggggcgcgguagugcaaccgggcaggagcuugcgcuugagcuguaccgcgagcggguucucguucacgagcuauaccauacacugggucaggcaagcgcccgggaaagggcucgaguggguggccuuuaucucguacgauggcacggaaaagaaauauaccgauagcgugaaagggcgcuuuaccauaagcagggacaauagcaagaacacgcucucgcuccaaaugaauagcuugcgcccggaagauaccgcggucuauuacugugccaaggacuugggcgcgagcaaggacgaugaaugggccacggacuauuacgauuucucgaucgcguacccgguccaggacccgcgcgcggucgugggcgcguucgauaucuggggccagggcacgauggugaccgugagcucg

SEQ ID NO: 55609 - RNA, 432 nt, Artificial Sequence
  derived and/or modified sequence opt11 from anti-HIV_cap256-048-131966_VR-Chain
caagagcaauuggucgagagcgggggcggggucgugcaaccgggcaggagcuugcgcuugagcugugccgcgagcggguucacguucucgaacuaugccaugcacugggucaggcaagcgcccgggaaagggcuagaguggguggccgcgaugucgcacgauggcucggacaaguacuaugccgauagcgugaaagggcgcuuuaccauaagcagggacaauagcaagaacacgcucuauaugcagaugaauagcuugcgcgcggaagauaccgcggucuauuacugugccaaggaccagggcgagagcgagaaagaggaaugggccucggacuauuacgauuucgggcgcgauuacccgggacaggacccgcgcagggucguggccacguucgcgaucuggggccagggcacgauggugaccgugagcucg

SEQ ID NO: 55610 - RNA, 432 nt, Artificial Sequence
  derived and/or modified sequence opt11 from anti-HIV_cap256-048-131008_VR-Chain
gaagugcgcuuggucgagagcgggggcgggcucgugaaaccgggcgggagcuugcgcuugagcugugccgcgagcggguucacggucucgagcaauuacaugagcugggucaggcaagcgcccgggaaagggcucgaguggguggccgcgaucucguucgcgggcacgaacaaguacuaugccgauagcgugaaagggcgauuuaccauaagcagggacaauagcaagaacgcgcucuaucuccagaugaauagcuugcgcgcggaagauaccgcgcucuauuacugugccaaggaccugcgcgagagcgagugcgaggaaugggccucggacuauuacgauuucgggcgcgauuacccgugccaggacccgcgcggagucgugggcacgcucgauaucuggggccagggcacgauggugaccgugagcucg

SEQ ID NO: 55611 - RNA, 432 nt, Artificial Sequence
  derived and/or modified sequence opt11 from anti-HIV_cap256-048-129369_VR-Chain
caagugcaauuggucgagagcgggggcggggucgugcaaccgggaaggagcuugcgcuugagcugugccgcgagcggguucacguucucgaacuaugucaugcacugggucagacaagcgcccgggaaagggcucgaguggguggccuuggucucguucgauggcucgaacaaguacuaugccgauagcgugaaagggcgcuuuaccauaagcagggacaauagcaagaacacggucuaucuccagaugaauagcuugcgcggggucgauaccgcggucuauuacugugccaaggacuugggcgggggcgaggucgaggaaugggccacggacuauuacgauuggucgaucgcguacccggucgagcacccgcgcgcggucgugggcguguucgauaucuggggccagggcacgaaagugaccgugagcucg

SEQ ID NO: 55612 - RNA, 432 nt, Artificial Sequence
  derived and/or modified sequence opt11 from anti-HIV_cap256-048-128476_VR-Chain
gaagugcaagugcucgagagcgggggcgggcucgugcaaccgggcgggagccugcgccuggccugugccgcgagcggguucucguucucgagcuauggcaugcacugggucaggcaagcgcccgggaaagggcucgagugggugagcuuuaucagguacgauggcgcaaacaaguaccaugccgauagcgugaaagggcgcuuuaucauaagcagggacgauagcaagaacacggucucgcuacagaugaauagcuugcgcccggaagauaccgcggucuauuacugugccaaggacuugggcgcgaacaaggacgaugaaugggccacggacuauuacgaucucucgaucgcguacccggucccggacccgcgcgcggucgugggcgcguucgauaucuggggccagggcacgauggugaccgugagcucg

SEQ ID NO: 55613 - RNA, 432 nt, Artificial Sequence
  derived and/or modified sequence opt11 from anti-HIV_cap256-048-128270_VR-Chain
caaguccaacucgucgaauccggcggcggcgucguccaacccggccgaucccuccgccucucaugcacagccuccggcuucaccuuccgcuccuacgccaugcacuggguccgccaagcccccggcaaaggccuagaaugggucgcccuaaucucauacgacggcuccaacaaauacuacgccgacuccgucaaaggccgcuucaccaucucccgcgacaacucaaaaaacacccucuaccuacaaaugaacucccucacauccgaagacaccgccgucuacuacugcgccaaagaccucggcggcuccaaaaccgacgaauggggcaccgacuacuacgaauucuggaacgccuaccccguccaagacccccgcgucgucgucggcgccuucgacaucuggggccacggcaccaugguaaccgucuccuca

SEQ ID NO: 55614 - RNA, 432 nt, Artificial Sequence
  derived and/or modified sequence opt11 from anti-HIV_cap256-048-126220_VR-Chain
caagugcaauugguagagagcgggggcggggucgugcaaccaggcaggagccugcgccugagcugugccgcgagcggguucauauucucgcccuauggcauacacuggguaaggcaagcgcccggaaaagggcucgaguggguagcccugaucucacacgauggcagcaaaaaguacuacgccgauucagugaaagggcgcuuuaccauaagcagagacaauuucaaggacacgcuauaucuacagaugaauagcuugcgcggggucgauaccgcggucuauuacugugccaaggaccugggcgggggcgaggucgaggaaugggccacagacuauuacgauuggucgaccgcguacccggucgagcacccgcgcgcggucgugggcguguucgauaucuggggccagggaacgaaagugaccgugagcucg

SEQ ID NO: 55615 - RNA, 432 nt, Artificial Sequence
  derived and/or modified sequence opt11 from anti-HIV_cap256-048-125713_VR-Chain
gaagugcaauuggucgagagcgggggcgggcucgugcaaccgggcgggagcuugcgccugagcugugaagcgagcggguucucguucucgaccuaugaauugaacugggucaggcaagcgcccgggaaagggcucgaguggguggccgugaucucguacgauggcucgaacuauuacuaugccgauagcgugaaagggcgcuuuaccauaagcagagacaauagcaagaacacgcucuaucuacagaugaauagcuugcgcgcggaagauaccgcgguauauuacugugccaaggacgugggcgcgaacaaggacgaugaaugggccacggacuauuacgaucucucgaucgcguacccggucccggacccgcgcgcggucgugggcgcguucgauaucuggggacagggcacgaugguaaccgugagcucg

SEQ ID NO: 55616 - RNA, 432 nt, Artificial Sequence
  derived and/or modified sequence opt11 from anti-HIV_cap256-048-123934_VR-Chain
caagugcaauuggucgagagcgggggcggggucgugcaaccgggccgcagcuugagauugagcugugccgcgagcggguucacguucucgagcuauggcauggccugggucaggcaagcgcccgggaaagggcucgagugggugaccgcaaucucguucgcgggcacgaacaaguacuaugccgauagcgugaaaggacgcuuuacaauaagcagggacaauagcaaggacacgcucuaucuccagauggauggcuugcgcccggaagauaccgcgcucuauuacugugccaaggacuugggcgagcgcgagugcgaggaaugggccucggacuauuacgauuucgggcgcgauuucccgggccaggaccagcgcgcggucgcgggaguguucgauauguggggacagggcacgauggugaccgugagcucg

SEQ ID NO: 55617 - RNA, 432 nt, Artificial Sequence
  derived and/or modified sequence opt11 from anti-HIV_cap256-048-122673_VR-Chain
gaagugcaaguggucgagagcgggggcgggcucgugaaaccgggcgggagcuugcgcuugagcugugccgcgagcggauucacguucucgagccaugucaugaacugggucaggcaagcgcccgggaaagggcuagagugggugagcucgaucucaggcgggagcucgaguaaggacuaugccgauagcgugaaagggcgcuucaccauaagcagggacaauagcaagaacacgcucucgcuccagaugaauagccugcgcccggaagauaccgcggucuauuacugugccaaggacgugggcgcgaacaaggacgaugaaugggccacggacuauuacgaucucucgaucgcguacccggucccggacccgcgcgcggucgugggcgcguucgauaucuggggccagggcacgauggugaccgugagcucg

SEQ ID NO: 55618 - RNA, 432 nt, Artificial Sequence
  derived and/or modified sequence opt11 from anti-HIV_cap256-048-122208_VR-Chain
cgcgugcaaguggucgagagcgggggcggggucgugaaaccgggcgggagccugcgcuugagcuguggcgcgagcggguucacguucucgaacgcgugguugagcugggucaggcaagcgcccgggaaagggcucgaguggguggccgugauaucgagcgauggcucgagcaagaacuaugccgauagcgugaaagggcgauuuaccauaagcagggacaauagcaagaacacggucucgcuccagaugaauagcuugcgcccggaagauaccgcggucuauuacugugccaaggacgugggcgcgaacaaggacgaugaaugggccacggacuauuacgaucucucgaucgcguacccggucccggacccgcgcgcggucgugggagcguucgauaucuggggccagggcacgauggugaccgugagcucg

SEQ ID NO: 55619 - RNA, 432 nt, Artificial Sequence
  derived and/or modified sequence opt11 from anti-HIV_cap256-048-121552_VR-Chain
caagugcaauuggucgagagcgggggcggggucgugcaaccgggcgggagcuugcgccugagcugugccgcgagcggguucacguucucgagcuaugccaugcacugggucaggcaagcgccagggaaagggcucaaguggguggcagauaucucguacgaugccucgagcaaguacuaugccgauagcgugaaagggcgcuuuaccauaagcagggacaauagcaagaacacgcuauaucucgagaugaauagcuugcgcccggaagauaccgcggucuauuacugugccaaggacuugggcgagcgcgagugcgaggaaugggccucggacuauuacgauuucgggcgcgauuucccgugccaggacccgcgcggggucgugggcacguucgauaucuggggccagggcacgauggugaccgugagcucg

SEQ ID NO: 55620 - RNA, 432 nt, Artificial Sequence
  derived and/or modified sequence opt11 from anti-HIV_cap256-048-120643_VR-Chain
caagugcaacuggucgagagcgggggcggggucgugcaaccgggcaggagccugcgauugagcugugccgcgagcggguucacgcucucagccuauaccaugcacugggucaggcaagcgcccgggaaagggcucgagugggugagcgugaucucguucgcgggcaauaacaaguacuaugccgauagcgugaaagggcgcuuuaccauaagcagggaaaauagcaagaacaugcuauaucuccagaugaauagcuugcgcggggaagauaccgcggucuauuacugugccaaggacuugcgagaguucgagugcgaggaaugggccucagacuauuacgauuucgggcgcgauuacccgugccaggacccgcgcggggucgugggcacguucgaugucuggggccauggcucgcucgugaccgugaguucg

SEQ ID NO: 55621 - RNA, 432 nt, Artificial Sequence
  derived and/or modified sequence opt11 from anti-HIV_cap256-048-118458_VR-Chain
caagugcaauuggucgagagcgggggcggggucgugcaaccgggcaggagccugcgcuugagcugugccgcgagcggguucacguucucgaccucgggcaugcacugggucaggcaagcgcccgggaaagggcucgaguggguggccuuuaucucgagcgaccgcucgaacaaguucuaugccgauagcgugaaagggcgcuuuagcauaagcagggacaauagcaaguacacgcucuaucuccagaugaauagccugcgcgcggacgauaccgcggucuacuucugugccaaggacuugggcgugaacaagaacgaugaaugggccacggacuauuacgaucucucggucgcguacccgguccaggacccgcgcggggucgcgggcauauucgauaucuggggccagggcacaauggugaccgugagcucg

SEQ ID NO: 55622 - RNA, 432 nt, Artificial Sequence
  derived and/or modified sequence opt11 from anti-HIV_cap256-048-118112_VR-Chain
caagagcaauuggucgagagcgggggcggggucgugcaaccgggcaggagcuugcgccugagcugugccgcgagccaguucacguucucgaacuauggcaugcacugggucaggcaagcgcccgggaaagggcucguauggguggccgggaucucguucgcgggcacgaacaaguacuaugccgcgagcgugaaagggcgcuuuaccauaagcagggacaauagcaagaacacgcucuaucuccagaugaacagcuugcgcgcggaagauaccgcgcucuauuacugugccaaggacaugcgcgaguacgagugcgaggaaugggcaucggacuauuacgauuucgggcgcgauuacccgugccaggacccgcgcggggucgugggaacguucgauaucuggggacagggcacgauggugaccgugagcuca

SEQ ID NO: 55623 - RNA, 432 nt, Artificial Sequence
  derived and/or modified sequence opt11 from anti-HIV_cap256-048-116469_VR-Chain
caagugcaacuggucgagagcgggggcggggucgugcaaccgggcagaagccugcgcuugagcugugccgcgagcggguucacguucucgagcuaugccaugcacugggucaggcaagcgcccgggaaagggcucgaguggguggccauaaucucguacgauggcucgaacaaguacuaugccgauagcgugaaagggcgcuuuaccauaagcagggacaaucccaagaacacgcucuaucuccagaugaauagcuugcgcgcggaagauaccgggcucuauuacugugccaaggacaugggcgagagcgagaaagaggaaugggccucggacuauuacgauuucgggcgcgauuacccgggccaggaaccacgcgcgauggugggcacguucgauaucuggggccagggcacaauggugaccguaagcucg

SEQ ID NO: 55624 - RNA, 432 nt, Artificial Sequence
  derived and/or modified sequence opt11 from anti-HIV_cap256-048-113917_VR-Chain
gaagugcaauuggucgagagcgggggcgggcucgugcaaccgggcgggagcuugcgcuugagcugugccgcgagcgggcuaacggucucggacacguacaugaacuggcucaggcaagcgcccgggaaagggcucgaguggguggccguggucucgagcgauggcucgaacaagaacuaugccgacagcgugaaagggcgcuuuacaauaagcagggacaacagcaagaacacggucuaucuccagaugaauagcuugcgcgcggaagauaccgcggucuauuacugugccaaggacuugggcgcgaacaaggacgaugaaugggccacggacuauuacgaucucucggucgcguacccggucccggacccgagagcggucgugggcgcguucgacgucuggggccagggaacgauggugaccgugagcucg

SEQ ID NO: 55625 - RNA, 432 nt, Artificial Sequence
  derived and/or modified sequence opt11 from anti-HIV_cap256-048-112368_VR-Chain
caaguacaauuggucgagagcgggggcggggucgugcaaccgggcaggagcuugcgcuugagcugugccgcgagcggguucacguucucgcgaaaugccaugcacuggguaaggcaagcgcccgggaaagggcucgaguggguggccgugaucucguacgauggcucgaacaaguacuaugccgauagcgugaaagggcgcuuuaccauaagcagggacaauagcaagaacacgcucuaucuccagaugaauagcuugcgagcggaagauaccgcggucuauuacugugccaaggacuugggcgggggcgaggucgaggaaugggccacggacuauuacgauuggucgacagcguacccggucgagcacccgcgagcggucgugggcguguucgauaucuggggccagggcacgaaagugaccgugagcucg

SEQ ID NO: 55626 - RNA, 432 nt, Artificial Sequence
  derived and/or modified sequence opt11 from anti-HIV_cap256-048-112047_VR-Chain
gaagugcaauuggucgagagcgggggcgggcuagugcaaccgggcgggagcuugcgcuugagcugugccgcgagcgggcucacggucucgggcuauuacaugagcugggucaggcaagcgccagggaaagggcuagagugguuggccuuuauccauuucgauggcucgaaaauacacuaugcagggagcgugaaagggcgaauaacagugagcagggacaauagcaagaacacgcucgaucuccagaugaauagcuugcgcgcggaagauaccgcggucuauuacugugccaaggacgugggcgauagcaagagcgaugaaugggccacggacuauuacgaucucucggucgcguacccggucccggacccgcgcgcggucgugggcgcguucgauaucuggggccagggcacgauggugaccgugaguucg

SEQ ID NO: 55627 - RNA, 432 nt, Artificial Sequence
  derived and/or modified sequence opt11 from anti-HIV_cap256-048-112029_VR-Chain
caagugcaauuggucgagagcgggggcggggucguacaaccgggcaggagcuugcgcuugagcugugccgcgagccaguucacguucucgagcuauggcaugcacugggucaggcaagcgcccgggaaagggcucgaguggguggccgggaucucguucgcgggcaucaaaaaguacuaugccgauagcgugaaagggcgcuuuaccauaagcagggacaauagcaagaacacgcucuaucuccagaugaauagcuugcgaggggaagauaccgcgcucuauuacugugccaaggacuugcgcgaguacgagugcgaggaaugggccucggacuauuacgauuucgggcgcgauuacccgugccaggacccgcgcggggucguaggcauauucgauauauggggccagggcacgauggugaccgugagcucg

SEQ ID NO: 55628 - RNA, 432 nt, Artificial Sequence
  derived and/or modified sequence opt11 from anti-HIV_cap256-048-110957_VR-Chain
caagugcgauuggucgagagcgggggaggggucgugcgcucgggcaggagcuugcgauugagcugugccgcgagcggguucacguucucgaacuuugccuugcacugggucagacaagcgcccgggaaagggcucgaguggguggcagugaucucguacgauggcaauagcaaguucuaugccgauagcgugaaagggcgcuuuacaauaagcacggacaauagcaagaacacgcucuaccuccagaugaauagccugaccgcggaagauaccgcggucuauuacugugccaaggaccugggcgggaacaaggacgacgaauggggcacggacuauuacgauuucucggucgcguacccgguccaggacccgcgcgcggucucgggcauauucgauguauggggccauggcacaauggugaccgugagcucg

SEQ ID NO: 55629 - RNA, 432 nt, Artificial Sequence
  derived and/or modified sequence opt11 from anti-HIV_cap256-048-110526_VR-Chain
caagugcaauuggucgagagcgggggcggggucgugcaaccgggcaggagccugcgcuugagcugugcagcgagcggguucacguucucgaacuuuggcuuucacugggucaggcaagcgcccgggaaagggcucgaguggguggccgcgaucucguucgcgggcaauaacaaguacuaugccgauagcgugaaaggacgcuuuaccauaagcagggaaaauagcaagaacauacucuaucuccagaugaauagcuugcgcggggaagauaccgcggucuauuacugugccaaggacuugcgcgaguucgagugcgaggaaugggccucggacuauuacgauuggucgaccgcguacccggucgagcacccgcgcgcggucgugggcguguucgauaucuggggccagggcacgaaagugaccgugagcuca

SEQ ID NO: 55630 - RNA, 432 nt, Artificial Sequence
  derived and/or modified sequence opt11 from anti-HIV_cap256-048-109336_VR-Chain
gaagugcaauuggucgagagcgggggcgggcucgugcaaccgggcgggagccagcgcuugagcugugccgcgagcgggcuaacggucaauagcaauuacaugaccugggucaggcaagcgcccgggaaagggcucgaguggguggccauaaucucgagcgauggcucgggccaguacuaugcagauagcgugaaaggacgcuuuaccauaagcagggacaauagcaagaacacgcucucgcuccagaugaauagcuugcgcccggaagauaccgcggucuauuacugugccaaggacuugggcgcgagcaaggacgaugaaugggccacggacuauuacgauuucucgaucgcguacccgguccaggacccgcgcgcggucgugggcgcguucgauaucuggggccagggcacgauggugaccgugagcucg

SEQ ID NO: 55631 - RNA, 432 nt, Artificial Sequence
  derived and/or modified sequence opt11 from anti-HIV_cap256-048-108152_VR-Chain
caagcgcaauuggucgagagcggaggcggggucgugcaaccgggaaggagccugguacugagcucggucgcgagcggguucucguucucgaccuaugccaugcacugggucaggcaagcgcccgggaaagggcuagaguggguggccgugaucucauacgauggcgggaacaaguacuaugccgauagcgugaaagggcgcuuuagcauaagcagggacaauagcaagaacacggucuaucuccagaucaauagcuugcgcgcggaagauaccgcggucuauuacugugccaaggaccugggcgcgaacaaggacgaugaaugggccacggacuauuacgaucucucggucgcguacccggucccggacccgcgcgcggucgugggcgcguucgaugucuggggccagggcacgauggugaccgugagcuca

SEQ ID NO: 55632 - RNA, 432 nt, Artificial Sequence
  derived and/or modified sequence opt11 from anti-HIV_cap256-048-107799_VR-Chain
gaagugcaaguagucgagagcgggggcggggucgugcaaccgggcaggagcuugcgcuugagcugugccgcgagcggguucacguucucgaacuaugccauggacuggguaaggcaagcgcccgggaaagggcucgaguggguggccuuugucucaagcgauggcucgaacaagaacuaugccgauagcgugaaagggcgcuuuacaauaagcagggacaauagcaagaacacgcuaucgcuccagaugaauagcuugcgcgcggaagauaccgcggucuauuacugugccaaggaagugggcgagaacaaggacgaugaaugggccucggacuauuacgaucucucgaucgcguacccgauccaugacccgcgagcggucgugggcggguucgauaucuggggccagggaacgauggugacagugagcucg

SEQ ID NO: 55633 - RNA, 432 nt, Artificial Sequence
  derived and/or modified sequence opt11 from anti-HIV_cap256-048-107384_VR-Chain
gaagugcgcuuggucgagagcgggggcgcgcucgugaaaccgggcacgagcuugcgcuuaagcugugccgcaagcggguucacguucacgcacuaugccauggacugggucaggcaagcgcccgggaaagggcucgaguggguggcaauaaucucgagcgauggcucgaccaagaacuaugcagauagcgugaaagggcgcuuuaccauaagcagggacaauagcaagaacacgcucucgcuccagaugaauagccugcgcccggaagauacagcggucuauuacugugccaaggacgugggcgcgaacaaggacgaugaaugggccacggacuauuacgaucucucgaucgcguacccggucccggacccgcgagcggucgugggcgcguucgacaucuggggccagggcacgauggugaccgugagcucg

SEQ ID NO: 55634 - RNA, 432 nt, Artificial Sequence
  derived and/or modified sequence opt11 from anti-HIV_cap256-048-106530_VR-Chain
gaagugcaauugcuagagagcgggggcgggcucgugcaaccgggcgggagcuugcgcuugagcugugccgcgagcggguucacguucucgaguuaugccauggacugggucaggcaagcgcccgggaaagggcucgaguggguggcagugaucucgagcgauggcucaaacaagaacuaugccgauagcgugaaagggcgcuuuaccauaagcagggacaauagcaagaacacgcucuaucuccagaugucgagcuugcgcccggaagauaccgcggucuauuacugugccaaggacgugggcgauagcaagagcgaugaaugggccacggacuauuacgauuucucgaucgcguacccgauccaggacccgcgcgcggucgugggcgcguucgauaucuggggccagggcacgauggugaccgugagcucg

SEQ ID NO: 55635 - RNA, 432 nt, Artificial Sequence
  derived and/or modified sequence opt11 from anti-HIV_cap256-048-106464_VR-Chain
gaagugcaaaugguccagagcgggggcgggcucgugcaaccgggcgggagcuugcgcuugagcugugccgcguucggguucacguucacgaaccaugccauggacugggucaggcaagugcccgggaaagggcucgaguggguggccuuuaucucgagcgauggcucgaacaagaacuaugccgauagcgugaaagggcgcuuuaccauaagcagggacaauagcaagaacacggucuaucuccagaugagcucauugcgcccggaagauaccgcggucuauuacugugccaaggacgugggcgauagcaagagcgaugaaugggccacggacuauuacgaucucucggucgcauacccggucccggacccgagagcggucgugggcgcguucgauaucuggggccagggcacgauggugaccgugagcucg

SEQ ID NO: 55636 - RNA, 432 nt, Artificial Sequence
  derived and/or modified sequence opt11 from anti-HIV_cap256-048-106411_VR-Chain
caagugcaauuggucgagagcgggggcggggucgugcaaccgggcaggagcuugcgccugagcugugccgcgagcggguucacguucucguacucgggcaugcacugggucaggcaagcgcccgggaaagggauggaguggguggcaguaaucucguacgauggcucgaacaaguacuaugccgauagcgugaaagggcgcuuuaccauaagcagggacaacagcaagaacacgcucuaucuccagaugaauagcuugcgcguggaagauaccgcggucuaucacugugccaaggacuugggcgggaccaagagcgaugaaugggccacggacuauuacgaucucucgaucgcguacccgauccaggacccgggcgcggucgugggcguguucgauaucuggggccagggcacgauggugaccgugagcucg

SEQ ID NO: 55637 - RNA, 432 nt, Artificial Sequence
  derived and/or modified sequence opt11 from anti-HIV_cap256-048-106306_VR-Chain
gaagugcaauuggucgagagcgggggcggacucgugcaaccgggcgggagcuugcgcuugagcugugaagcgagcggguucacguucaauaacuauggaauggucugggucaggcaagcgcccgggaaagggcucgaguggguggccauaaucucguacgauggcacggaaaaguacuaugucgauagcgugaaagggcgcuuuaccauaagcagggacaauagcaagaacacgcucucgcuacagaugaauagcuugcgcgcggaagauaccgcggucuauuacugugccaaggaagugggagagaacaaggacgaugaaugggcaucagacuauuacgaucucucgaucgcguacccgauccaugacccgcgcgcggucgugggcggguucgauaucuggggccagggcacgauggugaccgugagcucg

SEQ ID NO: 55638 - RNA, 432 nt, Artificial Sequence
  derived and/or modified sequence opt11 from anti-HIV_cap256-048-104496_VR-Chain
caagugcaauuggucgagagcgggggcgggcucgugaaaccgggcgggagccugcgcuugagcugugccgcgagcggguucacguucucgagcuauggcaugcacugggucaggcaagcgcccgggaaagggcucgaguggguggccuuugucucaagcgauggcaauaauaagaacuaugccgauagcgugaaagggcgcuuuaccauaagcagggacaauagcaagaacacggucuaucuccagaugaauagcuugcgcguggaagauaccgcggucuauuacugugccaaggacuugggcgcgaacaaggacgaugaaugggccacggacuauuacgaucuaucggucgcguacccggucccggacccgcgcgcggucgugggcgcguucgaugucuggggccagggcacgauggugaccgugagcucg

SEQ ID NO: 55639 - RNA, 432 nt, Artificial Sequence
  derived and/or modified sequence opt11 from anti-HIV_cap256-048-103074_VR-Chain
caagugcacuuggucgagagcggggccggggucgugcaaccgggcgggagccugcgcuugagcugugccgugagcggguucacguucaauagcuauggcaugcacugggucaggcaagcgcccgggaaagggcucgaguggguggccgugaucucguacgauggcucggacaaguacuaugcagauagcgugaaagggcgcuuuaccauaagcagggacucgagcaagaacacgcucuaucuccagaugaauagcuugcgcguggaagauaccgcggucuauuacugugcaaaggacuugggcgcaaacaaggacgaugaaugggccacggacuauuacgaucucucggucgcguacccggucccggacccgcgcgcggucgugggcgcguucgaugucuggggccagggcacgauggugaccgugagcucg

SEQ ID NO: 55640 - RNA, 432 nt, Artificial Sequence
  derived and/or modified sequence opt11 from anti-HIV_cap256-048-100832_VR-Chain
caagugcaacuggucgagagcgggggcggggucgugcaaccgggcaggagcuugcgcuugagcugugccgcgagcggguucacguucucgagcuauggcaugcacugggucaggcaagcgcccgggaaagggcucgaguggguggccguggucucgagcgauggcacgaacaagaacuauggcgauagcgugaaagggcgcuuuaccauaagcagggacaauagcaggaacacggucuaucuccagaugucgagcuugcgcccggaagauaccgcggucuauuacugugccaaggacgugggcgauaccaagagcgaugaaugggccacggacuauuacgauuucucgaucgcguacccgguccaggacccacgcgcggucgugggcgcguucgauaucuggggacagggcacgauggugaccgugagcucg

SEQ ID NO: 55641 - RNA, 432 nt, Artificial Sequence
  derived and/or modified sequence opt11 from anti-HIV_cap256-048-100188_VR-Chain
caagugcaccuggucgagagcgggggcggggucgugcaaccgggcaggagcuugcgaauauacugugccgugagcgaguucacguucaggaacuaugccaugcacugggucaggcuagcgcccgggaaagggcuccaguggguggccgugaucucguacaauggcgggaaaaaguacuaugccgauagcgugaaagggcgcuuuacaauaagcagggacaauagcaagaacgcgcucuaucuccagaugaauagccugcgagcggaagauaccgggcucuauuacugugccaaggacuugcgagaguucgagugcgaggaaugggccucggacuauuacgauuucgggcgcgaguacccgugccaggacccgcgaggggucgugggcacguucgauaucuggggccagggcacgauggugaccgugagcucg

SEQ ID NO: 55642 - RNA, 432 nt, Artificial Sequence
  derived and/or modified sequence opt11 from anti-HIV_cap256-048-099645_VR-Chain
caaguccaacucgucgaauccggcggcggcguaguccaacccggccgcucacuccgccucuccugcgccgcauccggcuucaccuucucccgauacgcccuccacuggguccgccaagcccccggcaaaggacucgaaugggucgccgucaucuccuacgacggcagcuccaaauacuacgccgacuccgucaaaggccgcuucuccaucucccgcgacaacuccaaauacacccucuaccuccaaaugaacucccuccgcgccgacgacacagccgucuacuucugcgccaaagaccucggcgucaacaaaaacgacgaaugggccaccgacuacuacgaccucucagucgccuaccccguccaagacccccgcggcgucgccggcaucuucgacaucuggggccaaggcaccauggucaccgucucaucc

SEQ ID NO: 55643 - RNA, 432 nt, Artificial Sequence
  derived and/or modified sequence opt11 from anti-HIV_cap256-048-098137_VR-Chain
caagugcaauuggucgagagcggaggcggagucgugcaaccgggcaggagccugcgcuugagcugugccgcgagcggguucacgcucaggaacuaugccaugcacugggucaggcaagcgccagggaaagggcucgaguggguggccguaaucucgagcgauggcaauaacaaguacuaugccgauagcgugaaagggcgcuuuaccgugagcagagacaauagcaaggacacgcuauaucuccagaugaauaguuugcgcccggaagauaccgcgcucuauuacugugccaaggaccugggcgagcgcgagugcgaggaaugggccucgaacuauuacgauuucgggcgcgauuacccgugccaggacccgcgcggggucgugggcacguucgauaucuggggccagggcacgauggugaccgugagcuca

SEQ ID NO: 55644 - RNA, 432 nt, Artificial Sequence
  derived and/or modified sequence opt11 from anti-HIV_cap256-048-097878_VR-Chain
caagugcaauugcucgagagcgggggcgggguagugcaaccgggcaagagcuugcgcuugagcugugccgcgagcggguucacguucaauaccuauggcaugcacugggucagacaagcgcccgggaaagggcuccaguggguggccgugaucucguacgauggcacgauccagaaauaugccgauagcgugaaagggcgcuuuacaauaagcagggaaaauagcaagaacaugcucuaucuccagaugaauagcuugcgaggggaagauaccgcggucuauuacugugccaaggacuugcgcgaguucgagugcgaggaaugggccucggacuauuacgauuucgggcgcgauuacccgugccaggacccacgaggggucgugggcacguucgaugucuggggccauggcucgcucgugaccgugagcucg

SEQ ID NO: 55645 - RNA, 432 nt, Artificial Sequence
  derived and/or modified sequence opt11 from anti-HIV_cap256-048-097510_VR-Chain
caagugcaauuggucgagagcgggggcggggucgugcaaccgggcaggagcuugugguugagcugugccgcgagcgaguucacgcucaggagcuauggcaugcacugggucaggcaagcgcccgggaaagggcucgaguggguggccuuugucgcguucgaugaaucggacaaguacuaugccgacagcgugaaagggcgcuuuaccauaagcagggacaauagcaagaacacgcuaucgcuccagaugaauagcuugcgcgcggaagauaccgcggucuauuacugugccaaggaagugggcgauaacaaggacgaugaaugggccucggacuauuacgaucucucgaucgcguacccgguccaugacccgcgcgcggucgugggaggguucgauaucuggggccagggaacgauggugaccgugagcucg

SEQ ID NO: 55646 - RNA, 432 nt, Artificial Sequence
  derived and/or modified sequence opt11 from anti-HIV_cap256-048-097313_VR-Chain
caagugcaauuggucgagagcgggggcgggcucgugcaaccgggcggggcccugcgcuugagcugucucgugagcggguucacguucgaugacuaugccuugcacugggucaggcaagcgcccgggaaagggcccgaguggguggccgugcucucgagcgauggcucguacaaguacuauaccgagagcgugcaagggcgcuuuaccauaagcagggacaauagcaagaacacgguauaucuccagaugaauagcuugagaggggucgauaccgcggucuauuacugugccaaggacuugggcgggggcgaggucgaggaaugggccacggacuauuacgauuggucgaucgcguacccggucgagcacccgcgcgcggucgugggcguguucgauaucuggggccagggcacgaaagugaccgugagcucg

SEQ ID NO: 55647 - RNA, 432 nt, Artificial Sequence
  derived and/or modified sequence opt11 from anti-HIV_cap256-048-096626_VR-Chain
gaaguccaacucgucgaauccggcggcggccucguccaacccggcgaaucccuacgccucuccugcgccggcuccggcuucaccuucuccuccuacuggauguccuggguccgccaagcccccggaaaaggccucgaauggauggcccucaucuccuacgacggcuccaacaaauacuacguagacuccguaaaaggccgcuucaccaucucccgcgacaacuccaaaaacacccucuaccuccaaaugaacucacuccgcgccgaagacaccgccgucuacuacugcgccaaagaccucggcggcaacaaagacgacgaaugggccaccgacuacuacgaccucuccaucgccuaccccguccaagacccccgcgucgucgucggcaucuucgacaucuggggccaaggcaccauggucaccgucuccucc

SEQ ID NO: 55648 - RNA, 432 nt, Artificial Sequence
  derived and/or modified sequence opt11 from anti-HIV_cap256-048-096483_VR-Chain
gaagugcaauuggucgagagcgggggcggacucgugcaaccgggcaggagcuugcgcuugagcugugccgcgagcggguucucguucgaggacuaugccaugcacugggucaggcaagcgcccgggaaagggcucgaguggguggccgggaucucguucgcgggcacgaaaaaguacuaugccgauagcgugaaagggcgcuuuaccauaagcagggacaauagcaagaacgcgcucuaucuccagaugaauagcuugcgcgcagaagauaccgcgcucuauuacugugccaaggacuugcgcgaguacgagugcgaggaaugggccucggacuauuacgauuucgggcgcgauuacccgugccaggacccgcgcggggucgugggcacguucgauaucuggggccagggaacgauggugaccgugagcucg

SEQ ID NO: 55649 - RNA, 432 nt, Artificial Sequence
  derived and/or modified sequence opt11 from anti-HIV_cap256-048-095691_VR-Chain
caagugcaauuggucgagagcgggggcggggucgugcaaccgggcaggagccugcgcuugagcugugccgcgagcggguucacguucucaagcuauggcauggccugggucaggcaagcgcccgggaaagggcucgagugggugaccgcgaucucguucgcgggcacgaacaaguacuaugccgauagcgugaaagggcgcuuuaccauaagcagggacaauagcaaggacacgcucuaucuccagauggauggccugcgcccggaagauaccgcgcucuauuacugugccaaggacuugggcgagcgcgagugcgaggaaugggccucgaacuauuacgauuucgggcgcgauuacccgugccaggacccgcgcggggucgugggcacguucgauaucuggggccagggcacgauggugaccgugagcucg

SEQ ID NO: 55650 - RNA, 432 nt, Artificial Sequence
  derived and/or modified sequence opt11 from anti-HIV_cap256-048-095525_VR-Chain
caagugcaacugguccagagcgggggcucagucgugcaaccgggcaagagcuugcgccugagcugugccgcgagcggguucacguucucgagcuuuggcaugcacugggucaggcaaacgcccgggaaagggcucgaguggguggccgugaucucguacgauggcucggaaaagagcuaugccgauagcgugaaagggcgcuuuaccauaagcagggacaauagcaagaacacgcucuaucuccagaugaauagcuugcgcgcggaagauaccgcggucuauuacugugccaaggacuugggcgggaccaaggacgaugaaugggccacggacuauuacgacaucucgaucgcguacccgguccaggacccgcgcgcggucgcgggcgcguucgauaucuggggccagggcacgauggugaccgugagcuca

SEQ ID NO: 55651 - RNA, 432 nt, Artificial Sequence
  derived and/or modified sequence opt11 from anti-HIV_cap256-048-094783_VR-Chain
gaggugcaguugguggagagcgggggggggcugguaaagccgggagggagcuugagguugagcugugcggcgagcgggauaacguucaguacguaugagaugaacugggugaggcaggcgccggggaaggggauggaguggguggcggugauaaguuacgauggaaguaacaaguacuaugcggauagcgugaaggggagguuuacgauaagcagggacaauagcaagaacacgguguaucugcagaugaauagcuugagggggguggauacggcgguguauuacugugcgaaggacuugggggggggggagguggaggagugggcgacggacuauuacgauuggaguauagcguacccgguggagcacccgagagcggugguggggguguucgauauaugggggcaggggacgaaggugacggugaguagu

SEQ ID NO: 55652 - RNA, 432 nt, Artificial Sequence
  derived and/or modified sequence opt11 from anti-HIV_cap256-048-094356_VR-Chain
caaguccaacucguagaaucuggcggcggugucguccaacccggccgcucccuacgccucuccugcgccgccucuggcuucaucuucacccacuacgccauggacuggguccgccaagcccccggcaaaggccucgaaugggucgccgucaucuccuccgacggcuccuccaaaaacuacgccgacuccgucaaaggccgcuucaccaucucccgcgacaacucuaaaaacaccgucucccuccaaaugaacucccuccgccccgaagacaccgccguauacuacugcgccaaagacgucggcgacaacaaauccgacgaaugggccaccgacuauuacgacuucuccaucgccuacccaguccccgacccccgcgccgucgucggcgccuucgaccucuggggccaaggcaccauggucaccgucuccucc

SEQ ID NO: 55653 - RNA, 432 nt, Artificial Sequence
  derived and/or modified sequence opt11 from anti-HIV_cap256-048-090756_VR-Chain
caagugcaauuggucgagagcgggggcgggguagugcgcccgggcaggagcuugcgcuugagcugugcagugagcggguucacguucucgaacuaugccauacacugggucaggcaagcgcccgggaaagggcucgaguggguggccgugaucucguacgauggcucggacaaguacuaugccgauagcgugaaagggcgcuuuaccauaagcagggaaaauagcaagaacaugcucuaucuccagaugaauagcuugcgcggggaagauaccgcggucuauuacugugccaaggaccugcgcgaguucgagugcgaggaaugggccucggacuauuacgauuucgggcgcgauuacccgugccaggacccgcgcggggucgugggcacguucgaugucuggggccauggcucgcucgugaccgugagcucg

SEQ ID NO: 55654 - RNA, 432 nt, Artificial Sequence
  derived and/or modified sequence opt11 from anti-HIV_cap256-048-089065_VR-Chain
caaguccaacucgucgaauccggaggcggcgucguccaacccggccgcucccuccgacucucaugcgccgccuccggcuucaccuucuccaccuacgcaaugcacuggguccgccaagcccccggcaaaggacucgaauggguagcccucaucuccuacgacggcaccaacaaauacuacgucgacucagucaaaggccgcuucaccaucucacgcgacaacuccaaaaacacccuauaccuccaaaugaacucacucaccgccgaagacaccgccguauacuacugcgcaaaagaccucggcggcaacaaagacgacgaauggggcaccgacuacuacgacuucuccgucgccuaccccguccaagacccacgcgccgucuccggcaucuucgacgucuggggccacggcaccauggucaccgucuccucc

SEQ ID NO: 55655 - RNA, 432 nt, Artificial Sequence
  derived and/or modified sequence opt11 from anti-HIV_cap256-048-084986_VR-Chain
caaguccaacucgucgaauccggcggaggcgucguccaacccggccgcucccuacgccucuccugcgccgccuccggcuucaccuucuccgacuacgccaugcacuggguccgccaagcccccggcaaaggacucgaaugggucgcccucaucuccuacgacggcuccaacaaauacuacgccgacuccgucaaaggccgcuucaccaucucacgcgacaacuccaaaaacacccucuaccuacaaauguccucccucaccgccgaagacaccgccgucuacuacugcgccaaagaccucggcggcaacaaaaacgacgaaugggccaccgacuacuacgaccuauccaucgccuaccccauccacgacccccgcgccguccucggcgccuucgacgucuggggccaaggcaccaugcucaccgucuccucc

SEQ ID NO: 55656 - RNA, 432 nt, Artificial Sequence
  derived and/or modified sequence opt11 from anti-HIV_cap256-048-083355_VR-Chain
caagugcaauuggucgagagcgggggcggggucgugcaaccgggccgcagcuugagauugagcugugccgugagcggguucauauucucgagcuaugccaugcgcugggucaggcaagcgcccggaaaagggcucgaguggguggcagugaucucguacgauggcucgaaaacgaacuaugccgauagcgugaaagggcgcuuuaccauaagcagggacaauagcaagaacacgcucuaucuccagaugaauagcuugaccucggaagauaccgcggucuauuacugugccaaggacuugggcgggagcaagaccgaugaauggggcacggacuauuacgaguucuggaacgcguacccgguccaggacccgcgcguggucgugggcgcguucgauaucuggggccauggcacgauggugaccguaagcucg

SEQ ID NO: 55657 - RNA, 432 nt, Artificial Sequence
  derived and/or modified sequence opt11 from anti-HIV_cap256-048-082462_VR-Chain
caagugcaccuggucgagagcgggggcggggucgugcaaccgggcaagagcuugcgauugagcuguaccgcgagcagguucauauucaggaacuaugccauggacugggucaggcaagcgcccgggaaaggacucgaguggguggccgugaucucguacgauggcgugaaagagcacuaugccgagagcgugaaagggcgcuuuaccauaagcagggacaauagcaagaacacggucuaucuccagaugaauagcuugcgcguggaagauaccgcggucuauuacugugccaaggaccugggcgcgaacaaggacgaugaaugggccacggacuauuacgaucucucggucgcguacccggucccggacccgcgcgcggucgugggagcguucgaugucuggggccagggcacgauggugaccgugagcucg

SEQ ID NO: 55658 - RNA, 432 nt, Artificial Sequence
  derived and/or modified sequence opt11 from anti-HIV_cap256-048-082246_VR-Chain
caagugcacuuggucgagagcgggggcggggucgugcaaccgggaaggagcuugcgaauaagcugugccgcgagcggguucacguucucgaaaaaugccaugcacugggucaggcaagcgcccgggaaagggcucgaauggguggccuuugucgcguucgaugaaucggacaaguacuaugccgauagcgugaaagggcgcuuuaccauaagcagggacaauagcaagaacauacucucgcuccagaugaauagcuugcgagcggaagauaccgcggucuauuacugugcaaaggaaguggacgaguacaaggacgaugaaugggccucggacuauuacgaccucucaauagcguacccggucagggacccgcgcgcggucgugggcggguucgauaucuggggccagggcacgauggugaccgugagcgcg

SEQ ID NO: 55659 - RNA, 432 nt, Artificial Sequence
  derived and/or modified sequence opt11 from anti-HIV_cap256-048-080752_VR-Chain
caagugcaauuggucgagagcgggggcggggucgugcaaccgggcgggagcuugcgacugagcugugccgcgagcggauucacguucucgaacuauggcaugcacugggucaggcaagcgcccgggaaagggcucgaguggguggccuuuaucagguacgauggcgauaucacguacuaugucgauagcgugaaagggcgcuuuaccauaagcagggacaauagcaagaacgcgcucuaucuccagaugaauagcuugcgcgcggaagauaccgcgcucuacuacugugcaaaggacuugcgagaguacgagugcgaggaaugggccucggacuauuacgauuucgggcgcgaguacccgugccaggacccgcgcggggucgugggcacguucgauaucuggggccagggcacgauggugaccgugagcucg

SEQ ID NO: 55660 - RNA, 435 nt, Artificial Sequence
  derived and/or modified sequence opt11 from anti-HIV_cap256-048-078409_VR-Chain
cagguccagcucguggaaucgggcgggggcgugguccagcccgggcgcucgcucaggcucucgugcgcggccucgggcuuuaccuuuaacaauuacgcgauggauugggugcgccaggccccgggcaagggccuggaaugggucgcgcucauaagcuaugacgggagcaauaaauauuacgcggaaucggucaagggcagguucacgaucucgcgcgauaacucgaaaaauaccuuguacuugcaaaugaacucgcucagagccgaggacacggccguguacuauugcgcgaaagaugucggggaaaagcaaucgaugaugcgaugggccacggacuauuacgaucucucgaucgcauacccggucccggacccgcgcgcggucgugggcgcguucgaucucuggggcaggggcacgauggugaccgugagcucg

SEQ ID NO: 55661 - RNA, 432 nt, Artificial Sequence
  derived and/or modified sequence opt11 from anti-HIV_cap256-048-078273_VR-Chain
gaaguacaacucgucgaaagcggaggaggacucguccaacccggcggaucccuacgccucagcugcgccgcaagcggauucacagucucaagcaacuacaugagcugggucagacaagcccccggaaaaggacucgaauggguagccguaaucucaagcgacggcucaaacaaaaacuacgccgacagcguaaaaggccgcuucaccauaagccgagacaacagcaaaaacacacucuuccuccaaaugaacagccuacgcccagaagacaccgccgucuacuucugcgccaaagaccuaggcgcaaacaaagacgacgaaugggccacagacuacuacgaccucucaaucgccuacccaguccacgacccccgcgcagucgucggcauauucgaccucuggggccaaggcacaaugguaaccgucagcucc

SEQ ID NO: 55662 - RNA, 432 nt, Artificial Sequence
  derived and/or modified sequence opt11 from anti-HIV_cap256-048-078062_VR-Chain
gacguguacuuggucgagagcgggggcgggcucgugcaaccgggcgggagcuugcgcuugagcuguaccgcgagcgggaucacguucucgaccuaugaaaugaacugggucaggcaagcgcccgggaaagggcucgaguggguggccuuugucgcguucgauggcucggacaaguacuaugccgauagcgugaaagggcgcuuugucauaagcagggacaauagcaagaacacgcucucgcuccagaugaauagcuugagagcggaagauaccgcggucuauuacugugccaaggaagugggcgaggacaaggacgaugaaugggccucggacuauuacgaucucucgaucgcguacccgguccaugacccgcgcgcggucgugggcggguucgauaucuggggccagggcacgauggugaccgugagcucg

SEQ ID NO: 55663 - RNA, 432 nt, Artificial Sequence
  derived and/or modified sequence opt11 from anti-HIV_cap256-048-077798_VR-Chain
caagugcaauuggucgagagcgggggcggggucgugcaaccgggcaggagcuugcgauugagcugugccgcgagcggguucacguucucgaacuauggcaugcacugggucaggcaaacgcccgggaaagggcuagaguggguggccgugaucucguacgauggcucgaacaaguucuaugccgauagcgugaaagggcgcuuuaccauaagcagggacaauagcaagaacacgcuauaucuccagaugaauagcuugcgcguggaagauaccgcggucuaucacugugccaaggacuugggcgggagcaagagcgaugaaugggcaacggacuauuacgauuggucgaucgcguacccgguccaugacccgcgcgcggucgugggcguguucgauaucuggggccagggcacgcuagugaccgugagcucg

SEQ ID NO: 55664 - RNA, 432 nt, Artificial Sequence
  derived and/or modified sequence opt11 from anti-HIV_cap256-048-073853_VR-Chain
gaagugcaauuggucgagagcgggggcgggcucgugaaaccgggcgggagcuugcgauugagcugugccgcgagcggguucacguucucggacgcguggaugaacugggucaggcaagcgcccgggaaagggcucgaguggguggccgggaucucguucgcgggaacgaacaaguacuaugccgauagcgugaaagggcgcuuuaccauaagcagggacaauagcaagaacacgcucuaucuccaaaugaauagcuugcgcgcggaagauaccgcgcucuauuacugugccaaggacaugcgcgaguacgagugcgaggaaugggccucggacuauuacgauuucgggcgcgauuacccgugccaggacccgcgcggggucgugggcacguucgauaucuggggccagggcacgauggugaccgugagcucg

SEQ ID NO: 55665 - RNA, 435 nt, Artificial Sequence
  derived and/or modified sequence opt11 from anti-HIV_cap256-048-071661_VR-Chain
caagugcaacuggucgagagcgggggcggggucgugcaaccgggcagaagccugggcuugagcugcgaagugagcggguucacguucucggacuauuucaugagcuggaucaggcaagcgcccgggaaagggcucgaguggguggccgugauaucgcacgauggcaauaacaaguacuaucccgacagcgugcaaggacgcuucaccauaagcagggaaaauagcaagaacacgcuauaucuccagaugaacagcuugaaaccggaagauaccgcggucuauuucugugccaaggaccugggcggggaaucggaaguggaagagugggcgagcgauuacuaugacuuuggcagggacauacccgggcccgaucccagaggcguggucgggacauuggacauaugggggcacgggaccauggucacggucucaagc

SEQ ID NO: 55666 - RNA, 432 nt, Artificial Sequence
  derived and/or modified sequence opt11 from anti-HIV_cap256-048-071360_VR-Chain
caagugcaauuggucgagagcgggggaggggucgugcaaccgggcaggagcuugcgauugagcugugccgcgagcggguucacgcucacgaacuaugcaauggacugggucaggcaagcgcccgggaaagggcucgaguggguggccgugaucucgagcgauggcucgaacaagaacuaugaagauagcgugaaagggcgcuuuaccauaagcagggacaauagcaagaacacgcucuaucuccagaugucgagcuugcgcccggaagauaccgcagucuauuacugugccaaggacgugggcgauaacaagagcgaugaaugggccacggacuauuacgauuucucgaucgcguacccggucccggacccgcgagcggucgugggcgcguucgaucucuggggccagggcacgauggugaccgugagcucg

SEQ ID NO: 55667 - RNA, 432 nt, Artificial Sequence
  derived and/or modified sequence opt11 from anti-HIV_cap256-048-070955_VR-Chain
gaagugcaauuggucgagagcgggggcgggcucgugcaaccgggcgggagcgugcgauugagcugugccgugagcggguucacguucucgagcuauuggaugagcugggucaggcaagcgcccgggaaagggcucgaguggguggccgugaucucggacucgggcucgaacaaguacuaugccgauagcgugaaagggcgcuuuaccauaagcagggacaauagcaagaacacgcucuaucuccagaugaauagcuugcgcgcggaagauaccgcggucuauuucugugcaaaggacuugggcgggcgcgagaccgaggaaugggcaucggacuauuacgauuucgggcgcgauuucccgggccaggaccagcgcgcggucgcgggcguguucgauauguggggccagggcacgauggugaccgugagcucg

SEQ ID NO: 55668 - RNA, 432 nt, Artificial Sequence
  derived and/or modified sequence opt11 from anti-HIV_cap256-048-070061_VR-Chain
gaagugcaauugcucgagagcgggggcgggcucgugcaaccgggcgggagcuugcgcuugagcugugccgcgagcggauucacguucucgagcuaugccaugcacugggucaggcaagcgcccgggaaagggcucgaguggguggccguaaccucguacgauggcucgaacaaguacuaugccgauagcgugaaagggcgcuuuaccauaagcagggacaauagcaagaacacgcucuauaugcagaugaauagcuugcgagcggaagauaccgcggucuauuacugugccaaggaccagggcgagagugagaaagaggaaugggccucggacuauuacgauuucgggagagauuacccgggcagggacccgcgcagggucguggccacguucgcgaucuggggccagggcacgaugguaaccgugagcucg

SEQ ID NO: 55669 - RNA, 432 nt, Artificial Sequence
  derived and/or modified sequence opt11 from anti-HIV_cap256-048-069669_VR-Chain
caagugcaauuggucgagagcgggggcggggucgugcaaccgggcaggagcuugcgcuugagcugugccgugagcggguucacguucucgaaauuucccaugcacugggucaggcaagcgcccgggaaaggacucgaguggguggccgugaucucauacgauggcaauaaaaaguacuaugucgauagcgcgaaagggcgcuuuaccauaagcagggacaauagcaggaaaacgcucuaucuccagaugacgggcuugcgaccggaagauaccgcggucuauuacugugccaaggacuugggcgggggcgagugcgagaccugggccucggacuauuacgauuucgggaaagauuacccgugcuuggacccgcgagaugucgugggcacguucgauaucuggggccagggcacgcuagugaccgugagcucg

SEQ ID NO: 55670 - RNA, 432 nt, Artificial Sequence
  derived and/or modified sequence opt11 from anti-HIV_cap256-048-069205_VR-Chain
caagugcaauuggucgagagcgggggcggggucgugcaaccgggcaggagcuugcgcuugagcugugccgcgagcggguucacguucucgagcuaugccaugcacugggucaggcaagcgcccgggaaagggcucgaguggguggucgugaucucgaacgauggcaauaacaaguacuaugccgauagcgugaaagggcgcuuuaccauaagcagggacaauagcaagaacacggucuaucuccagaugaauagcuugcgcgcggaagauaccgcggucuauuacugugccaaggacgugggcgauaccaagaaagaugaaugggccacggacuauuacgaucucucgaucgcguacccgguccaggacccgcaagcggucgugggagcguucgauaucuggggccagggcacgauggugaccgugagcucg

SEQ ID NO: 55671 - RNA, 432 nt, Artificial Sequence
  derived and/or modified sequence opt11 from anti-HIV_cap256-048-068882_VR-Chain
caagugcaauuggucgagagcgggggcgggguagugcaaccgggaaggagccugcgccugagcugugccgcgagcggguucacguucucgaccuaugccaugcacugggucaggcaagcgcccgggaaaggacucgaguggguggccuugaucucguacgauggcacggacaaguacuaugcagauagcgugaaagggcgcuuuaccauaagcagggacaauagcaagaacacggucuaucuccagaugaauagcuugcgcggggucgauaccgcgguguauuacugugccaaggacuugggcgggggcgaggucgaggaaugggcaacggacuauuacgauuggucgaccgcguacccggucgagcacccgcgcgcgguggugggcguguucgauauauggggccagggcacgaaagugacagugagcucg

SEQ ID NO: 55672 - RNA, 432 nt, Artificial Sequence
  derived and/or modified sequence opt11 from anti-HIV_cap256-048-067764_VR-Chain
gaagugcaauugguccagagcgggggcgggcucgugaaaccgggcgggagcuugcgcuugagcugugccgcgagcggguucacguucucgaccuauagcaugaacugggucaggcaagcgcccgggaaagggcucgaguggguggccgugaucucgagcgauggcucgagcaagaacuaugccgauagcgugaaagggcgcuuuaccauaagcagggacaauagcaagaacacggucucgcuccagaugaauagcuugcgaccggaagauaccgcggucuauuacugugccaaggacgugggagcgaacaaggacgaugaaugggccacggacuauuacgaucucucgaucgcguacccggucccggacccgcgcgcggucgugggcgcguucgauaucuggggccagggcacgauggugaccgugagcucg

SEQ ID NO: 55673 - RNA, 432 nt, Artificial Sequence
  derived and/or modified sequence opt11 from anti-HIV_cap256-048-066845_VR-Chain
caagugcucuuggucgagagcgggggcggggucgugcaaccgggcgggagcuugacccugagcugugccgcgagcggguucacguucucgaacuauggcaugcacugggucaggcaagcgcccgggaaagggcucgaguggguggccuuuaucagguacgauggcaauaacaaguacuaugccgauagcgugaaagggcgcuuuaccauaagcagggacaauagcaaggacacgcucuaucuacagauggauggcuugcgaccggaagauaccgcgcucuauuacugugccaaggacuugggcgagcgagagugcgaggaaugggccucgaacuauuacgauuucgggcgcgauuacccgugccaggacccgcgcggggucgugggcacguucgauaucuggggccagggcacgauggugaccgugagcucg

SEQ ID NO: 55674 - RNA, 432 nt, Artificial Sequence
  derived and/or modified sequence opt11 from anti-HIV_cap256-048-065226_VR-Chain
gaagugcaacuggucgagagcgggggcgggcucgugaaaccgggcgggagcuugcgcuugagcugugucgcgagcggguucacguucucgaacuauggcaugcacugggucaggcaagcgccagggaaagggcuaguguggguggccgggaucucguucgcgggcacgaacaaguacuaugccgcgagcgugaaagggcgcuuuaccauaagcagggacaauagcaagaacacgcucuaucuccagaugaauagcuugcgcgcggaagauaccgcgcucuauuacugugccaaggacaugcgcgaguacgagugcgaggaaugggccucggacuauuacgauuucgggcgcgauuacccgugccaggacccgcgaggggucgugggcacguucgauaucuggggccagggcacgauggugaccgugagcucg

SEQ ID NO: 55675 - RNA, 432 nt, Artificial Sequence
  derived and/or modified sequence opt11 from anti-HIV_cap256-048-063717_VR-Chain
caagugcaacuggucgagagcgggggcggggucgugcaaccgggcaggagcuugcgacugagcugugcagcgagcggguucucguucucgaaccaugccauggacuggguaagacaagcgcccgggaaagggcuagaguggguggccgugaucucgagcgauggaucggacaagaucuaugcagagagcgugaaagggcgcuuuaccauaagcagggacaauagcaagaacacgcucuaucuacaaaugaauagcuugcgcguggaagauacagcggucuauuucugugccaaggacuugggcgcgaacaaggacgaugaaugggccacggacuauuacgaucucucgauagcguacccggucccggacccgcgcgcggucgugggagcguucgauaucuggggccagggcacgauggugagcguaagcucg

SEQ ID NO: 55676 - RNA, 432 nt, Artificial Sequence
  derived and/or modified sequence opt11 from anti-HIV_cap256-048-063150_VR-Chain
gaagugcaacuggucgagagcgggggcggggucgugcaaccgggcaggagcuugcgccugagcugugccgcgagcggguucacguucucgagcuaugccaugcacugggucaggcaagcgcccgggaaagggcucgaguggguggcccauaucagguacgauggcucgaacaaguacuauaucgauagcgugcaagggcgcuuuaccauaagcagagacaaucccaagaacacgcucuaucuccagaugaauagcuugcgcacggaagauaccgcggucuauuacugugccaaggacuugggcgggggcgaggucgaggaaugggccacggacuauuacgauuggucgaucgcguacccggucgagcacccgcgcgcggucgugggcguguucgauaucuggggccagggcacgaaagugaccgugagcucg

SEQ ID NO: 55677 - RNA, 432 nt, Artificial Sequence
  derived and/or modified sequence opt11 from anti-HIV_cap256-048-062431_VR-Chain
caagugcaacuggucgagagcgggggcggggucgugcaaccgggcaggagcuugcgccugagcugugccgcgagcggguucacguucucgaacuucgccauggacugggucaggcaagcgcccgggaaagggcucgaguggguggccgugaucucgagcgauggcucgaaaaagaacuauggagauagcguaaaagggcgcuuuaccauaagcagggacaauagcaagaacacgcucuuucuccagaugaauagcuugcgcccggaagauaccgcgcucuauuacugugccaaggaccugggcggguacaagagcgaugaaugggccacggacuauuacgaucucucgaucgcguacccgguccaggacccgcgcccgugguuggaauugcucuauaucuggggccagggcgcgaugguaaccgugagcucg

SEQ ID NO: 55678 - RNA, 432 nt, Artificial Sequence
  derived and/or modified sequence opt11 from anti-HIV_cap256-048-060745_VR-Chain
caagugcaauuggucgagagcgggggcucggucgugcaaccgggcaggagccugcgccugaccuguaccgcgagcggguucacguucucgcacuaugccauggacugggucaggcaagcgcccgggaaagggcucgaguggguggccgugaucucgagcgaugccacgaacaagaacuaugccgauagcgugaaagggcgcuuuaccauaagcagggacaauagcaagaacacggucuaucuacagauggauagcuugcgcgcggaagauacagcggucuauuacugugccaaggacgugggcgauuacaaggacgaugaaugggccacggacuauuacgauuucucgaucgcguacccggucccggacccgcgcgcggucgugggcgcauucgauuucuggggccagggcacgauggugaccgugagcucg

SEQ ID NO: 55679 - RNA, 432 nt, Artificial Sequence
  derived and/or modified sequence opt11 from anti-HIV_cap256-048-060420_VR-Chain
caagugcaauuggucgagagcgggggcggggucgugcaaccgggcaggagcuugcgauugagcugugccgcgagcggguucacguucucgagcuauggcauggccugggucaggcaagcgcccgggaaagggcucgagugggugaccgugaucucguucgcgggcgugaaaaaguacuaugccgauagcgugaaagggcgcuuuaccauaagcagggacaauagcaagggcacgcuauaucuccagaugaauagcuugcgcgcggaagauaccgcgguauauuacugugccaaggacgugggcgauaccaagaaagaugaaugggccacggacuauuacgaucucucgaucgcguacccgguccaggacccgcaagcggucgugggcgcguucgauaucuggggccagggcacgauggugaccgugagcucg

SEQ ID NO: 55680 - RNA, 435 nt, Artificial Sequence
  derived and/or modified sequence opt11 from anti-HIV_cap256-048-060014_VR-Chain
cagguccagcucguggaaucgggcggaggcgugguccagcccgggcgcucgcucaggcucucuugcgcggccucgggcuuuaccuuuagcaauuacgggaugcauugggugcgacaggccccgggcaagggcuuggaaugggucgcgcucauaagccaugacggaagcaauaaaaauuucgcggacucagucaagggcagguucacgaucucgcgcgauaacucgaaaaauaccuuguacuuacaaaugaacucgcucaggaccgaggacacggccauauacuauugcgcgaaagaucucgggggcgagagcgagaucgaggaauggcccucggacuauuacgauuucgggcgcgauuacccggucccggacccacgcggggucgugggcacguucgauuucuggggccagggcacgauggugaccguaagcucg

SEQ ID NO: 55681 - RNA, 432 nt, Artificial Sequence
  derived and/or modified sequence opt11 from anti-HIV_cap256-048-059747_VR-Chain
caagugcaauuggucgagagcgggggcggggucgugcaaccgggcaggagcuugcgcuugagcugugccgcgagcggguucacguucacgcacuaugcaauggacugggucaggcaagcgcccgggaaagggcucgaguggguggcagugaucucgagcgauggcucgagcaaggacuaugccgauagcgugaaagggcgcuuuaccauaagcagggacaauagcaagaacacgcucucacuccagaugaauagcuugcgcccggaagauacagcggucuauuacugugcaaaggacuugggcgcgagcaaggacgaugaaugggccacggacuauuacgaucucucgaucgcguacccgguccaugacccgcgagcggucgugggcggguucgauauauggggccagggcacgauggugaccgugagcucg

SEQ ID NO: 55682 - RNA, 432 nt, Artificial Sequence
  derived and/or modified sequence opt11 from anti-HIV_cap256-048-058393_VR-Chain
caaguccaacucgucgaauccggcggcggcgucguacaacccggcggcucacuccgacucuccugcgccgccuccggcuucaccuucaacaccuacggcaugcacuggguccgccaagcccccggaaaaggccucgaaugggucaccuucauccgcuacgacggcuccaacgaauacuacgccgacuccgucaaaggccgcuucaccaucucccgcgacaacuccaaaaacacccucuaccuacaaaugaacucacucuccgucgaagacaccgccgucuacuacugcgccaaagaccucggcaaaaacaaagacgacgaaugggccaccgacuacuacgacaucucaaucgccuaccccguccccgacccccgcgcaguagucggcguauucgacaucuggggccaaggcacagucgucaccgucucaagc

SEQ ID NO: 55683 - RNA, 432 nt, Artificial Sequence
  derived and/or modified sequence opt11 from anti-HIV_cap256-048-058159_VR-Chain
caagugcaauuggucgagagcgggggcggggucgugcaaccgggcaggagcuugcgccugagcugugccgcgagcggguucacguucucgagcuaucccaugcacugggucaggcaagcgcccgggaaagggcucgaguggguggccguaaucucguucgcgggcacgaacaaguacuaugcccauagcgugaaagggcgcuucaccauaagcagggacaauagcaagaacacgcucuaucuccagaugaauagccugcgcgcggaagauaccgcgcucuauuacugugccagggacuugcgcgagagcgagugcgaggaaugggccucagacuauuacgauuucgggcgagaguacccgugccaggacccgcgcggggucgugggcacguucgauaucuggggcaggggcacgauggugaccgugagcucg

SEQ ID NO: 55684 - RNA, 432 nt, Artificial Sequence
  derived and/or modified sequence opt11 from anti-HIV_cap256-048-057127_VR-Chain
gacguguacuuggucgagagcgggggcgggcucgugcaaccgggcgggagcuugcgcuugagcugugucgcgagcgggaucacguucucgagcuauggcaugcacugggucagacaagcgcccgggaaagggcucgagugggcggccuuuaucagguacgauggcaggaacaaguacuaugccgauagcgugaaagggcgcuuuaccauaagcagggacaauagcaagaacacgcuaucgcuccagaugaauaacuugcgcgcggaagauaccgcggucuauuacugugccaaggaagugggcgauaacaaggacgaugaaugggccucggacuauuacgaucucucgaucgcguacccgguccaggacccgcgcgcggucgugggcggguacgauaucuggggacagggcacgauggugaccgugagcucg

SEQ ID NO: 55685 - RNA, 432 nt, Artificial Sequence
  derived and/or modified sequence opt11 from anti-HIV_cap256-048-056251_VR-Chain
gaagugcaauuggucgagagcgggggcgggcucgugcaaccgggcaggagcuugcgcuugagcugugccgggagcggguucacguucucgaacuuuggcuuucacugggucaggcaagcgcccgggaaagggcucgaguggguggccgcgaucucguucgcgggcuauaacaaguacuaugccgauagcgugaaagggcgcuuuaccauaagcagggaaaauagcaauaacaugcucuaucuccagaugucgagcuugcgcgcggaagauaccgcggucuauuacugugccaaggacuugcgcgagagcgagugcgaggaaugggccucggacuauuacgauuucgggaaagauuacccgugccaggacccgcgcggggucgugggaacguucgauguauggggacauggcucgcucgugaccgugagcucg

SEQ ID NO: 55686 - RNA, 432 nt, Artificial Sequence
  derived and/or modified sequence opt11 from anti-HIV_cap256-048-055421_VR-Chain
caagugcaacuggucgagagcgggggcggagucguacaaccggccaggagcuugcgcuugagcugugccgcgagcggguucauauucucgaccuauggcaugcacugggucagacaagcgcccgggaaaggacucgaauggguagccgugaucucaagcgauggcucgagcaaggacuaugccgacagcguuaaaggacgcuuuaccauaagcagggacaauagcaagaacacgcucucgcuacagaugaauagccugcgcccggaagacaccgcggucuacuacugugccaaggacuugggcgcgagcaaggacgaugaaugggccacagacuauuacgauuucucgaucgcguacccgguccaggacccgcgcgcggucgugggcgcguucgauaucuggggccagggcacgauggugaccguaagcucg

SEQ ID NO: 55687 - RNA, 432 nt, Artificial Sequence
  derived and/or modified sequence opt11 from anti-HIV_cap256-048-054989_VR-Chain
caagugcaauuggucgagagcgggggcggggucgugcaaccgggcgggagcuugcgccugagcugugccgcgagcggguucacguucucgaccaauggaaugcacugggucaggcaagcgcccgggaaagggcucgaguggguggccuuuaucagguacgauggcucaaacaaguacuaugccgauagcgugaaagggcgcuucaccauaagcagggacaauagcaagaacacggucuaucuccagaugaauagcuugcgcggggucgauaccgcggucuauuacugugccaaggacuugggagggggcgaggucgaggaaugggccacggacuauuacgauuggucaauagcguacccggucgagcacccgcgagcggucgugggcguguucgauauauggggccagggcacgaaaguaaccgugagcucg

SEQ ID NO: 55688 - RNA, 435 nt, Artificial Sequence
  derived and/or modified sequence opt11 from anti-HIV_cap256-048-054759_VR-Chain
cagguccagcucguggaaucgggcgggggcgugguccagcccgggcgcucacucaggcuaucgugcgcggccucgggcuuuagcuuuagcaagaacgggaugcauugggugcgccaggccccgggcaagggauuggaaugggucgcguucguggccuuugacgagagcgauaaauauuacgcagacucggucaagggcagguucacgaucucgcgcgauaacucgaaaaauaccuugagccugcaaaugaacucgcuaagggucgaggacacggccguguacuauugcgcgaaagaggucggggaaaauaaagaugacgagugggcggccccggacuauuacgauuucucgaucgcguacccgguccaggacccgcgcgcggucgugggcggguucgauaucuggggccagggcacgauggugaccgugagcucg

SEQ ID NO: 55689 - RNA, 432 nt, Artificial Sequence
  derived and/or modified sequence opt11 from anti-HIV_cap256-048-052573_VR-Chain
caagugaaauuggucgagagcgggggcggggucguacaaccgggcaggagccugcgcuugagcugugcagcgagcggguucucguucucgaacuaugccauggacugggucaggcaagcgccagggaaagggcucgaguggguggccgugguaucgagcgauggaucgaacaagaacuaugccgauagcgugaaagggcgcuuuaccauaagcagggacaauagcaagaacacggucuaucuccagaugaauagcuugcgcgcggaagauaccgcggucuauuacugugccaaggacuugggcgcgaacaaggacgaugaaugggccacggacuauuacgauuggucgaucgcguacccgguccaugacccgcgagcggucgugggcguguucgauaucuggggacagggcacgcucgugaccguaagcucg

SEQ ID NO: 55690 - RNA, 432 nt, Artificial Sequence
  derived and/or modified sequence opt11 from anti-HIV_cap256-048-051477_VR-Chain
caagagcaauuggucgagagcgggggcggggucgugcaaccgggcaggagccugcgcuugagcugugcagcgagcggguucacguucucgaacuaugccaugcacugggucaggcaagcgcccgggaaagggcucgaguggguggccgcgaugucgcacgauggcucggacaaguacuaugccgauagcgugaaagggcgcuuuaccauaagcagggacaauagcaagaacacgcucuauaugcagaugaauagcuugcgcgcggaagauaccgcggucuauuacugugccaaggaccagggcgagagcgagaaagaggaaugggccucggacuauuacgaucucucgaucgcguacccgauccaggacccgcgcgcgauggugggcgcguucgauaucuggggccagggcacgaugguaaccgugagcucg

SEQ ID NO: 55691 - RNA, 432 nt, Artificial Sequence
  derived and/or modified sequence opt11 from anti-HIV_cap256-048-051299_VR-Chain
caagugcaacuggucgagagcggaggcggagucguacaaccgggccgcagccugcgccugagcugcgccgcaagcggguucacauucucgaccuucggcaugcacugggucaggcaagcgcccgggaaagggcucgaguggguggcccugaucucacacgacggcaacaacaaauacuacgccgacagccugaaagggcgcuucacaauaagcagagaaaacagcaagaacacacucuuccuccagaugaacagccuacgcgcagaagacaccucagucuacuacugcgccaaggaccugggcgacagcgaaugcgaagaaugggccucagacuacuacgacuucgggaaagacuacccaugccugcacccacgcggagucgugggcacauucgacuucuggggccacggcacaauggugaccguaagcuca

SEQ ID NO: 55692 - RNA, 432 nt, Artificial Sequence
  derived and/or modified sequence opt11 from anti-HIV_cap256-048-050815_VR-Chain
caagugcaauuggucgagagcgggggaggggucgugcaaccgggcgggagcuugcgcuugagcugugucgugagcggguucacguucucgagcuauggcaugcacugggucaggcaagcgcccgggaaagggcuagagugggugagcuuuaucagguucgauggcaauuacgaguacuaugucgauagcgugaaagggcgcuuuaccauaagcagggacaauagcaagaacacggucuaucuacagauggauagcuugcgcgcggaagauacagcggucuauuacugugccaaggacgugggcgauuacaaggacgaugaaugggccacggacuauuacgauuucucgaucgcguacccggucccggacccgcgcgcggucgugggcgcguucgauuucuggggccagggcacgauggugaccgugagcucg

SEQ ID NO: 55693 - RNA, 432 nt, Artificial Sequence
  derived and/or modified sequence opt11 from anti-HIV_cap256-048-049884_VR-Chain
caagugcaauuggucgagagcgggggcggggucgugcaaccgggcaggagccugcgcuugagcugugccgcgagcggguucucauucaauaccuaugccaugcacugggucaggcaagcgcccgggaaagggcuagaguggauggcccugaucucguacgauggcucgaacaaguacuaugucgacagcgugaaaggacgcuuuaccauaagcagggacaauagcaagaacacgcucuaucuacagaugaauagccugcgcgcggaagauaccgcggucuauuacugugccaaggaccugggcgggaacaaggacgaugaaugggccacggacuauuacgaucucucgaucgcguacccgguccaggacccgcgcgugguagugggcauauucgauaucuggggccagggcacgauggugaccgugagcucg

SEQ ID NO: 55694 - RNA, 432 nt, Artificial Sequence
  derived and/or modified sequence opt11 from anti-HIV_cap256-048-049170_VR-Chain
caagugcaauuggucgagagcgggggcggggucgugcaaccgggaaggagcuugcgcuugagcugugccgcgagcggguucauauucucgagcuauggaaugcacugggucaggcaagcgcccgggaaagggcucgaguggguggccgugaucucgggcgauggcacgaaaaaggacuuugccgauagcgugaaagggcgcuuuaccauaagcaaggacaauagcaagaacauggucucgcuccagaugaauagcuugcgcgcggaagaugccgcggucuauuacugugccaaggaccugggcgagagcgauaacgaggaauggcccucggacuauuacgauuucgggcgcgauuucacgggccagaacccgcgcgcggucgugggcacguucgaucucuggggccagggcacgauggugaccgugagcucg

SEQ ID NO: 55695 - RNA, 435 nt, Artificial Sequence
  derived and/or modified sequence opt11 from anti-HIV_cap256-048-048531_VR-Chain
caagugcaauuggucgagagcgggggcggggucgugcaaccgggcaggagcuugcgccugagcugugccgcgagcggguucacguucucgagcuauggccugcacugggucaggcaagcgcccgggaaagggcuagaauggguggccuuuaucucguacgauggcaauaacaagcacuaugucgauagcgugaaagggcgauuuaccauaagcagggacaauagcaagaacacgcucuaucuccagaugaauagccugcgcgcggaagauaccgcggucuauuacugugccaaggaccugggcggggaaucggaaauagaagagugggcgaccgauuacuaugacuuuagcauagccuaucccgugaaagagagcaggggcguggucgggaucuuugacaugugggggcaagggaccauggucacggucucgagc

SEQ ID NO: 55696 - RNA, 432 nt, Artificial Sequence
  derived and/or modified sequence opt11 from anti-HIV_cap256-048-048259_VR-Chain
caagugcaauuggucgagagcgggggcggggucgugcaaccgggaaggagcuugcgccugagcugugccgcgagcggguucacguucucgaccugugccaugcacuggguaaggcaagcgcccgggaaagggcucgaguggguggccgugaucucguacgauggcucgaacaaguacuaugucgauagcgugaaagggcgcuuuaccauaagcagggacaauagcaagaacacgcucuaucuacagaugaauagccugcgcgcggaagauaccgcggucuauuacugugcaaaggaaguggacauaaacaaggaagaugaaugggccucggacuauuacgauuucucgaucgcguacccgguccaggacccgcgagcggucgugggcggguucgauaucuggggccagggcacgauggugaccgugagcucg

SEQ ID NO: 55697 - RNA, 432 nt, Artificial Sequence
  derived and/or modified sequence opt11 from anti-HIV_cap256-048-047313_VR-Chain
caagugcaauuggucgagagcgggggcggggucgugcaaccgggcaggagcuugcgccugagcugugccgcgagcggguucacguucucgacauuuggcaugcacugggucaggcaagcgcccgggaaagggcucgaguggguggccguaaucucacacgauggcaauaacaaguacuaugccgauagcgugaaagggcgcuuuaccauaagcagggacaauagcaagaacacggucuaucuccagaugaauagcuugcgcgcggaagauaccgcggucuauuacugugccaaggacuugggcgcgaacaaggacgaugaaugggccacggacuauuacgaucucucggucgcguacccggucccggacccgcgcgcggucgugggcgcguucgaugucuggggccagggcacgauggugaccguaagcucg

SEQ ID NO: 55698 - RNA, 432 nt, Artificial Sequence
  derived and/or modified sequence opt11 from anti-HIV_cap256-048-046596_VR-Chain
caagugcaauuggucgagagcgggggcgggguagugcaaccgggcgggagcuugcgauugagcugugccgcgagcggguucacguucucaagcuauggcaugcacugggucaggcaagcgcccgggaaagggcuagaguggguagccuuuaugagguuugauggcucgaacagguacuauggcgauagcgugaaagggcgcuuuaccauaagcagggacaauagcaagaacacgcucuaucuccagaugaauagcuugcgcacggaagaugccgcgcucuauuacugugccaaggacaugcgcgaguucgagugcgaggaaugggccucggacuauuacgauuucgggcgcgauuacccgugccaggacccgcgcggggucgugggcauauucgauaucuggggccagggcacgauggugaccgugagcucg

SEQ ID NO: 55699 - RNA, 432 nt, Artificial Sequence
  derived and/or modified sequence opt11 from anti-HIV_cap256-048-044781_VR-Chain
caagugcaacuggucgagagcgggggcggggucgugcaaccgggcagaucauugcgauugagcugugccgcgagcggguucacguucacgagcuaugccauacacuggguaaggcaagcgcccgggaaagggcucgaguggguggccgugaucucguacgauggcagcaaaaagaacuaugccgauagcgugaaagggcgauuuaccauaagcagggacaauagcaagaacacgcucuauguccagaugaauagccugcgcgcggaagauaccgcggucuauuacugugccaaggaagugggcgaggacaaggacgaugaaugggccucggacuauuacgaucucucgaucgcauacccgguccaugacccgcgagcggucgugggaggguucgauaucuggggccagggcacgauggugaccgugagcucg

SEQ ID NO: 55700 - RNA, 432 nt, Artificial Sequence
  derived and/or modified sequence opt11 from anti-HIV_cap256-048-042599_VR-Chain
caagugcaauuggucgagagcgggggcggggucgugcaaccgggccgcagcuugagauugagcugugccgcgagcggguucacguucucgaacuauggcaugcacugggucaggcaaacgcccgggaaagggcucgaguggguggccgugaucucauacgauggaucgaacaaguucuaugccgauagcgugaaagggcgcuuuaccauaagcagggacaauagcaagaacacgcucuaucuccagaugucgagcuugcgcgcggacgauaccgcggucuauuacugugccaaggaagugggcgaggacaaggacgaugaaugggccucggacuauuacgaucucucgaucgcguacccgguccaugacccgcgcgcggucgugggcggguucgauaucuggggccagggcacgauggugaccgugagcucg

SEQ ID NO: 55701 - RNA, 432 nt, Artificial Sequence
  derived and/or modified sequence opt11 from anti-HIV_cap256-048-041276_VR-Chain
caagugcaacuggucgagagugggggcggggucgugcaaccgggcaggagcuugcgcuugagcugugccgcgagcagguucacguucucgagcuaugccaugcacugggucaggcaagcgcccgggaaagggcucgaguggguggccauaaucucguacgacggcucgaacaaguacuaugccgauagcgugaaagggcgcuuuaccauaagcagggacaauagcaagaacacgcucuuucuccagaugaauagccugcgcgcggaagauaccgcgcuauauuacugugccaaggacuugggaggguacaagagcgaugaaugggccacggacuauuacgaucucucgaucgcguacccgauccaggacccgcgcgcggucgugggcgcguucgauaucuggggccagggcacgaugguaaccgugagcucg

SEQ ID NO: 55702 - RNA, 432 nt, Artificial Sequence
  derived and/or modified sequence opt11 from anti-HIV_cap256-048-040200_VR-Chain
caagugcaauuggucgagagcgggggcggggucgugcaaccgggcaggagccugcgcuugagcugugucgcgagcggguucacauucucgagcuuuggcaugcacugggucaggcaagcgcccgggaaagggcucgaguggguggcagugaucucgcacgauggccauaacaaguacuaugccgauagcuugaaagggcgcuuuaccgugagcagggaaaauagcaagaacacgcucuuucuccagaugaauagcuugcgcgcggaagauaccucggucuauuacugugccaaggacuugggcgggggcgagugcgaggaaugggccucggacuauuacgauuucgggcgcgauuacccgugcuugaccccgcgcggggucgugggcacguucgauaucuggggccauggcacgaccgugaccgugagcucg

SEQ ID NO: 55703 - RNA, 432 nt, Artificial Sequence
  derived and/or modified sequence opt11 from anti-HIV_cap256-048-039061_VR-Chain
gaagugcaauugcucggaagcggaggcgggcucgugcaaccgggcgggagccugcgcuugaccugugccgugagcggguucacguucucgagcuuugccaugagcugggucaggcaagcgcccgggaaagggcuagaguggguggccuugaucucguacgauggcacggacaaguacuaugcagauagcguaaaagggcgcuucaccauaagcagggacaauagcaagaacacgcucuaccuacagaugaauagcuugcgcguggaagauaccgcgaucuaucacugugccaaggaccugggcgggaccaagagcgaugaaugggcaacggacuauuacgaucucucgaucgcguacccgauccaggacccaggcgcggucgugggcguguucgauaucuggggccagggcacgauggugaccguaagcucg

SEQ ID NO: 55704 - RNA, 432 nt, Artificial Sequence
  derived and/or modified sequence opt11 from anti-HIV_cap256-048-038515_VR-Chain
caagugcaauuggucgagagcgggggcggggucguacaaccgggcaggagcuugcgccugagcugugccgcgagcggguucacguucucgaccuaugccaugcacugggucaggcaagcgcccgggaaagggcuagaguggguggucgugauaucguacgauggcucgaacaaguacuaugccgauagcgugaaagggcgauuuacaauaagcagggacaauagcaagaacacgcucuuucuccagaugaauagcuugcgagcggaagauaccgcgcucuauuacugugccaaggacgugggcgaguacaagagcgaugaaugggccacggacuauuacgaucucucgaucgcguacccgauccaggacccgcgcgcgauggugggcgcguucgauaucuggggccagggcacgauggugaccgugagcucg

SEQ ID NO: 55705 - RNA, 432 nt, Artificial Sequence
  derived and/or modified sequence opt11 from anti-HIV_cap256-048-038255_VR-Chain
caagugcaauuggucgagagcgggggcggggucgugcaaccgggcaggagcuugcgcuugagcugugccgcgagcggguucacgcucucaagcuaugccaugcacugggucaggcaagcgcccgggaaagggcucgaguggguggccgugaucucguacgauggcucgaacaaguacuaugccgauagcgugaaagggcgcuuuaccauaagcagggacaauagcaagaacgcgcucuaucuccagaugaauagcuugcgagcggaagauaccgcgcucuauuacugugccaaggacuugcgcgaguacgagugcgaggaaugggccucagacuauuacgauuucgggcgcgauuacccgugccaggacccgcgcggggucgugggcacguucgauaucuggggccagggcacgauggugaccgugagcucg

SEQ ID NO: 55706 - RNA, 432 nt, Artificial Sequence
  derived and/or modified sequence opt11 from anti-HIV_cap256-048-038177_VR-Chain
caaguacaacucgucgaauccggcggcggcgucguccaacccggacgcucccuccgccucuccugcgccgcauccggcuucaccuucaacaccuacggcauccacuggguccgacaagcccccggcaaaggccucgaaugggucgcccucaucuccuacgacggcaccgacaaauacuacgccgacuccgucaaaggccgcuucaccaucucccgcgacaacuccaaaaacacccucuaccuccaaaugaacucacuccgcgucgaagacaccgccaucuaccacugcgccaaagaccucggcggcaccaaaucagacgaaugggccacagacuacuacgaccucuccaucgccuaccccauccaagaccccggcgccgucgucggcgucuucgacaucuggggccaaggcaccauggucaccgucuccucc

SEQ ID NO: 55707 - RNA, 432 nt, Artificial Sequence
  derived and/or modified sequence opt11 from anti-HIV_cap256-048-035513_VR-Chain
caagugcaauuggucgagagcgggggcggggucgugcaaccgggcaggagcuugagauugagcugugccgcgagcggguucacguucucgagcuauggcauggccugggucaggcaagcgcccgggaaagggcucgagugggugaccgugaucucguucgcgggcgugaaaaaguacuaugccgauagcgugaaagggcgcuuuaccauaagcagggacaauagcaagggcacgcucuaucuccagauggauggcuugcgaccggaagauaccgcgcucuauuacugugccaaggacuugggcgagcgcgagugcgaggaaugggccucggacuauuacgauuucgggcgcgauuucccgugccaggacccgagaggggucgugggcacguucgauaucuggggccagggcacgauggugaccgugagcucg

SEQ ID NO: 55708 - RNA, 432 nt, Artificial Sequence
  derived and/or modified sequence opt11 from anti-HIV_cap256-048-034112_VR-Chain
caaaugcaauuggucgagagcgggggcggaguagugcaaccgggcaggagccugcgcuugagcugugccgcgagcggguucacguucaauagcuaugccaugcacugggucaggcaagcgcccgggaaagggcucgaguggguggccgugaucucguacgauggcucgaacaaguacuaugccgauagcgugaaagggcgcuuuacaauaagcagggacaacagcaagaacacagucuaucuacagaugaauagcuugcgcggggucgauacagcggucuauuacugugcaaaggacuugggcgggggcgaggucgaggaaugggccacggacuauuacgauuggucgaucgcguacccggucgagcacccgcgcgcagucgugggcguguucgauaucuggggccagggcacgaaagugaccguaagcucg

SEQ ID NO: 55709 - RNA, 432 nt, Artificial Sequence
  derived and/or modified sequence opt11 from anti-HIV_cap256-048-033983_VR-Chain
caagugcaauuggucgagagcgggggcggggucgugcaaccgggcgagagcuugcgcuuaagcugugccgcgagcggguucacgcucucgagccauggcauacacugggucaggcaagcgcccgggaaagggcucgaguggguggccuuuaucucgagcgauggcucgaacaagaacuauggcgauagcgugaaagggcgcuuuaccauaagcagggacaauagcaagaacacgcucuuucuccagaugaauagcuugcgcgcggaagauaccgcgcucuauuacugugccaaggacgugggcgaguacaagagcgaugaaugggccacggacuauuacgaucucucgaucgcguacccgauccaggacccgcgcgcgauggugggcgcguucgauaucuggggccagggcacgauggugaccgugagcucg

SEQ ID NO: 55710 - RNA, 432 nt, Artificial Sequence
  derived and/or modified sequence opt11 from anti-HIV_cap256-048-032688_VR-Chain
caagugcaauuggucgagagcgggggcggggucgugcaaccgggcaggagcuugcgcuugagcugugccgcgagcggguucauauucaauagcuauggcaugcacugggucaggcaagcgcccgggaaagggcucgaguggguggccgugguccauggagauggagggaacaaguacuaugccgauagcgugaaagggcgcuuuaccauaagcagggacaauagcaagaacacgcucuaucucgagaugaauagcuugcgagcggaagauaccgcggaauauuacugugccaaggacuugggagagagcgauaaagaggaauggccaucggacuauuacgauuucgggcgcgauuucacgggccaggucccgcgcgcggucgugggcgcguucgauaucuggggccagggcacgaugguaaccgugagcucg

SEQ ID NO: 55711 - RNA, 432 nt, Artificial Sequence
  derived and/or modified sequence opt11 from anti-HIV_cap256-048-031092_VR-Chain
caagugcaauuggucgagagcgggggcggggucgugcaaccgggcaggagccugcgauugagcugugccgcgagcggguucucguucuauaacuuugccauggacugggucaggcaagcgcccgggaaagggcucgaguggguggccgugauaucgagcgauggcgggaacaagaacuauguagauagcgugaaagggcgcuuuaccauaagcagggacaauagcaagaacacgcucuaucuccagaugaauagcuugcgcgcggaagauaccgcggucuauuacugugccaaggacuugggcgggaccaaggacgaugaaugggccacggacuauuacgauaucucgaucgcguacccgguacaggacccgcgcgcggucgcgggagcguucgauaucuggggccagggcacgauggugaccgugagcucg

SEQ ID NO: 55712 - RNA, 435 nt, Artificial Sequence
  derived and/or modified sequence opt11 from anti-HIV_cap256-048-030464_VR-Chain
cagguccagcucguggaaucgggagggggcuuggucaagcccgggggcucgcucaggcuaucgugcgaggccucgggcuuuagcuuuaccaauuacuauaugucguggauacgccaggccccgggcaagggccuggaaugggucgcggucaucagcuuuaacgggcgcaauaaauauuacgcggacuuugucaagggcagguucacgauaucgcgagauaacucgaaaaauaccuugagccugcaaaugaacucgcucagggucgaggacacggccguguacuauugcgcgaaagaggucggggaaaauaaagaugacgagugggcggccccggacuauuacgauuucucaaucgcguacccgguccaggacccgcgcgcggucgugggcggguucgauaucuggggccagggcacgauggugaccguaagcucg

SEQ ID NO: 55713 - RNA, 432 nt, Artificial Sequence
  derived and/or modified sequence opt11 from anti-HIV_cap256-048-030289_VR-Chain
caagugcaauugguagagagcgggggcggggucgugcaaccgggcgggagcuugcgcuugagcugugccgcgagcggguucacguucucgagcuauggcaugcacuggguaaggcaagcgcccgggaaagggcucgaguggguggccuuuaucagguacgacggcucgaacaaguacuaugcagauagcgugaaagggcgauucaccauaagcagggacaauagcaagaacacggucuaucuccagaugaauagcuugcgaguggaagauaccgcggucuauuacugugccaaggacuugggcgcgaacaaggacgaugaaugggccacggacuauuacgaucucucggucgcguacccggucccggacccgcgcgcggucgugggcgcguucgaugucuggggacagggcacgauggugaccgugagcucg

SEQ ID NO: 55714 - RNA, 432 nt, Artificial Sequence
  derived and/or modified sequence opt11 from anti-HIV_cap256-048-030261_VR-Chain
caagugcaauuggucgagagcggaggcggggucgugcaaccgggcgggagccugcgcuugagcugugccgcgagcggguucacguucucaacauuuggcaugcacuggguaaggcaagcgcccgggaaagggcucgaguggguggccgugaucucgcacgauggcucgaacaaguacuaugccgauagccugaaagggcgcuuuaccauaagcagggaaaauagcaagaacacgcuauaucuccagaugaauagcuugcgccuggaagauaccgcggucuaucacugugcaaaggacuugggcgggagcaagagcgaugaaugggcaacggacuauuacgaucucucggucgcguacccgguccaggacccgcgcgcggucgugggcguauucgauaucuggggccagggcacgauggugaccgugagcucg

SEQ ID NO: 55715 - RNA, 432 nt, Artificial Sequence
  derived and/or modified sequence opt11 from anti-HIV_cap256-048-029362_VR-Chain
caagugcaauuggucgagagcgggggcggggucgugcaaccgggcaggagccugcgcuugagcugugccgcgagccaguucacguucucgagcuacggcaugcacugggucaggcaagcgcccgggaaagggcucgaguggguggccgggaucucguucgcgggcacaaacaaguacuaugcagauagcgugaaagggcgcuuuaccauaagcagggacaauagcaagaacacgcucuaucuccagaugaauagcuugcgaacggaagaugccgcgcucuauuacugugccaaggacaugcgagaguucgagugcgaggaaugggccucagacuauuacgauuucgggcgcgauuacccgugccaggacccgcgcggggucgugggcauauucgauaucuggggacagggcacgauggugaccgugagcucg

SEQ ID NO: 55716 - RNA, 432 nt, Artificial Sequence
  derived and/or modified sequence opt11 from anti-HIV_cap256-048-027638_VR-Chain
caagugcaauuggucgagagcgggggcggggucgugcaaccgggcaggagcuugcgcuugagcugugucgcgagcggguucauauucucgagcuauggaauacacugggucaggcaagcgcccgggaaagggcucgaguggguggcagugaucucgggcgauggcacgaacaaguacugugccgauagcgugaaagggcgcuuuaccauaagcagggacaauagcaagaacacggucuuucuccagaugaauagcuugcgcgcggaagauaccgcggucuuuuacugugccaaggaccugggcgagagcgauaaagaggaauggccaucggacuauuacgauuucgggcgcgauuucacgggccaggucccgcgcgcggucgugggcgcguucgauaucuggggccagggcacgauggugaccgugagcucg

SEQ ID NO: 55717 - RNA, 432 nt, Artificial Sequence
  derived and/or modified sequence opt11 from anti-HIV_cap256-048-027613_VR-Chain
guccagcaauuggucgagagcgggggcgaugucgugcaaccgggaacgagccugagauugagcugugaagcgagcgggcuaauacucucgggcuauggauugcacugggucaggcaagcgccagggaaagggauggaguggguggccgugaucucguacgacggcucgaacaaguacuaugccgauagcgugaaagggcgcuuuaccauaagcagggacaauagcaagaacacggucuaucuucagaugaauagcuugcgcggggucgauaccgcggucuauuacugugccaaggacuugggagggggcgaggucgaggaaugggccacggacuauuacgauuggucgaccgcguacccgguagagcacccgcgagcggucgugggaguguucgauaucuggggccagggcacgaaagugaccgugagcucg

SEQ ID NO: 55718 - RNA, 432 nt, Artificial Sequence
  derived and/or modified sequence opt11 from anti-HIV_cap256-048-026627_VR-Chain
caagugcaauugcucgggagcgggggcgggagcgugcaaccgggcgggagcuugcgcuugaccugugccgugagcggguucacguucucgagcuuugccaugagcugggucaggcaagcgcccgggaaagggcucgaguggguggccuuuaucucgagcgauggcacgaacaagaacuauggcgauagcgugaaagggcgcuuuaccauaagcagggacaauagcaagaacacgcucuuucuccagaugaauagccugcgcgcggaagauaccgcgcuauauuacugugccaaggacuugggcggguacaagagcgaugaaugggccacggacuauuacgaucucucgaucgcguacccgauccaggacccgcgagcggucgugggcgcguucgauaucuggggccagggcacgauggugaccgugaguucg

SEQ ID NO: 55719 - RNA, 432 nt, Artificial Sequence
  derived and/or modified sequence opt11 from anti-HIV_cap256-048-026239_VR-Chain
caaaugcaauuggucgagagcgggggcggggucgugcaaccgggcaggagcuugcgcuugagcugugccgcgagcggguucacguucaauagcuaugccaugcacugggucaggcaagcgcccgggaaagggcucgaguggguggccgugaucucguacgauggcucgaacaaguacuaugccgauagcgugaaagggcgcuuuaccauaagcagggacaauagcaagaacacgcucuaucuccagaugaauagcuugcgcacggaagaugccgcgcucuauuacugugccaaggacaugagagaguucgagugcgaggaaugggccucggacuauuacgauuucgggcgcgauuacccgugccaggacccgcgcggggucgugggcauauucgauaucuggggccagggcacgauggugaccgugagcucg

SEQ ID NO: 55720 - RNA, 432 nt, Artificial Sequence
  derived and/or modified sequence opt11 from anti-HIV_cap256-048-025518_VR-Chain
caaguccaacucgucgaauccggcggcggcgucguccaacccggccgaucccuccgacucucaugcgccgucuccggcuucaccuucucccaacacgccaugcacuggguccgccaagcccccggcaaaggacucgaaugggucacccucaucuccaacgacggcaccgaaaaauucuacgccgacuccgucaaaggccgcuucaccaucucacgcgacaacuccaaaaacacacuauaccuccaaaugaacucccucuccgucgaagacaccgccgucuacuacugcgccaaagaccucggcaaaaacaaagacgacgaaugggccaccgacuacuacgacaucucaaucgccuaccccguccccgacccccgagcagucgucggcgucuucgacaucuggggccaaggcaccgucgucaccguauccucc

SEQ ID NO: 55721 - RNA, 432 nt, Artificial Sequence
  derived and/or modified sequence opt11 from anti-HIV_cap256-048-024854_VR-Chain
caagugcaauuggucgagagcgggggcggggucgugcaaccgggcaggagccugaccuugagcugugccgcgagcggguucacguucaauaacuaugacaugcacugggucaggcaagcgcccgggaaagggcucgaguggguggccuuuaccagguacgauggcucgaaccaguacuaugccgauagcgugaccgggcgcuuuacaauaagcagggacaauagcaagaacacgguauaucuccagaugaauagccugcgaggggucgauaccgcggucuauuacugugccaaggacuugggcgggggcgagguagaggaaugggcaacggacuauuacgauuggucgaucgcguacccggucgagcacccgcgcgcggucgugggaguguucgauaucuggggccagggcacgaaagugaccgugagcucg

SEQ ID NO: 55722 - RNA, 432 nt, Artificial Sequence
  derived and/or modified sequence opt11 from anti-HIV_cap256-048-024537_VR-Chain
caagugcaauugguagagagcgggggcgcggucgugcaaccgggcaggagcuugcgcuugagcugugucgcgagcggguucacguucucgagcuaugccaugcacugggucaggcaagcgcccgggaaagggcucgauuggguggccuugauaucguacgauggcucgaacaaguacuuugccgauagcgugaaagggcgauuugccauaagcagggacaauagcaagaacacgcucuaucuccagaugaauagccugcgcccggaagauaccgcggucuauuacugugccaaggacuugggcgggggcgagugcgagaccugggccucggacuauuacgauuucgggaaagauuacccgugcuuggacccgcgcgaugucgugggcacguucgauauauggguccagggcacgcucgugaccgugagcucg

SEQ ID NO: 55723 - RNA, 432 nt, Artificial Sequence
  derived and/or modified sequence opt11 from anti-HIV_cap256-048-021781_VR-Chain
caagugcacuuggucgagagcgggggcgggcucgugaaaccgggcgggagcuugcgcuugagcugugaagcaagcggguucucguucucgaacuaugccauggacugggucaggcaagcgcccgggaaagggcucgaguggguggccuuuguaucgagcgauggcucgaacaagaacuaugccgauagcgugaaagggcgcuuuaccauaagcagggacaacagcaagaacacggucuaucuacagaugaauagcuugcgcguggaagauaccgcggucuauuacugugccaaggacuugggagcgaacaaagacgaugaaugggccacggacuauuacgaucuaucggucgcguacccggucccggacccacgcgcggucgugggcgcguucgaugucuggggccagggcacgauggugaccgugagcucg

SEQ ID NO: 55724 - RNA, 432 nt, Artificial Sequence
  derived and/or modified sequence opt11 from anti-HIV_cap256-048-021758_VR-Chain
caagugcaacuggucgagagcgggggcggggucgugcaaccaggcaggagccugcgauugagcugugccgcgagcggguucacguucucgcgcuauggcaugcacugggucaggcaagcgcccgggaaagggcucgaguggguggccgugaucucguacgauggaucgaaagaguacuaugccgauagcgugaaagggcgcuuuaccauaagcagggacaauagcaaggacacgcucuaucuccagaugucgagcuugcgaguggaagauaccgcggucuauuacugugccaaggacgugggagcgaacaaggacgaugaaugggccacggacuauuacgaucuaucgaucgcguacccggucccggacccgcgcgcggucguaggcgcguucgauaucuggggccagggcacgauggugaccgugagcucg

SEQ ID NO: 55725 - RNA, 432 nt, Artificial Sequence
  derived and/or modified sequence opt11 from anti-HIV_cap256-048-020988_VR-Chain
caagugcaauuggucgagagcgggggcggggucgugcaaccgggcaggagcuugcgcuugagcugugaagcgagcgcguucacguucucgagcuauggcaugcacugggucaggcaagcgcccgggaaagggcucgagugggugaccuuuaucucguacucgggcaauaacaaguacuaugccgauagcgugaaagggcgauuuaccgugagcagggacaauagcaagaacacgcucuaucuccagaugaauagcuugaccucggaagauaccgcggucuauuacugugccaaggacuugggcggaagcaagaccgaugaauggggcacggacuauuacgaguucuggaacgcguacccgguacaggacccgcgcguggucgugggcgcguucgauaucuggggccauggcacgauggugaccgugagcucg

SEQ ID NO: 55726 - RNA, 435 nt, Artificial Sequence
  derived and/or modified sequence opt11 from anti-HIV_cap256-048-020663_VR-Chain
caaguacaacucguagaaagcgggggcggggucguacaaccgggcaugagccuacgccuaagcugcgccgcgagcggguucacauucuccaacuucggcaugcacugggucagacaagcccccggaaagggacuagaauggguggccguaaucucacacgacggcaacaacaaauacuaccccgacagcguacaagggcgcuucaccauaagcagagaaaacagcaaaaacacgcucuaccuccaaaugaacagccugaaaccagaagacaccgcggucuacuucugcgccaaggaccugggcggagaaucggaaguggaagagugggcaagcgacuacuacgacuucggcagggacauacccgggcccgaccccagaggcguagucggaacacuagacauauggggacacgggaccauggucacagucucgagc

SEQ ID NO: 55727 - RNA, 432 nt, Artificial Sequence
  derived and/or modified sequence opt11 from anti-HIV_cap256-048-020590_VR-Chain
caagugcaauuggucgagagcgggggaggggucgugcaaccgggcggagucccgcgauuggccugugccgcgagcggguucacguucucgagcuaugccaugcacuggguaaggcaagcgcccgggaaagggcucgagugggugaccguaaucucguacgauggcucgaacaaguacuaugccgauagcgugaaagggcgauuuaccauaagcagggacaauagcaagaacacgcuauaucuccagaugaauagcuugcgcgcggaagauaccgcggucuauuacugugccaaggacuugggcgggaccaaggacgaugaaugggccacggacuauuacgauaucucgaucgcguacccgguccaggacccgcgcgcggucgcgggcgcguucgauaucuggggccagggcacgauggugaccgugagcucg

SEQ ID NO: 55728 - RNA, 432 nt, Artificial Sequence
  derived and/or modified sequence opt11 from anti-HIV_cap256-048-019765_VR-Chain
caagugcaauuggucgagagcgggggcggggucgugcaaccgggcaggagcuugcgcuugagcugugccgcgagcggguucauauucacgaacuaugccauggacugggucaggcaagcgcccgggaaagggcucgaguggguggccgugaucucgagcgauggcucgaacaagaacuaugccgauagcgugaaagggcgauuuaccauaagcagggacaauagcaagaacacggucucgcuccagaugaauagcuugcgcgcggaagauaccgcggucuauuacugugccaaggacuugggcgauagcaagaaagaugaaugggccacggacuauuacgaucucucgaucgcguacccggucccggacccgagagcggucgugggcgcguucgauaucuggggccagggcacgauggugaccgugagcucg

SEQ ID NO: 55729 - RNA, 432 nt, Artificial Sequence
  derived and/or modified sequence opt11 from anti-HIV_cap256-048-019254_VR-Chain
caagugcaauuggucgagagcgggggcggggucgugcaaccgggcaggagccugcgacugagcugugccgcgagcggguucacgagcucgaccuaugccaugcacugggucaggcaagcacccgggaaagggcucgaguggguagcccugaucucguacgauggcacagacaaguacuacgccgacagcgugaaagggcgcuucaccauaagcagggacaauagcaagaacacgcucuaucuccagaugaauagcuugcgcguggaagacaccgcggucuaucacugugccaaggaccugggcgggaacaagcccgaugaaugggccacggacuacuacgaccucucgaucgcauacccgguccaggacccgcgcgcagucguaggcguguucgacaucuggggccaaggcacaaucauaaccgugagcucg

SEQ ID NO: 55730 - RNA, 432 nt, Artificial Sequence
  derived and/or modified sequence opt11 from anti-HIV_cap256-048-018073_VR-Chain
caagugcaacuggucgagagcgggggcggggucgugcaaccgggcaggagcuugcgccugagcugugccgcgagcggguucucgcucucaagcuaugccauggacugggucaggcaagcgcccgggaaagggcucgaguggguggccgugaucucgagcgauggcacgaacaaguacuaugccgauagcgugaaagggcgcuuuaccauaaccagggacaauagcaagaacacgcuauaucuacagaugaauagcuugcgcguggaagauaccgcgcucuauuacugugccaaggacaugggcgagagcgagaaagaggaaugggccucggacuauuacgauuucgggcgagauaucccgggccaggacccgcgcggggaagugggaucguucgauaucuggggccagggcacgauggugaccguaagcucg

SEQ ID NO: 55731 - RNA, 432 nt, Artificial Sequence
  derived and/or modified sequence opt11 from anti-HIV_cap256-048-016775_VR-Chain
gaagugcaauuggucgaguucgggggcgggcucgugcaaccgggcaggagcuugcgauugagcugugccgcgagcgcguucacguucucgcacuauggcauacacuggguaaggcaagcgcccgggaaagggcucgaguggguggccgugaucucgcacgauggcucgacaaaggacuaugccgauagcgugaaagggcgcuuuaccauaagcagggacaauagcaagaacacgauguaccuccagaugaauagcuugcgcgcggaagauaccgcggucuauuacugugccagggacuugggcgagagcgagaccgaggaaugggccacggacuauuacgauuucucgaucgcguacccgguccagaacccgcgaggggucauaggcgugcucgauaucuggggcuugggcacgauggugaccgugagcuca

SEQ ID NO: 55732 - RNA, 432 nt, Artificial Sequence
  derived and/or modified sequence opt11 from anti-HIV_cap256-048-016069_VR-Chain
cagguccagcucguggaaucaggcgggggcguaguccagcccgggcgcucgcucaggcucucaugcgcggccucgggcuuuaccuuuagcaaguacgcgaugcauugggugcgacaggccccgggcaagggccuggaaugggucgcguucguggcauuugacgagagcgcaaaauuuuacgcggacucggucaagggcagauucacgaucucgcgcgauaacucgaaaaauacccugagccugcaaaugaacucgcucagggccgaggacacggccguguacuauugcgcgaaagaggucggggaaaauaaagaugacgagugggcgagcgauuacuaugacuuaagcauagccuaucccgugcacgaucccagggccguggucgggggcuuugacgugugggggcaagggaccauggucacggucucgagc

SEQ ID NO: 55733 - RNA, 432 nt, Artificial Sequence
  derived and/or modified sequence opt11 from anti-HIV_cap256-048-015867_VR-Chain
caagugcaauuggucgagagcgggggcggggucgugcaaccgggaaggagcuugcgcuugagcuguagcgcgagcggguucucguucacgaacuaugccauggacugggucaggcaagcgcccgggaaagggcucgaguggguagccgugaucucaagcgauggcucaaacaagaacuaugccgauagcgugaaagggcgcuuuaccauaagcagggacaauagcaagaacacgcucuuucuccagaugaauagccugcgcccggaagauaccgcggucuauuucugugccaaggacuugggcgcgaacaaggacgaugaaugggccacggacuauuacgaucuaucgaucgcguacccgguccaugacccgcgcgcggucgugggaauauucgaucucuggggccagggaacgauggugaccgugagcucg

SEQ ID NO: 55734 - RNA, 432 nt, Artificial Sequence
  derived and/or modified sequence opt11 from anti-HIV_cap256-048-015673_VR-Chain
caagugcacuuggucgagagcgggggcggggucgugcaaccgggcaggagccugcgcuugagcugugccgcgagcggguucacguucucgaacuuugccaugggcugggucaggcaagcgcccgggaaagggcucgaguggguggccuuuaucucgagcgauggcacgaacaagaacuauggcgauagcgugaaagggcgcuuuaccauaagcagggacaauagcaagaacacgcucuuucuccagaugaauagucugcgcgcggaagauaccgcgcucuauuacugugccaaggacuugggcggguacaagagcgaugaaugggccacggacuauuacgaucucucgaucgcguacccgauccaggacccgcgcgcggucgugggcgcguucgauaucuggggccagggcacgauggugaccgugagcucg

SEQ ID NO: 55735 - RNA, 432 nt, Artificial Sequence
  derived and/or modified sequence opt11 from anti-HIV_cap256-048-015156_VR-Chain
caaguccaacucgucgaauccggcggcggcgucguccaacccggccgcucccuacgccucucaugcgccgccuccggcuucaccuucuccgucuacgcucuacacuggguccgccaaacccccggcaaaggccucgaaugggucgcccuaaucuccuacgacggcaccaacaaauacuacgucgacuccgucaaaggccgauucaccaucucccgcgacaacuccaaaaacacccucuaccuccaaaugaacucccuaaccgccgaagacaccgccguauacuacugcgccaaagaccucggcggcuccaaaaacgacgaaugggccaccgacuacuacgaccucucaaucgccuaccccauccaagacccccgcgccgucgccggaaucuucgacgucuggggccgcggcaccauggucaccgucuccucc

SEQ ID NO: 55736 - RNA, 432 nt, Artificial Sequence
  derived and/or modified sequence opt11 from anti-HIV_cap256-048-014521_VR-Chain
gaagugcaauuggucgagagcgggggcgggcucgugcaaccgggcaggagccugcgcuugagcugugccgcgagcggguucauauucucgagcuauggcauacacugggucaggcaagggcccgggaaagggcucgaguggguggccuugaucucgggcgauggcaauaacaaguacuaugccgauagcgugcaagggcgauuuagcauaagcagggacaauagcaagaacacgcucuaucuccagaugaauagcuugcgcgcggaagauaccgcggucuauuacugugccaaggacuugggcgagagcgauaaagaggaauggcccucggacuauuacgauuucgggcgcgauuucacgggccaggacccgagagcgguagugggcguguucgauaucuggggccagggcacgaccgugaucgugagcucg

SEQ ID NO: 55737 - RNA, 432 nt, Artificial Sequence
  derived and/or modified sequence opt11 from anti-HIV_cap256-048-014475_VR-Chain
caaguccaacucgucgaauccggcggcggcgucguccaacccggccgcucacuacgccucuccugcgccgccuccggcuucaccuucaacacauucggcaugcacugggucagacaagcccccggaaaaggccucgaaugggucgccgucaucucccacgacggcaacaacaaauacuacgccgacucccucaaaggccgcuucaccaucucccgcgaaaacuccaaaaacacccucuuccuccaaaugaacucccuccgcgccgaagacaccucagucuacuacugcgccaaagaccucggccacggcgaaugcgaagaaugggccuccgacuacuacgacuucggaaaagacuaccccugccuaacaccccgaggcgucgccggcaccuucgacaucuggggccacggaaccaccgucaccgucuccuca

SEQ ID NO: 55738 - RNA, 432 nt, Artificial Sequence
  derived and/or modified sequence opt11 from anti-HIV_cap256-048-013798_VR-Chain
caagugcaauuggucgagagcgggggcggggucgugcaaccgggcaggagcuugcgccugagcugugcagcgagcggguucacguucaauaacuauggcacgcacugggucaggcaagcgcccgggaaagggcucgaguggguggccgugaucucggacucgggcucgaacaaguacuaugccgauagcgugaaagggcgcuuuaccauaagcagggacaauagcaagaacacgcucuaucuccagaugaauagcuugcgcgcggaagauaccgcggucuauuucugugccaaggacuugggcgggcgcgagaccgaggaaugggccucggacuauuacgauuucgggcgcgauuucccgggccaggaccagcgcgcagucgcgggcguguucgauauguggggccagggcacgauggugaccgugagcucg

SEQ ID NO: 55739 - RNA, 432 nt, Artificial Sequence
  derived and/or modified sequence opt11 from anti-HIV_cap256-048-013271_VR-Chain
gaagugcaauuggucgagagcgggggcggggucgugcgcccgggcgggagcuugcgcuugagcugugccgcgagcggguucauauucucgagcuauggcauacacugggucaggcaagcgcccgggaaagggcucgaguggguggccgugaucucgggcgauggcacgaacaaguacugugccgacagcgugaaagggcgcuuuaccauaagcagggacaauagcaagaacacgcucuaucuccagaucaauagcuugcgcguggaagauaccgcggucuauuacugugccaaggacuugggcaagaacaaggacgaugaaugggccacggacuauuacgaucucucgauagcguacccggucccggacccgcgcgcggucgugggcguguucgauaucuggggccagggcacggucgugaccgugagcucg

SEQ ID NO: 55740 - RNA, 432 nt, Artificial Sequence
  derived and/or modified sequence opt11 from anti-HIV_cap256-048-013180_VR-Chain
caagugcaacuggucgagagcgggggcggggucgugcaaccgggcaggagcuugcgcuugagcugugccgcgagcggguucacguucucgaaaaauggcaugcacugggucaggcaagcgccagggaaagggcucgaguggguggccuuugucgcguucgauggaucggacaaguacuaugccgauagcgugaaagggcgcuuugucauaagcagggacaauaguaagaacacgcucucgcuccagaugaauagcuugcgcgcggaagauaccgcggucuauuacugugccaaggaagugggcgaggacaaggacgaugaaugggccucggacuauuacgaucucucgaucgcguacccaguacaugacccgcgagcggucgugggcggguucgauaucuggggccagggaacgauggugaccgugagcucg

SEQ ID NO: 55741 - RNA, 432 nt, Artificial Sequence
  derived and/or modified sequence opt11 from anti-HIV_cap256-048-012148_VR-Chain
caagugcaauuggucgagagcgggggcggagucgugcaaccgggcaggagcuugcgauugagcugugccgcgagcggguucacguucacgcacuaugccauggacugggucaggcaagcgccagggaaagggcuagaguggguggccgugaucucgagcgauggcucgagcaagaacuaugccgauagcguacgcgggcgcuuuaccauaagcagggacaauagcaagaacacgcuaucgcuauugaugaauggauugcgcccggaagauaccgcggucuauuacugugccaaggacgugggcgaugucaagaacgaugaaugggccacggacuauuacgaucucucgaucgcguacccgguacaggacccgcgagcggucgugggcgcguucgauuucuggggccagggcacgauggugaccgugagcgcg

SEQ ID NO: 55742 - RNA, 432 nt, Artificial Sequence
  derived and/or modified sequence opt11 from anti-HIV_cap256-048-011870_VR-Chain
caagugcaauuggucgagagcgggggcggggucgugcaaccgggcaggagcuugcgcuugagcugugccgugagcggguucacguucucguucuauggcaugcacugggucaggcaagcgcccgggaaagggcucgaguggguggccgugaucucguacgauggcaauaacaaguacuaugucgauagcgugaaagggcgcuuuaucauaagcagggacaauagcaagaacacgcucuaucuccagaugaauagcuugcgcguggaagauaccgcggucuauuacugugccagggacuugggcgagcgcgagaacgaggaaugggccacggacuauuacgauuucucgaucgcguacccgaucgagggcccgcgcggggucgugggcguguucgauaucuggggcaggggcacgauggugaccgugagcucg

SEQ ID NO: 55743 - RNA, 432 nt, Artificial Sequence
  derived and/or modified sequence opt11 from anti-HIV_cap256-048-011530_VR-Chain
caagugcacuuggucgagagugggggcgggguagugcaaccgggcaggagcuugcgcuugagcugugccgcgagcggguucucguucaggaacuaugccauggacugggucaggcaagcgcccgggaaagggcucgaguggguggccgugaucucgagcgauggcucagacaagcacuaugccgauagcgugcgcgggcgcuuuaccauaagcagggacaauagcaagaacacgcucuaucuccagaugaauagcuugcgcguggaagauacagcggucuauuacugugccaaggacuugggcgcgaacaagaacgaugaaugggccacggacuauuacgauuucucgaucgcguacccggucccggacccgcgcgcgguagugggagcguucgauaucuggggccagggcacgauggugaccgugagcucg

SEQ ID NO: 55744 - RNA, 432 nt, Artificial Sequence
  derived and/or modified sequence opt11 from anti-HIV_cap256-048-010968_VR-Chain
caagugcaauuggucgagagcgggggcggggucgugcaaccgggcaggagcuugcgccugagcugugccgcgagcggguucauauucucgagcuauggcaugcacugggucaggcaagcgcccgggaaagggcucgaguggguggccuugaucucaggcgauggcucgaacaaguacuaugccgauagcgugaaagggcgcuuuaccauaagcagggacaauagcaagaacacgcuauaucuccagaugaauagcuugcgcgcggaagauagcgcgcucuauuucugugccaaggacuugggcgagagugauaaagaggaauggcccucggacuauuacgauuucgggcgcgauuucacgggccaggucccgcgcgcggucgugggcauauucgauauguggggccagggaacgauggugaccgugagcucg

SEQ ID NO: 55745 - RNA, 426 nt, Artificial Sequence
  derived and/or modified sequence opt11 from anti-HIV_cap256-048-010224_VR-Chain
gaagugcacuuggucgagagcgggggcgaucucgugcaaccgggcgggagcuugcgcuugagcugugucgugagcgaguucacguucucgagcuauggcaugcacugggucaggcaagcgcccgggaaagggcucgaguggguggccuuuaucagguacgauggcucgaacaaguacuaugccgauagcgugaaagggcgcuuuaccauaagcagggacaauagcaaggucuaucucgagaugaauagcuugcgcgcggaagauaccgcggucuauuacugugccaaggaagugggcgagaacaaggacgaugaaugggccucggacuauuacgaucucucgaucgcguacccgauccaugacccgcgcgcggucgugggcggguucgauaucuggggccagggcacgauggugaccgugagcuca

SEQ ID NO: 55746 - RNA, 432 nt, Artificial Sequence
  derived and/or modified sequence opt11 from anti-HIV_cap256-048-009749_VR-Chain
caagugcaauuggucgagagcgggggcggggucgugcaaccgggcaggagcuugcgauugagcuguggcgcgagcggguucacauucucaagcuaugccaugcacugggucaggcaagcgcccgggcgcgggcucgaguggguggccuuuaccucgagcgauggcucgaacaagaacuauggcgauagcgugaaagggcgcuuuacaauaagcagggacaauagcaagaacacgcuauuucuccagaugaauagcuugcgcgcggaagauaccgcgcucuauuacugugccaaggacgugggcgaguacaagagcgaugaaugggccacggacuauuacgaucucucgaucgcguacccgauacaggacccgcgcgcgauggugggcgcguucgauaucuggggccagggcacgauggugaccgugagcucg

SEQ ID NO: 55747 - RNA, 432 nt, Artificial Sequence
  derived and/or modified sequence opt11 from anti-HIV_cap256-048-009623_VR-Chain
caagugcaauuggucgagagcgggggcggggucgugcaaccgggcaggagcuugcgccugagcugugccgcgagcggguucucguucucgaaauauggcaugcacugggucaggcaagcgcccgggaaagggcucgaguggguggccuuugucgcguucgaugaaggggacaaguacuaugucgauagcgugaaagggcgcuuuaccauaagcagggacaauagcaagaacacgcuaucgcuccagaugaauagcuugcgcgcggaagauaccgcggucuauuacugugccaaggaagugggagagaacaaggacgaugaaugggccucggacuauuacgaucucucgaucgcguacccgauccaugacccgcgcgcggucgugggcggguucgauaucuggggccagggcacaauggugaccgugagcuca

SEQ ID NO: 55748 - RNA, 432 nt, Artificial Sequence
  derived and/or modified sequence opt11 from anti-HIV_cap256-048-008234_VR-Chain
caagugcaauuggucgagagcgggggcggggucgugcaaccgggcaggagcuugcgcuugagcugugcagcgagcggguucacguucacgaacuaugccauggacugggucaggcaagcgcccgggaaagggcucgaguggguggccgugaucucgagcgauggcucgaacaagaacuaugccgauagcgugaaagggcgcuuuaccauaagcagggacaauagcaaaaacacgguauaucuccagaugucgagcuugcgcccggaagauaccgcggucuauuacugugccaaggacgugggcgauaccaagagcgaugaaugggccacggacuauuacgaucucucgaucgcguacccgguccaggacccgcgcgcgguagugggcgcguucgauauauggggccagggcacgauggugaccgugagcucg

SEQ ID NO: 55749 - RNA, 432 nt, Artificial Sequence
  derived and/or modified sequence opt11 from anti-HIV_cap256-048-008149_VR-Chain
caaguccaacucgucgaauccggcggcggcgucguccaaccuggccgcucccuccgacucuccugcgccgccucaggcuucaccuucuccgucuacaccaugcacuggguccgacaagcccccggcaaaggccucgaaugggucgccgucaucuccuacgacggccgcaacaaguacuacgccgacagcguaaaaggccgcuucaccaucucccgcgacaacuccaaaaacaccgucuaccuacaaaugaacucccuccgcgucgaagacaccgccgucuacuacugcgccaaagaccuaggcgcaaacaaagacgacgaaugggccacagacuacuacgaccucuccgucgccuaccccgucccagacccccgcgccgucgucggcgccuucgacgucuggggccaaggaaccauggucaccgucuccucc

SEQ ID NO: 55750 - RNA, 432 nt, Artificial Sequence
  derived and/or modified sequence opt11 from anti-HIV_cap256-048-007301_VR-Chain
caaguccaacucgucgaauccggcggcggcgucguccaacccggccgcucccuccgccucuccugcgccgccuccggcuucuccuucaacuacuacgccauggacuggguccgccaagcccccggcaaaggccucgaaugggucgccguaauaucauccgacggccgcaacaaaaacuacgccgacuccgucaaaggccgcuucaccaucucacgcgacaacuccaaaaacacccucuaccuccaaaugaacucccucuccgucgaagacaccgccgucuacuacugcgccaaagaccucggcaaaaacaaagacgacgaaugggccaccgacuacuacgacaucuccaucgccuaccccguccccgaccccagagccguagucggcguauucgacaucuggggccaaggcacagucgucaccgucucaucc

SEQ ID NO: 55751 - RNA, 432 nt, Artificial Sequence
  derived and/or modified sequence opt11 from anti-HIV_cap256-048-007174_VR-Chain
caagugcaauuggucgagagcgggggcggggucgugcaaccgggcaggagcuugcgccuaagcugugccgcgagcggguucacguucaauagcuauggcauggccugggucaggcaagcgcccgggaaagggcucgaguggguggccuugaucucguacgauggcucgaacaaguacuaugccgauagcgugcgcggacgcuuuaccauaagcagggacaauagcaaggacacgcucuaucuacagauggauggcuugcgcccggaagauaccgcgcucuauuacugugccaaggacuugggcgagagcgagugcgaggaaugggccucggacuauuacgauuucgggcgagauuacccgugcuuggccccgcgcggggucccgggcacguucgauaucuggggccagggcacgauggugaccgugagcucg

SEQ ID NO: 55752 - RNA, 432 nt, Artificial Sequence
  derived and/or modified sequence opt11 from anti-HIV_cap256-048-007079_VR-Chain
caaguccaacucgccgaauccggcggcggcgucguccaacccggccgcucccuccgccuauccugcgccgccuccggcuucaccuucuccaucuacggcaugcacuggguccgccaagcccccggcaaaggccucgaaugggucgccuucauccucucugacggcaccgacaaauacuccgccgacuccgucaaaggccgcuucaccaucucccgcgacaacuccaaaaacacccucuaccuccaaaugaacucacuccgcgccgaagacaccgccgucuacuacugcgccaaagaccucggcaaagccaaagacgacgaaugggccaccgacuacuacgacuucuccaucgccuaccccguccacgacccccgcggcgucgccggcaucuucgacaucuggggccaaggcaccaugguaaccgucuccucc

SEQ ID NO: 55753 - RNA, 432 nt, Artificial Sequence
  derived and/or modified sequence opt11 from anti-HIV_cap256-048-007033_VR-Chain
caagugcaauuggucgagagcgggggcggggucgugcaaccgggcaggagcuugcgauugagcugugccgcgagcggguucacguucucgaacuuuggauuucacugggucaggcaagcgcccggaaaagggcucgaguggguggccgcgaucucguucgcgggcaauaacaaguacuaugccgauagcgugaaagggcgcuuuaccauaagcagggaaaauagcaagaacauacucuaucuccagaugaauagcuugcgaggggaagauacagcggucuauuacugugccaaggacuugcgcgaguucgagugcgaggaaugggccucggacuauuacgauuucgggcgcgauuacccgugccaggacccacgcggggucgugggcacguucgaugucuggggccauggcucgcucgugaccgugagcucg

SEQ ID NO: 55754 - RNA, 432 nt, Artificial Sequence
  derived and/or modified sequence opt11 from anti-HIV_cap256-048-006128_VR-Chain
caaguccaacucgucgaauccggcggcggcgucguccaacccggccgcucccuccgccucuccugcgccgccuccggcuucaccuucuccaccuacgccaugcacuggguccgacaagcccccggcaaaggccuagaaugggucgcccucaucuccuacgacggcaccgacaaauacuacgccgacucagucaaaggccgcuucaccaucucccgcgacaacuccaaaaacacccuauaccuccaaaugaacucucuccgcgucgaagacaccgccgucuaccacugcgccaaagaccucggcggcuccaaauccgacgaaugggccaccgacuacuacgacuggucaaucgccuaccccguccacgacccccgcgcagucgucggcgucuucgacaucuggggccaaggcacccuagucaccguauccuca

SEQ ID NO: 55755 - RNA, 432 nt, Artificial Sequence
  derived and/or modified sequence opt11 from anti-HIV_cap256-048-005999_VR-Chain
caaguccaacucgucgaauccggaggcggcgucguccaacccggccgcucccuccgacucuccugcgccgccuccggcuucaccuucacccacuucgccauggacuggguccgccaagcccccggcaaaggccucgaaugggucgccgucaucuccucugacggcagcuccaaaaacuacgccgacuccgucaaaggccgauucaccaucucccgcgacaacuccaaaaacaccgucucccuccaaaugaacucccuccgccccgaagacaccgccgucuacuacugcgccaaagaccucggcgccaacaaagacgacgaaugggccaccgacuacuacgaccucuccaucgccuaccccguccccgacccccgcgccgucgucggcgccuucgacaucuggggccaaggcaccauggucaccgucucaucc

SEQ ID NO: 55756 - RNA, 432 nt, Artificial Sequence
  derived and/or modified sequence opt11 from anti-HIV_cap256-048-005394_VR-Chain
caagugcaauuggucgagagcgggggcggggucgugcaaccgggcaggagcuugcgcuugagcugugccgcgagccaguucacguucucgagcuauggcaugcacugggucaggcaagcgcccgggaaagggcucgaguggguggccgcgaucucguucgcgggcacgaacaaguacuaugccgauagcgugaaagggcgcuuuaccauaagcagagacaauagcaagaacgcgcucuaucuccagaugaauagccugcgcgcggaagauaccgcgcucuauuacugugcaaaggacuugcgagaguucgagugcgaggaaugggccucggacuauuacgauuucgggcgcgauuacccgugccaggacccgcgcggggucgugggcacguucgauaucuggggccagggcacgauggugaccgugagcucg

SEQ ID NO: 55757 - RNA, 432 nt, Artificial Sequence
  derived and/or modified sequence opt11 from anti-HIV_cap256-048-004226_VR-Chain
caagugcaauuggucgagagcgggggcggggucgugcaaccgggcaggagcuugcgccugagcugugccgcgagcggguucacguucaauaaacauggcaugcacuggguaaggcaagcgcccgggaaagggcucgaguggguggccuuugucgcguucgauggcucggacaaguacuaugccgauagcgugaaagggcgcuuuaccauaagcagggacaauagcaagaacacgcuaucgcuccagaugaauaacuugcgcgcggaagauaccgcggucuauuacugugccaaggaagugggcgauaacaaggacgaugaaugggccucggacuauuacgaucuaucgaucgcguacccgguccaggacccgcgcgcggucgugggcggguacgauaucuggggccagggcacgauggugaccgugagcucg

SEQ ID NO: 55758 - RNA, 432 nt, Artificial Sequence
  derived and/or modified sequence opt11 from anti-HIV_cap256-048-004097_VR-Chain
caaguccaacucgucgaauccggcggcggcgucguccaacccggccgcucacuccgccucucuugcgccgccuccggcuucaccuucuccgccuacaccguccacuggguccgacaagcccccggccgcggccucgaaugggucuccgucaucucauacgacgaccgcaacaaauacuacgcccacucagucaaaggccgcuucaccaucucccgcgacaacuccaaaaacacccucuaccuccaaaugaacucacuccgccgcgaagacaccgccgucuacuacugcgccaaagaccuaggcgccaacaaagacgacgaaugggccaccgacuacuacgaccucuccaucgccuaccccguccccgacccccgcgccgucgucggcgccuucgacaucuggggccaaggcaccaugguaaccguauccucc

SEQ ID NO: 55759 - RNA, 432 nt, Artificial Sequence
  derived and/or modified sequence opt11 from anti-HIV_cap256-048-003289_VR-Chain
caagugcaacuggucgagagcgggggcggggucgugcaaccgggcaggagccugcgcuugagcugugccgcgagcggguucacguucucgaaauauggcaugcacugggucaggcaagcgcccgggaaagggcucgaguggguggccuuugucgcguucgauggaucgagcaagaacuaugccgauagcgugaaagggcgauuuaccauaagcagggacaacagcaagaacacggucucgcuccagaugaauagcuugcgcccggaagauaccgcggucuauuacugugccaaggacuugggcgcgaacaaggacgaugaaugggccacggacuauuacgaucucucgaucgcguacccggucccggacccgcgagcggucgugggcgcguucgauaucuggggccagggcacgauggugaccgugagcucg

SEQ ID NO: 55760 - RNA, 432 nt, Artificial Sequence
  derived and/or modified sequence opt11 from anti-HIV_cap256-048-002601_VR-Chain
caagugcaauuggucgagagcgggggcgggguaguacaaccgggcaggagcuugcgauugagcugugccgcgagcggguucucguucaauaacuaugccauggacuggguaaggcaagcgcccgggaaagggcucgaguggguggccgugaucucgagcgacggcaggaacaagaacuaugccgagagcgugaaagggagauuuaccauaagcagggacaauagcaagaacacggucuaucuccagaugaauagcuugcgcgcggaagauaccgcggucuauuacugugccaaggacgugggcgauaccaagaaagaugaaugggccacggacuauuacgaucucucgaucgcguacccgguccaggacccgcaagcggucgugggcgcguucgauaucuggggccagggcacgauggugaccgugagcucg

SEQ ID NO: 55761 - RNA, 432 nt, Artificial Sequence
  derived and/or modified sequence opt11 from anti-HIV_cap256-048-002129_VR-Chain
caagugcaauuggucgagagcggaggcggggucgugcaaccgggcaggagcuugcgcuugagcugugccgcgagcggguucacguucucgaccuaugccaugcacugggucaggcaagcgcccgggaaagggcucgaguggguggcauugaucucguacgauggcacggacaaguacuaugccgauagcgugaaagggcgcuuuaucauaagcagggacaauagcaggagcacgcucuaucuccagaugaauagcuugcgcuuggaagauaccgcggucuaucacugugccaaggacuugggcgggagcaagagcgaugaaugggccacggacuauuacgaucucucggucgcguacccgguccaggacccgcgagcggucgugggcguguucgauaucuggggccagggcacgauggugaccgugagcucg

SEQ ID NO: 55762 - RNA, 432 nt, Artificial Sequence
  derived and/or modified sequence opt11 from anti-HIV_cap256-048-001875_VR-Chain
caagugcaauuggucgagagcgggggcgggguagugcaaccgggcgggagcuugcgcuugagcugugccacgagcgggcucacguucucgaacuauggcaugcacugggucaggcaagcgcccgggcgagggcucgaguggguggccuuuaccagguacgauggcacguacaauuacuaugccgauagcgugaaagggcgcuuuaccauaagcagggacaauagcaagggcacgcuauaucuccagauggauggccugcgcccggaagauaccgcgcucuauuacugugccaaggacuugggagagcgcgagugcgaggaaugggccucggacuauuacgauuucgggcgcgauuucccgugccaggacccgcgcggggucgugggcacguucgauaucuggggccagggcacgauggugaccgugagcucg

SEQ ID NO: 55763 - RNA, 432 nt, Artificial Sequence
  derived and/or modified sequence opt11 from anti-HIV_cap256-048-001302_VR-Chain
caagugcaauuggucgagagcgggggcggagucgugcaaccgggcaggagcuugcgcuugagcugugcagcgagcggguucacguucucguacucgggcaugcacugggucaggcaagcgcccggaaaagggauggaguggguggccgugaucucguacgauggcucgaacaaguacuaugccgauagcgugaaagggcgauuuacaauaagcagggacaauagcaagaacacggucuaucuccagaugaauagcuugcgaggggucgauaccgcgguuuauuacugugccaaggacuugggcgggggcgaggucgaggaaugggccacggacuauuacgauuggucgaucgcguacccggucgagcacccgcgcgcggucgugggcguguucgauaucuggggccagggaacgaaagugacagugagcucg

SEQ ID NO: 55764 - RNA, 432 nt, Artificial Sequence
  derived and/or modified sequence opt11 from anti-HIV_cap256-048-001203_VR-Chain
caagugcaauuggucgagagcgggggcggggucgugcaaccgggcaggagcuugcgcuugagcugugccgcgagcggguucacguucucgagcuaugccaugcacugggucaggcaagcgcccgggaaagggcucgaguggguggccauaaucucguacgauggcacgaucaaguacuaugccgauagcgugaaagggcgcuuuacaauaagcagggacaauagcaagaacacggucucgcuccagaugaauagcuugcgcccggaagauaccgcggucuauuacugugccaaggacgugggcgcgaacaaggacgaugaaugggccacggacuauuacgaucucucgauagcguacccggucccggacccgcgcgcggucgugggcgcguucgauaucuggggccagggcacgauggugaccgugagcucg

SEQ ID NO: 55765 - RNA, 432 nt, Artificial Sequence
  derived and/or modified sequence opt11 from anti-HIV_cap256-048-000383_VR-Chain
caagugcaauuagucgagagcgggggcggggucgugcaaccgggcaggagcuugcgcuugagcuguaccgcgagcggguucacguucaaucacuaugccauggacugggucaggcaagcgcccgggaaagggcucgaguggguggccgugaucucgagcgauggcucggacaagaccuaugccgauagcguaaaagggcgcuuuaccauaagcagggacaauagcaagaacacgguauaucuacagaugaauagcuugcgcgcggaagauaccgcggucuauuacugugccaaggacgugggcgggagcaaggacgaugaaugggccacggacuacuacgaucuaucgaucgcguacccgguaccggacccgcgcgcggucgugggcgcguucgauuucuggggcccgggcacgauggugacagugagcucg

SEQ ID NO: 55766 - RNA, 432 nt, Artificial Sequence
  derived and/or modified sequence opt11 from anti-HIV_cap256-038-261791_VR-Chain
caagugcaauuggucgaguucgggggcggggucgugcaaccgggcgggagccugcgacugagcugugccgcguucggguucacgaucucgagcuauggcaugcacugggucaggcaagcgccagggaaagggcuccaguggguggccuuuaucagguacgaugaaucgaguaaguucuaugccgauagcgugaaagggcgcuuuaccauaagcagggacaauagcgagaacacgcucuaucuccagaugaauagcuugcgcgcggaagauaccgcggucuauuacugugccaaggacuugggcgagagcgagaacgaggaaugggccacggacuauuacgauuucucgaucgcguacccgggccaggacccgcgcggggucgugggcauauucgauaucuggggccagggaacgauggugaccgugagcucg

SEQ ID NO: 55767 - RNA, 432 nt, Artificial Sequence
  derived and/or modified sequence opt11 from anti-HIV_cap256-038-241540_VR-Chain
caagugcaauuggucgagagcgggggcggggucgugcaaccgggcaggagcuugcgccugagcugugccgcgagcggguucacguucucgaacucggccaugcacugggucaggcaagcgcccgggaaagggcucgaguggguggccuugaucucguacgugggcgggaacauauacuaugccgauagcgugaaagggcgcuuuaccgugagcagggacaauagcaagaaaacacucuaucuccagaugaauagcuugcgcguggaagauaccgcagucuauuacugugucaaggacgugggcgagagcgagaacgaggaaugggccucggacuauuacgauuucgggcgcgauuacccgggccaggacacgcgcgcagucgugggcgcguucgauaucuggggccagggcacgauggugaccgugagcucg

SEQ ID NO: 55768 - RNA, 432 nt, Artificial Sequence
  derived and/or modified sequence opt11 from anti-HIV_cap256-038-235677_VR-Chain
cucgugcaacuggucgagagcgggggcggggucgugcaaccgggcgggagcuugcgcuugagcugugccgcgagcggguucagguucucgagcuauggcaugcacugggucaggcaagcacccgggaaagggcucgaguggguggccuuuaucagguacgauggcucguucaaggacuaugccgauagcgugcgcgggcgcuuuaccauaagcagggaaaauagcaagaacacgcucuaucuccagaugaauagcuugcgcacggacgauaccgcggucuauuacugugccaaggacuugggcgagagcgagaccgaggaauggcccucggacuauuacgauuucgggcgcgauuacccgggccaggacccgcgagggguagugggcacguucgauaucuggggccauggcacgauggugaccgugagcucg

SEQ ID NO: 55769 - RNA, 435 nt, Artificial Sequence
  derived and/or modified sequence opt11 from anti-HIV_cap256-038-234314_VR-Chain
gaagugcaauugcuagagagcgggggagggcucgugcaaccgggagggagccugcgcuugagcugugccgcgagcggguucacguucucgcgcuaugccaugagcugggucaggcaagcgcccgggaaagggcucgaguggguggcagugaucucauacgacggcucgaacaaguacuaugccgauagcgugaaagggcgcuuuaccauaagcagggacaauagcaagaacacgcucuaucuccagaugaauagcuugcgagcggucgauacagcggucuauuacugugccaaggacuugggcgagggcgagaacgaggaaugggccacggacuauuacgauuucucguacuggcucccgugcccgaaauaucacggggccuggcucgagcucuuguacauaugggggcaagggaccauggucacggucucgagc

SEQ ID NO: 55770 - RNA, 432 nt, Artificial Sequence
  derived and/or modified sequence opt11 from anti-HIV_cap256-038-234273_VR-Chain
gaagugcaauuggucgagagcgggggcgggcucauacaaccgggcgggagccugcgcuugagcugugccgcgagcggguucacggucucgaccaauuucaugagcugggucaggcaagcgcccgggaaagggcucgaguggguggccgugaucucguacgauggcaauaacaaguacuaugccgauagcgugaaagggcgcuuuaccauaagcagggaaaacagcaagaacacgcucuaucuccagaugaauagccugagaacggacgauaccgcggucuauuacugugccaaggacuugggcgagagcgagaccgaggaauggccaucggacuauuacgauuucgggcgcgauuacccgggccaggacccgcgaggggucgugggcacguucgauaucuggggccauggcacgauggugaccgugagcuca

SEQ ID NO: 55771 - RNA, 432 nt, Artificial Sequence
  derived and/or modified sequence opt11 from anti-HIV_cap256-038-223164_VR-Chain
gaagugcaauuggucgagagcgggggagggcucgugcgcccgggcgggagcuugcgcuugagcugugccgcgagcggguucucgcuagggagcuauuggaugaccugggucaggcaagcgcccgggaaagggcuagaguggguggccgugaucucguacgauggcucaaacaaguacuaugccgauagcgugaaaggacgauuuaccauaagcagggacaauagcaagaacacgcuauaucuccagaugaauagccugcgcgcggaagauaccgcgcucuauuacugugccaaggacuugggcgagagcgagaacgaggaaugggccucggacuauuacgauuucgggcgcgauuacccgggccaggacccgcgcggggucgugggcacguucgauaucuggggccagggcacgauggugaccgugagcucg

SEQ ID NO: 55772 - RNA, 432 nt, Artificial Sequence
  derived and/or modified sequence opt11 from anti-HIV_cap256-038-220289_VR-Chain
gaagugcaacuggucgagagcgggggcgggcucgugcaaccgggcgggagcuugcgcuugagcuguaccgcgagcggguucacguucucgagcuaugaaaugaacuggguaaggcaagcgcccgggaaagggccagaguggguggccgugaucucguacgacggcaauaacaaguacuaugccgauagcgugaaagggcgcuuuaccauaagcagagaaaauagcaagaacacgcuauaucuccagaugaauagccugcgcacggacgauaccgcagucuauuacugugccaaggacuugggcgagagcgagaccgaggaauggcccucggacuauuacgauuucgggcgcgauuacccgggccaggacccgcgcggggucgugggcacguucgauaucuggggccauggcacgauggugaccgugagcucg

SEQ ID NO: 55773 - RNA, 432 nt, Artificial Sequence
  derived and/or modified sequence opt11 from anti-HIV_cap256-038-220020_VR-Chain
caagugcaauuggucgagagcgggggcggggucgugcaaccgggcaggagcuugcgcuugagcugugccgcgagcggguucacguucucgcgcaaugccaugcacugggucaggcaagcgcccgggaaagggcucgaguggguggccuugaucucguacgauggcucgaacaaguacuauguagauagcgugaaagggcgauuuaccauaagcagggacaauagcaagaacacgcucuaucuccagaugaauagcuugcgcgcggacgauaccgcggucuauuacugugccaaggacuugggcgagagcgagaccgaggaauggggcacggacuauuacgauuucucgaccggguacccgguccaggacccgcgcggggucgugggcgcguucgauaucuggggccagggcacgauggugagcgugagcucg

SEQ ID NO: 55774 - RNA, 432 nt, Artificial Sequence
  derived and/or modified sequence opt11 from anti-HIV_cap256-038-216853_VR-Chain
caagugcaauuggucgagagcgggggcggggucgugcaaccgggacgcagcuugagauugagcugugccgcgagcggguucacguucucgagcuaugccaugcacuggguaaggcaagcgcccgggaaagggcucgaguggguggccgugaucucguacgauggcucgaacaaguacuaugccgauagcgugaaagggcgcuuuaccauaagcagggacaauagcaagaacacgcuauauguccagaugaauagcuugcgcgcggaagauaccgcggucuauuacugugccagggacuugggcgagagcgagaccgaggaauggcccucggacuauuacgauuucgggcgcgauuacccgggccaggacccgcgaggggucgugggaacguucgauaucuggggccauggcacgauggugaccgugagcucg

SEQ ID NO: 55775 - RNA, 432 nt, Artificial Sequence
  derived and/or modified sequence opt11 from anti-HIV_cap256-038-213466_VR-Chain
gaagugcaauuggucgagagcgggggcgggcucgugcaaccgggccgcagcuugagagugagcugugccgcgagcggguucacguucgaggacuaugcaaugcacugggucaggcaagcgcccgggaaagggcucgaguggguggcagugaucucggacgauggcaauaacaaguacuaugccgauagcgugaaagggcgcuuuaccauaagcagggacaauagcaagaacacgcucuaucuccagaugaauagcuugcgcguggaagauaccgcggucuauuacugugucaaggacgugggcgagagcgagaacgaggaaugggccucggacuauuacgauuucgggcgagauuacccgggacaggacacgcgcgcggucgugggcgcguucgauaucuggggccagggcacgauggugacagugagcucg

SEQ ID NO: 55776 - RNA, 432 nt, Artificial Sequence
  derived and/or modified sequence opt11 from anti-HIV_cap256-038-213212_VR-Chain
caagugcaauuagucgagagcgggggcggggucgugcaaccgggcgggagcuugcgcuugagcugugccgcgagcggguucauauucucggacuauggcaugcacuggguaaggcaagcgcccgggaaagggcucgaguggguggccucgaucuggcacgauggcucgaagaaauacuaugccgauagcgugaaagggcgcuuuaccauaagcagggaaaauagcaaaaacacgcucuaucuccagaugaauagccugcgcgcggaagauaccgcggucuaucacugugccaaggaccugggcgagagcgagaucgaggaauggaccucggacuauuacgauuucgggcgcgauuacccgggccaggacccgcgcggggucuuuggcacguucgauaucuggggccauggcacgauggugaccgugagcucg

SEQ ID NO: 55777 - RNA, 432 nt, Artificial Sequence
  derived and/or modified sequence opt11 from anti-HIV_cap256-038-213120_VR-Chain
caagugcacuuggucgagagcgggggcgggcuagugaaaccgggcgggagccugcgcuugagcugugccgcgagcggguucacguucucagacuauuacaugaucuggaucaggcaagcgcccgggaaaggacucgaguggguggccguaaucucgagcgauggcucgaacaagaacuaugcagauagcgugaaagggcgcuuuaccauaagcagagacaauagcaagaacacgcucuaucuccagaugaauagcuugcgcgcggaagauaccgcggucuacuacugugccaaggacuugggcgagagcgagaacgaggaaugggccacggacuauuacgauuucgcgaccggguacccgguccaggacccgcgcgcggucgugggcgcguucgacaucuggggccagggcacgauggugaccgugagcccg

SEQ ID NO: 55778 - RNA, 432 nt, Artificial Sequence
  derived and/or modified sequence opt11 from anti-HIV_cap256-038-212592_VR-Chain
cucgugcaacuggucgagagcgggggcggggucgugcaaccgggcaagagcuugcgcuugagcugugccgcgagcggguucacguucucgagcuaugccaugcacuggaucaggcaagcgcccgggaaagggcucgaguggguggccgugaucucggacgauggcucgaucaagaacuaugccgauagcgugaaagggcgcuuuaccauaagcagggacacgagcaagaaauugauguaucuccagaugaauagcuugagcgcgaacgauaccgcggucuauuacugugccaaggacuugggcgagcgagagaacgaggaaugggcaucggacuauuacgauuucgggcgcgauuacccgggccaggacccgcgaggggucguaggcucgaucgauaccuggggccauggcacgauggugaccgugagcucg

SEQ ID NO: 55779 - RNA, 432 nt, Artificial Sequence
  derived and/or modified sequence opt11 from anti-HIV_cap256-038-211790_VR-Chain
gaacugcaauuggucgagagcgggggcgggcucgugcaaccgggcgggagcuugcgcuugagcugugucgugagcggguucacggucucgaccaauuacauaagcugggucagacaagcgcccgggaaagggcucgaguggguggccgugaucucguacgauggcucgaacaaguacuaugccgauagcgugaaagggcgcuuuacaauaagcagggacaauagcaagaacacgcucuaucuccagaugaauagcuugcgcgcggaagauaccgcgcucuauuacugugccaaggacuugggagagagcgagaacgaggaaugggccucggacuauuacgauuucgggcgcgauuacccgggccaggacccgcgcggggucgugggcacguucgauaucuggggccagggcacgauggugaccguaagcucg

SEQ ID NO: 55780 - RNA, 432 nt, Artificial Sequence
  derived and/or modified sequence opt11 from anti-HIV_cap256-038-209916_VR-Chain
caagugcaauuggucgagagcggaggcggggucgugcaaccgggcgggagcuugcgcuugagcugugccgcgagcggguucacguucucgagcuuuggaaugcacugggucaggcaagcgcccgggaaagggcucgagugggugagcuuuaucaggaacgauggcgggaucagguacucggccgauagugugcgcgggcgcuuuaccauaagcagggacaauagcaagaacacgcucuaucuccagaugaauagcuugcgcacggacgauaccgcggucuauuacugugccaaggacuugggcgagagcgagaccgaggaauggccaucggacuauuacgauuucgggcgcgauuacccgggacaggacccgcgcggggucgugggcacguucgauaucuggggccauggcacgauggugaccgugagcucg

SEQ ID NO: 55781 - RNA, 432 nt, Artificial Sequence
  derived and/or modified sequence opt11 from anti-HIV_cap256-038-207938_VR-Chain
caagugcaauuggucgagagcgggggaggggucgugcacccgggcaggagcuugcgcuugagcugugcagcgagcggguucacguucucgagcuauggcaugcacugggucaggcaagcgcccgggaaagggcucgaguggguagccgugaucucgcacgauggcucgaacaaguacuaugccgauagcgugaaagggcgcuuuaccauaagcagggacaauagcaaaaacacgcucuaucuccagaugaauagcuugcgcgcggaagauaccgcggucuauuacugugccaaggacuugggcgagagcgagaacgaggaaugggccucggacuauuacgauuucgggcgcgauuacccgggccaggacccgcgcggggucguaggcguguucgauaucuggggccagggcacgauggugaccgugagcucg

SEQ ID NO: 55782 - RNA, 432 nt, Artificial Sequence
  derived and/or modified sequence opt11 from anti-HIV_cap256-038-202245_VR-Chain
caaguacacuuggucgagagcgggggcggggucgugcaaccgggcaggagcuugcgcuugagcuguaccgugagcggguucacguucgggagcuaugccuugcacugggucaggcaagcgcccgggaaagggcucgagugguugagcguaaucucguacgauggcaauaacaaguacuaugccgauagcgugaaagggcgcuuuaccauaagcagggaaaauagcaagaacacgcucuaucuccagaugaauagccugcgcgcggaagauaccgcggucuaucacugugccaaggacuugggagagagcgagaaagaggaaugggccucggacuauuacgauuucgggcgcgauuacccgggccaggacccgcgcggggucgugggcacguucgauaucuggggccauggcacgauggugaccgugagcucg

SEQ ID NO: 55783 - RNA, 432 nt, Artificial Sequence
  derived and/or modified sequence opt11 from anti-HIV_cap256-038-197721_VR-Chain
caagugcaacugguagagagcgggggcggggucgugcaaccgggcaagagcuugcgcuugagcugugccgggagcggguucauauucucgaacuaucccaugcacugggucaggcaagcgcccgggaaagggcucgaguggauggccgaugucucguacgauggcucgaacaaggacuaugccgauagcgugaaagggcgauuuaccauaagcagggacaauagcaagaacacgcuauaucuacagaugaauagcuugcgcgcggaagauaccgcggucuauuacugugucaaggacguaggcgagagcgagaacgaggaaugggccucggacuauuacgauuucgggcgcgauuacccgggccaggacacgcgcgcggucgugggcgcguucgauaucuggggccagggcacgauggugaccgugagcucg

SEQ ID NO: 55784 - RNA, 432 nt, Artificial Sequence
  derived and/or modified sequence opt11 from anti-HIV_cap256-038-196679_VR-Chain
gaaguacaauugcuagagagcgggggcgggcucgugcaaccgggcgggagcuugcgccugagcugugccgcgagcggguucacguucucgagcuaugccaugagcugggucagacaagcgcccgggaaagggcucgaguggguggccgugaucucauacgauggagggaacaaguacuaugccgauagcgugaaagggcgcuuuaccauaagcagggacaauagcaagaacacgcucuaucuacagaugaauagcuugcgcgcggaagauaccgcgcucuauuacugugccaaggacuugggcgagagcgagaacgaggaaugggccucggacuauuacgauuucgggcgcgauuacccgggccaggacucgcgcggggucgugggaacguucgauguauggggccagggcacgauggugacagugagcucg

SEQ ID NO: 55785 - RNA, 438 nt, Artificial Sequence
  derived and/or modified sequence opt11 from anti-HIV_cap256-038-196118_VR-Chain
caagugcaauugguagagagcgggggcggggucgugcaaccgggagggagcuugcgcuugagcugugccgcgagcggguucacguucucgacauauggcaugcacugggucaggcaagcgcccgggaaagggcucgagugggugaccuuuaucaggaacgauggcacgaacaaguacuaugccgauagcgugaaagggcgcuuuaccauaagcagggacaauaccaagaacacgcucuaucuccagauguauagcuugagagcggaagauaccgcggucuauuacugugccaaggacuugggcgagagcgagaacgaggacgaggaaugggccucggacuauuacgauuucgggcgagauuacccgggccaggacucgcgcggggucgugggcacguucgacauguggggccagggcacgauggugacagugagcucg

SEQ ID NO: 55786 - RNA, 429 nt, Artificial Sequence
  derived and/or modified sequence opt11 from anti-HIV_cap256-038-195382_VR-Chain
caagugcacuuggucgagagcgggggcggggucgugcaaccaggcaggagcuugcgcuugagcugugcagcgagcggguucacguucucgaacuaucccgugcacugggucaggcaagcgcccgggaaagggcucgaguggguggccgugaucucguucgauggcauaaacaauuacgcgggcucggucaagggcagguucauaaucucgcgcgauaacucgaaaaauaccuuguaccugcaaaugaacucgcucagggccgaggacacggccguguacuauugcgugaaagaucucggggaaucggaaaaggaagaguggccgagcgauuacuaugacuuuggcagggacuaucccgggcaagauagcaggggcguggucggggucuuugacauaugggggcaagggaccauggucacggucucgagc

SEQ ID NO: 55787 - RNA, 432 nt, Artificial Sequence
  derived and/or modified sequence opt11 from anti-HIV_cap256-038-180001_VR-Chain
gaagugcaauuggucgagagcgggggcgggcucgugcaaccgggcaggagcuugcgcuugagcuguaccgcgagcggguucacguucggggacuaugccaugagcugguucaggcaagcgcccgggaaagggcucgaguggguggccgauaucucguacgauggcucgaacaaguacuaugccgauagcgugaaagggcgcuugaccauaagcagggacaauagcaagaacacgcucuaucuccagaugaauagccugcgcgcggaagauaccgcggucuauuacugugucaaggacuugggcgagagcgagaaagaggaauggcccucggacuauuacgauuucgggcgcgauuacccgggccaggacucgcgcggggucgugggcguguucgauaucuggggccagggcacgauggugaccgugagcucg

SEQ ID NO: 55788 - RNA, 432 nt, Artificial Sequence
  derived and/or modified sequence opt11 from anti-HIV_cap256-038-178021_VR-Chain
caagugaaauuggucgagagcgggggcggggucgugcaaccgggcgggagcuugcgcuugagcugugccgcagccggguucauauucucgaacucgggcaugcacugggucaggcaagcgcccgauaaagggcucgaguggguggccuuugucccguacgauggcucgaacaaguacuaugccgauagcgugaaagggcgcuuuacaauaagcagggacaauagcaagaacacgcucucgcuccagaugaauagcuugcgcacggaagauaccgcggucuauuacugugccaaggacuugggcgagagcgagaccgaggaauggcccucggacuauuacgauuucgggcgcgauuacccgggccaggacccgcgcggggucgugggcacauucgauaucuggggccauggcacgauggugaccgugagcucg

SEQ ID NO: 55789 - RNA, 432 nt, Artificial Sequence
  derived and/or modified sequence opt11 from anti-HIV_cap256-038-177104_VR-Chain
gaagugcaauugcuagagagcgggggcgggcucgugcaaccgggcgggagcuuacgcuugagcugugccgcgagcggguucacguucucaagcuaugccaugaacugggucaggcaagcgcccgggaaagggcucgaguggguggccgugaucucguacgauggcggggacaaguacuaugccgauagcgugaaagggcgcuuuaccauaagcagggacaauagcaagaacacgcucuaucuacagaugaauagcuugcgcguggaagauaccgcggucuauuacugugucaaggacgugggcgagagcgagaacgaggaaugggccucggacuauuacgauuucgggcgagauuacccgggccaggacacgcgcgcggucgugggcgcguucgauaucuggggccagggcacgauggugacagugagcucg

SEQ ID NO: 55790 - RNA, 432 nt, Artificial Sequence
  derived and/or modified sequence opt11 from anti-HIV_cap256-038-171261_VR-Chain
caagugcaauugguagagagcgggggcggggucgugcaaccgggcaggagcuugcgcuugagcugugccgcgagcggguucacguucucgagcuaugccauguacugggucaggcaagcgcccgggaaagggcucgaguggguggccgugaucucgagcgauggcucggacaagaacuaugcagauagcgugaaagggcgcuuuaccauaagcagggacaauagcaacaacacgcucuaucuccagaugaauagcuugcgcgcggaagauaccgcggucuauuacugugccagggacuugggcgagagcgagaacgaggaauggcccucggacuauuacgauuucgggcgcgauuacccgggccaggacccgcgcggggucauaggcacguucgaugucuggggacagggcacgauggugaccgugagcucg

SEQ ID NO: 55791 - RNA, 432 nt, Artificial Sequence
  derived and/or modified sequence opt11 from anti-HIV_cap256-038-169090_VR-Chain
caagugcaauuggucgagagcgggggcggggucgugcaaccgggcaggagcuugcgccugagcugugccgcgagcagguucacguucaagaccuauaccaugcacugggucaggcaagcgcccgggaaagggcucgaguggguggccuugaucucguacgauggcucgaacaaguacuaugccgauagcgugaaagggcgauugaccauaagcagggacaauagcaagaacacgcuauaccuccagaugaauagcuugcgcgcggaagauaccgcggucuacuacugugucaaggacuugggcgagagcgagaaagaggaauggcccucggacuauuacgauuucgggcgcgauuacccgggacaggacucgcgcggggucgugggcguguucgauaucuggggccagggcacgauggugaccgugagcucg

SEQ ID NO: 55792 - RNA, 432 nt, Artificial Sequence
  derived and/or modified sequence opt11 from anti-HIV_cap256-038-168705_VR-Chain
gaggugcaguugguggagagcgggggggggcuggugaagccgggggggagcuugagguugaguugugcggcgagcggguucacguucaguagcuauagcaugaacugggugaggagggcgccggggaaggggcuggaguggguggcguugauaaguuacgaugagaauaagaaguacuaugcggauagcgugaaggggagguuuacgauaagcagggagaauagcaagaacacgcuguaucugcagaugaauagcuugagggcggaggauacggcgguguauuacugugcgaaggacuugggagagagggagaacgaggagugggcgucggacuauuacgauuucgggagggauuacccggggcaggacccgaggggggugguggggaguauagauacgugggggcaugggacgauggugacggugagcagu

SEQ ID NO: 55793 - RNA, 432 nt, Artificial Sequence
  derived and/or modified sequence opt11 from anti-HIV_cap256-038-167685_VR-Chain
caagugcaauuggucgagagcgggggcggggucgugcaaccgggcaggagcuugcgccugagcugugccgcgagcgggaucacguucucgagcuaugccauacacugggucaggcaagcgcccgggaaagggcucgaguggguggccgugaucucguacgauggcucaaacaaguacuaugccgauagcgugaaagggcgcuuuaccauaagcagggacaauagcaagaacacgcucuaucuacagaugaauagcuugcgcgcggaagauaccgcggucuauuacugugccaaggacuugggcgagagcgagaacgaggaaugggccacggacuauuacgauuucucgauaggguacccgggccaggacccgcgaggggucgugggcgcguucgauauauggggccagggcacgauggugaccgugagcuug

SEQ ID NO: 55794 - RNA, 432 nt, Artificial Sequence
  derived and/or modified sequence opt11 from anti-HIV_cap256-038-158775_VR-Chain
caagugcaauuggucgagagcgggggcggggucgugcaaccgggcgggagccugcgccugagcugugccgcgagcggguucacguucucgaccuauggcaugcacugggucaggcaagcgccagggaaagggcuagaguggguggccuuuaucagggacaauggcucgaacaaguacuaugccgauagcgugaaagggcgauuuaccauaagcagggacaauagcaagaacacgcuauaucuccagaugaauagcuugcgcgcggaagauaccgcgcuauauuacugugccaaggacuugggagagagcgagaacgaggaaugggccucggacuauuacgauuucgggcgcgauuacccgggccaggacucgcgcggggucgugggcacguucgaugucuggggccagggcacgauggugaccgugagcucg

SEQ ID NO: 55795 - RNA, 432 nt, Artificial Sequence
  derived and/or modified sequence opt11 from anti-HIV_cap256-038-157318_VR-Chain
cacgugcaauuggucgagagcgggggcggggucgugcaaccgggcaggagcuugcgcuugagcugugccgcgagcgggaucacguucucgaccuaugacaugcacugggucaggcaagcgcccgggaaagggcucgaguggguagccgugaucucgaacgauggcucgaacaaguacuaugccgauagcgugaaagggcgcuuuaccauaagcagggacaauagcaagaacacgcucuaucuccagaugaauagcuugcgcgcggaagauaccgcgcucuauuacugugccaaggacuugggcgagagcgagaaagaggaaugggccucggacuauuacgauuucgggcgcgauuacccgggccaggacccgcgcggggucguggccacguucgauaucuggggccagggcacgauggugaccgugagcucg

SEQ ID NO: 55796 - RNA, 432 nt, Artificial Sequence
  derived and/or modified sequence opt11 from anti-HIV_cap256-038-153058_VR-Chain
caagugcaauuggucgagagcgggggcggggucgugcaaccgggcaggagcuugcgcuugagcugugccgcgagcggguucacguucucaacauacgccaugcacugggucaggcaagcgcccgggaaagggcucgaguggguggccgugaucucguacgauggcucgcacucguacuaugccgggagcgugaaagggcgcuuuaccacgagcagggacaauagcaagaacacgcucaaucuccagaugaauagcuugcgcccggaagauaccgcgcucuauuacugugccaaggacuugggcgagagcgagaacgaggaaugggccucggacuauuacgauuucgggcgcgauuacccgggccaggacucgcgcggagucgugggcacguucgaugucuggggccagggcacgauggugaccgugagcucg

SEQ ID NO: 55797 - RNA, 432 nt, Artificial Sequence
  derived and/or modified sequence opt11 from anti-HIV_cap256-038-150027_VR-Chain
cucgugcaauuggucgagagcgggggcggggucgugcaaccgggcgggagccugcgcuugagcugugccgcaagcggguucagguucucgagcuauggcaugcacugggucaggcaagcgcccgggaaagggcucgaguggguggccuuuaucagguacgauggcucguucaaggacuaugccgauagcgugcgcgggcgcuuuaccauaagcagggacaauagcaagaacacggucuauguccagaugaauagcuugcgagcggaagauaccgcggucuauuacugugccaaggacuugggcgagagcgagaacgaggaaugggccacggacuauuacgauuucgcgaccggguacccgguccaggacccgcgcgcggucgugggcgcguucgauaucuggggccagggaacgauggugacagugagccca

SEQ ID NO: 55798 - RNA, 432 nt, Artificial Sequence
  derived and/or modified sequence opt11 from anti-HIV_cap256-038-146372_VR-Chain
caagugcaauuggucgagagcgggggcggggucgugcaaccgggcaggagcuugcgauugagcugugccgcgagcggguucacguucucgagcuuuggcaugcacugggucaggcaaucgcccgggaaagggcucgaguggguggccgugaucucguacgauggcaauaacaaguacuaugccgauagcgugaaagggcgcuuuaccauaagcagggaaaauagcaagaacacgcucuaucuccagaugaauagcuugcgcacggacgauaccgcggucuauuacugugccaaggacuugggcgagagcgagaccgaggaaugggccacggacuauuacgauuucgcgaccggguacccgguccaggacccgcgagcggucgugggcgcguucgauaucuggggccagggcacgauggugaccgugagcccg

SEQ ID NO: 55799 - RNA, 432 nt, Artificial Sequence
  derived and/or modified sequence opt11 from anti-HIV_cap256-038-141868_VR-Chain
gaauugcgccuggucgagagcgggggcaaucucgugcaaccgggcgggagcuugaccuugagcugugucgcgagcggguucacguucgauagcuauggcaugagcugggucaggcaagcgcccgggaaagggcucgaguggguggcauugaucucguacgaugaaaauaaaaaguacuaugccgauagcgugaaagggcgcuuuaccauaagcagggaaaauagcaagaacacgcucuaucuccagaugaauagcuugcgcgcggaagauacagcggucuauuacugugccaaggaccugggcgagcgcgagaacgaggaaugggccucggacuauuacgauuucgggcgcgauuacccgggccaggacccgcgcggggucgugggcucgauagauaccuggggccauggaacgauggugaccgugagcucg

SEQ ID NO: 55800 - RNA, 432 nt, Artificial Sequence
  derived and/or modified sequence opt11 from anti-HIV_cap256-038-141616_VR-Chain
gaagugcaacugcucgagagcgggggcgggcucgugcaaccgggcgggagcuugcgcuugagcugugcagcgagcggguucacguucucgagcuaugccaugagcugggucaggcaagcgcccgggaaagggcucgaguggguggcagugaucucgaaagauggcucggacaauagcuaugucgauagcgugaaagggcgcuuuaccauaagcagggacaauagcaagaacacgcucuaucuccagaugaauagccugcgcgcggaagauaccgcggucuauuacugugccagggacuugggcgagagcgagaacgaggaauggcccucggacuauuacgauuucgggcgcgauuacccgggccaggacccgcgaggggucauaggcacguucgaugucuggggccagggcacgauggugaccgugagcucg

SEQ ID NO: 55801 - RNA, 432 nt, Artificial Sequence
  derived and/or modified sequence opt11 from anti-HIV_cap256-038-127989_VR-Chain
caagcgcaauuggucgagagcgggggcggggucgugcaaccgggcaggagcuugcgcuugagcugugccgcgagcggguucacguucucgaacuuugccaugcacugggucaggcaagcgcccgggaaagggcucgaguggguggcagugaugucggacgauggaucgaacaaguacuaugccgauagcgugaaagggcgcuuuacaauaagcagggacaauagcgagaacacgcuauaucuccagaugaauagcuugagagcggaagauaccgcggucuauuacugugccaaggacuugggcgagagcgagaccgaggaaugggccacggacuauuacgauuucgggaccggguacccgggccaggacccgcgcgcgaugauaggcacguucgauaucuggggcaggggcacgauggugaccgugagcucg

SEQ ID NO: 55802 - RNA, 432 nt, Artificial Sequence
  derived and/or modified sequence opt11 from anti-HIV_cap256-038-118109_VR-Chain
caagugcaauuggucgagagcgggggcggggucgugcaaccgggcgggagcuugcgauugagcuguacagcgagcggguucacguucucggccuaugacaugcacuggaucaggcaagcgcccgggaaagggcucggauggguagccuuuaucacgaacgagggcucgagcaagaacuaugucgauagcgugaaagggcgcuuuacaauaagcagggacaauagcaagaacacgcucuaucuccagaugaauagcuugcgcgcggaagauaccgcggucuauuacugugcaaaggacuugggcgagagcgagaacgaggaaugggccacggacuauuacgauuucucgaucgcguacccgggccaggacccacgcggggucgugggcauauucgauaucuggggccagggcacgauggugaccgugagcuca

SEQ ID NO: 55803 - RNA, 432 nt, Artificial Sequence
  derived and/or modified sequence opt11 from anti-HIV_cap256-038-112226_VR-Chain
gaagugcaacuggucgagagcgggggcgggcuagugcaaccgggcgggagccugcgauugagcugugccgcgagcggguucacguucucgagcuauuggaugaccugggucaggcaagcgcccgggaaagggcucgaguggguggccgugaucucagacgauggcaauaacaaguacuaugccgauagcgugaaaggacgcuuuaccauaagcagggacaauagcaagaacacgcucuaucuccagaugaauagcuugcgcguagaagauaccgcggucuauuacugugucaaggacgugggcgagagcgagaacgaggaaugggccucggacuauuacgauuucgggcgcgauuacccgggccaggacacgcgcgcggucgugggcgcguucgauaucuggggccagggcacgauggugaccgugagcucg

SEQ ID NO: 55804 - RNA, 432 nt, Artificial Sequence
  derived and/or modified sequence opt11 from anti-HIV_cap256-038-105918_VR-Chain
gaaguacaacuacuagaaagcggaggcggacucguacaaccaggcggaagccuacgccuaagcugcgccgcaagcggguucacauucaacauccaccccaugcacugggucagacaagcacccggcaaaggacuagaauggguagccguaaucucauacgacggcaacaacaaauacuacgccgacagcguaaaaggacgcuucaccauaagcagagaaaacuccaaaaacacacucuaccuccaaaugaacagccuccgcaccgacgacaccgcagucuacuacugcgccaaggaccuaggcgaaagcgaaacagaagaauggcccucggacuacuacgacuucggacgcgacuacccaggccaagacccacgcggaguaguaggcacauucgacaucuggggccacggcacaaugguaacaguaagcuca

SEQ ID NO: 55805 - RNA, 432 nt, Artificial Sequence
  derived and/or modified sequence opt11 from anti-HIV_cap256-038-104487_VR-Chain
cucgugcaauuggucgagagcgggggcggggucgugcaaccgggcaagagcuugcgcuugagcugugccgcgagcggguucacguucucgagcuaugccaugcacuggaucaggcaagcgcccgggaaagggcucgaguggguggccgugaucucggacgauggcucgauaaagaacuaugccgauagcgugaaagggcgcuuuaccauaagcagggacaauagcaagaacacgcuauaucuacagaugaauagcuugcgagcggaagauaccgcggucuauuacugugccaaggacuugggcgagagcgagaacgaggaaugggccacggacuauuacggguucucgaucggguacccgggccaggacccgagaggggucgugggcauauucgauaucugggcccagggcacgauggugaccgugagcuca

SEQ ID NO: 55806 - RNA, 432 nt, Artificial Sequence
  derived and/or modified sequence opt11 from anti-HIV_cap256-038-102308_VR-Chain
caagugcaauugguagagagcgggggcggggucgugcaaccgggcgggagcuugcgauugagcugugccgcgcucgauuucccguucucgagcuuuggcaugcacugggucaggcaaacgcccgggcgcgggcucgaguggguggccauaaucuggagcgauggcucgaacagguacuaugucgauagcgugaaagggcgcuuuaccauaagcagggacaauagcaagaacacgcuauaucuccagaugaauagcuugcgcccggacgauacagcggucuauuacugugucaaggaccugggcgagagcgagaacgaggaaugggccacggacuauuacgauuucucgguaggguacccgggacagggcccgcgaggggucgugggcauauucgauaucuggggccagggcacgauggugaccgugagcuca

SEQ ID NO: 55807 - RNA, 432 nt, Artificial Sequence
  derived and/or modified sequence opt11 from anti-HIV_cap256-038-091115_VR-Chain
caagugcaauuggucgagagcgggggcggggucgugcaaccgggcaggagcuugcgcuugagcugugccgugagcggguucacguucucgagcuauggcuugcacugggucaggcaagcgcccgggaaagggcucgaguggguggccgugaucucguacgauggcucgaacaaguacuaugccgauagcgugaaagggcgcuuuaccauaagcagggacaauagcaagaacacgcucuaucuccagaucaauagcuugcgcgcggaagauaccgcggucuauuacugugccaaggacuugggcgagagcgagaacgaggaaugggccacggacuauuacgauuucucgaucggguacccgggccaggacccgcgcgcggucgugggcgcguucgauaucuggggccagggcacgauggugaccgugagcucg

SEQ ID NO: 55808 - RNA, 432 nt, Artificial Sequence
  derived and/or modified sequence opt11 from anti-HIV_cap256-038-090262_VR-Chain
caagugcaauuggucgagagcgggggcggggucgugcaagcgggcgggagcuugcgcuugagcugugccgcgagcggguucacguucaauaacuauggaaugcacugggucaggcaagcgcccgggaaagggcucgagugggcggccuuuaucagguacgauggcucgaacaaguacuaugccgauagcgugcgcggacgcuuuaccauaagcagggacaauagcaagaacacgcucuaucuccagaugaauagcuugcgcgcggaagauaccgcggucuauuacugugucaaggacgugggcgagagcgagaacgaggaaugggccucggacuauuacgauuucgggcgcgauuacccgggccaggacacgcgcgcggucgugggcgcguucgauaucuggggccagggcacgauggugaccgugagcucg

SEQ ID NO: 55809 - RNA, 432 nt, Artificial Sequence
  derived and/or modified sequence opt11 from anti-HIV_cap256-038-083260_VR-Chain
caagugcaauuggucgagagcgggggcggacucgugaaaccgggcgggagcuugcgcuugagcugugccgcgagcggauucacguucucggacuauuacaugaccuggaucaggcaagcgcccgggaaagggcucgaguggguggccgugaucucguacgauggcgggaacaaguacuaugccgauagcgugaaagggcgcuuuaccauaagcagggacaauagcaagaacacgcucuaucuccagaugaauagcuugcgagcggaagauaccgcgcucuauuacugugccaaggacuugggagagagcgagaacgaggaaugggccucggacuauuacgauuucgggcgcgauuacccgggccaggacucgcgcggggucgugggcacguucgaugucuggggccagggcacgauggugaccgugagcucg

SEQ ID NO: 55810 - RNA, 432 nt, Artificial Sequence
  derived and/or modified sequence opt11 from anti-HIV_cap256-038-080981_VR-Chain
caagugcaauugguagagagcgggggcggggucgugcaaccgggcaggagcuugcgcuugagcugugccgcgagcggguucacguucucgagcuauggaaugcacugggucaggcaagcgcccgggaaagggauggaguggguggccgugaucucguacgauggcucgaacaaguacuaugccgauagcgugaaagggcgauuuaccauaagcagggacaauagcaagaacacgcucuaucuccagaugaauagcuugcgcgcggucgauaccgcggucuauuacugugccaaggacuugggcgagggcgagaacgaggaaugggccacggacuauuacgauuucucgaucggguacccgggccaggacccgcgcggggucgugggcgcguucgauaucuggggccagggcacgauggugaccgugagcucg

SEQ ID NO: 55811 - RNA, 432 nt, Artificial Sequence
  derived and/or modified sequence opt11 from anti-HIV_cap256-038-080873_VR-Chain
cucgugcaauuggucgagagcgggggcgggguagugcaaccgggcgggagcuugcgauugagcugugccgcgagcggguucagguucucaagcuauggcaugcacugggucaggcaagcgcccgggaaagggcucgaguggguggccuuuaucagguacgauggcucguucaaggacuaugccgauagcgugcgcgggcgauuuaccauaagcagggacaauagcaagaacacggucuaucuccagaugaauagcuugcgcgcggaagauaccgcggucuauuacugugucaaggacuugggcgagagcgagaaagaggaauggcccucggacuauuacgauuucgggcgcgauuacccgggccaggacucgcgcggggucgugggcguguucgauaucuggggccagggaacgauggugaccgugagcucg

SEQ ID NO: 55812 - RNA, 432 nt, Artificial Sequence
  derived and/or modified sequence opt11 from anti-HIV_cap256-038-074413_VR-Chain
caagugcaauuggucgaaagcgggggcggggucgugcaaccgggcgggagcuugcgcuugagcugugccgcgagcggguucacguucucgaccuauggcaugcacugggucaggcaaccgcccgggaaaggacuagaguggguggccuuuaucagguacgauggcucgaacacguacuaugccgauagcgugaaagggcgauuuaccauaagcagggacaauagcaagaacacgcucuaucuccagaugaauagcuugcgcgcggaagauaccgcggucuauuacugugccaaggacuugggcgagagcgagaacgaggaaugggcaucggacuauuacgauuucgggcgcgauuacccgggccaggacccgcgcggggucgugggcguguucgauaucuggggccagggcacgauggugaccgugagcucg

SEQ ID NO: 55813 - RNA, 432 nt, Artificial Sequence
  derived and/or modified sequence opt11 from anti-HIV_cap256-038-073153_VR-Chain
caagugcaauuggucgagagcgggggcggggucgugcaaccgggcaggagcuugcgcuugagcugugccgcgagcggguucacguucucgagcuauggcaugcacugggucaggcaagcgcccgggaaagggcucgaguggguggccuugaucucauacgauggcacgaacaaguacuaugccgauagcgugaaagggagauuuaccauaagcagggacaauagcaagaacacgcucuuucuccagaugaauagcuugcgcgcggaagauaccgcgcucuauuacugugccaaggacuugggcgagagcgagaacgaggaaugggccucggacuauuacgauuucgggcgcgauuacccgggccaggacccgcgcggggucgugggcacguucgauaucuggggccagggcacgauggugaccgugagcucg

SEQ ID NO: 55814 - RNA, 432 nt, Artificial Sequence
  derived and/or modified sequence opt11 from anti-HIV_cap256-038-064227_VR-Chain
gaggugcaagugguggagagcgggggagggcuagugcaaccgggagggagcuugagauugagcugugcggcgagcggguucacguucucgaacuauuggaugagcuggguaaggcaagcgccggggaaagggcuggaguggguggcagugaugucguucucggggaguggaaguuacuaugcggauagcgugaaagggagauuuacaauaagcucggacgauagcaugaacacgguauaucuacagaugaauagcuugagggcggaagauacggcgguauauuacugugcgaaggacuugggggagagggagaacgaggaaugggcaagugacuauuacgauuucgggagagauuacccgggacaggacccgagagggguggugggaucgauagauacaugggggcaugggacgauggugacagugagcagu

SEQ ID NO: 55815 - RNA, 432 nt, Artificial Sequence
  derived and/or modified sequence opt11 from anti-HIV_cap256-038-061640_VR-Chain
caagugcaacugguagagagcgggggcggggucgugcaaccgggcaggagcuugcgcuugagcuguaccgcgagcagguucucguucaauaacuaugcaaugcacugggucaggcaagcgccagggaaagggcucgaguggguggccauaaucucgaaagauggcucagacaauagcuaugucgauagcgugaaagggcgcuuuaccauaagcagggacaauagcaagaacacgcucuaucuccagaugaauagcuugcgcgcggaagauaccgcggucuauuacugugccagggacuugggcgagagcgagaacgaggaauggccaucggacuauuacgauuucgggcgcgauuacccgggccaggacccgcgcggggucauaggcacguucgaugucuggggccagggcacgauggugaccgugagcucg

SEQ ID NO: 55816 - RNA, 414 nt, Artificial Sequence
  derived and/or modified sequence opt11 from anti-HIV_cap256-038-059482_VR-Chain
cgcgggguccagugccagguccagcuaguggaaucgggcgggggcgugguccagcccggguucacguucucgagcuaugucaugcacuggguaaggcaagcgcccggaaaagggcucgaguggguggccgauaucucguacgauggcucgaacaaguacuaugccgauagcgugaaagggcgcuugaccauaagcagggacaauagcaagaacacgcucuaucuccagaugaauagcuugcgcgcggaagauaccgcggucuauuacugugucaaggacuugggagagagcgagaaagaggaauggcccucggacuauuacgauuucgcgaccggguacccgguccaggacccgcgcgcggucgugggcgcguucgauaucuggggccagggcacgauggugaccgugagcccg

SEQ ID NO: 55817 - RNA, 432 nt, Artificial Sequence
  derived and/or modified sequence opt11 from anti-HIV_cap256-038-054000_VR-Chain
gaagugcaauuggucgagagcgggggcucggucgugcgaccgggcgggagcuugcgcuugagcugugcagcgagcggguucacguucgaugacucgggcaugagcugggucaggcaagggcccgggaaagggcucgaguggguggccgugaucucguacgauggcgggaacaaguacuaugcagauagcgugaaagggcgcuuuacaauaagcagggacaauagcaagaacacgcucuaucuccagaugaauagcuugcgagcggaagauaccgcgcucuauuacugugccaaggacuugggcgagagcgagaacgaggaaugggccucggacuauuacgauuucgggcgcgauuacccgggccaggacucgcgcggggucgugggcacguucgaugucuggggccagggcacaauggugaccgugagcucg

SEQ ID NO: 55818 - RNA, 432 nt, Artificial Sequence
  derived and/or modified sequence opt11 from anti-HIV_cap256-038-050554_VR-Chain
gaagugcaauugcucgagagcgggggcgaucucgugcaaucgggcgggagccugcgauugagcugugucgcgagcggguucacguucucgacccaugccaugaccugggucaggcaagcgcccgggaaagggcucgaguggguggccgugaucucgagcgauggcucgaacaagaacuuugccgauagcgugaaagggcgcuuuaccauaagcagggacaauagcaagaacacgcucuaucuccagaugaauagcuugcgcccggaagauaccgcggucuauuacugugccaaggacuugggcgagagcgagaacgaggaaugggccacggacuauuacgauuucucgaccggguacccgguccaggacccgcgcgcggucgugggagcguucgauaucuggggccagggcacgauggugaccgugagcucg

SEQ ID NO: 55819 - RNA, 432 nt, Artificial Sequence
  derived and/or modified sequence opt11 from anti-HIV_cap256-038-044256_VR-Chain
caagugcaauugguagagagcgggggcggggucgugcaaccgggaaggagcuugcgauugagcugugccgcgagcggguucacguucucgagcuaugccaugcacugggucaggcaagcgcccgggaaagggcuugaguggguggccgugaucucguacgauggcucgaacaaguaccaugccgggagcgugaaagggcgcuuuaucauaagcagggacaauagcaagaacacgcucuaucuccagaugaauagcuugcgcgcggaagauaccgcgcucuauuacugugccaaggaccugggagagagcgagaacgaggaaugggccucggacuauuacgauuucgggcgagauuacccgggccaggacccgcgcggggucgugggcacguucgauaucuggggccagggcacgauggugaccgugagcucg

SEQ ID NO: 55820 - RNA, 432 nt, Artificial Sequence
  derived and/or modified sequence opt11 from anti-HIV_cap256-038-040944_VR-Chain
caagugcaauuggucgagagcgggggcggggucgugcaaccgggcaggagccugcgcuugagcugugccgcgagcggguucacguucucgaacuaugccauggacugggucaggcaagcgcccgggaaagggcucgaguggguggccgugaucucguacgauggcucgaacaaguacuaugccgauagcgugaaagggcgcuuuaccauaagcagggacaauagcaagaacacgcucuaucuccagaugaauagcuugcgcgcggaagauaccgcggucuauuacugugccaaggacuugggcgagagcgagaacgaggaaugggccacggacuauuacgauuucucgaccggguacccgggccaggacccgcgagcggucgugggcgcguucgauaucuggggccagggcacgauggugaccgugagcucg

SEQ ID NO: 55821 - RNA, 432 nt, Artificial Sequence
  derived and/or modified sequence opt11 from anti-HIV_cap256-038-040090_VR-Chain
caagugcaauuggucgagagcgggggcggggucgugcaaccgggcaggagcuugcgcuugagcugugccgcgagcggguucucguucucgaacuaugccauggacuggguaagacaagcgcccgggaaagggcucgaguggguggccgugaucucgagcgauggcucgaacaagaacuacgccgauagcgugaaagggcgcuuuaccauaagcagggacaauagcaagaacacgcucuaucuccagauggauagccugcgcgcggacgauaccgcggucuauuacugugccaaggacuugggcgagagcgagaacgaggaaugggccacggacuauuacgauuucucgaucggguacccgguccaggacccgcgcggggucgugggcauauucgauauauggggccagggcacgauggugaccgugagcucg

SEQ ID NO: 55822 - RNA, 432 nt, Artificial Sequence
  derived and/or modified sequence opt11 from anti-HIV_cap256-038-032874_VR-Chain
caagugcaauuggucgagagcgggggcggggucgugcaaccgggcgggagccugcgcuugagcugugccgcgagcggguucacguucucgagcuauggcaugcacugggucaggcaagcgcccgggaaagggcucgaguggguggccuuuaucagguacgauggcaauaacaaguacuaugccgauagcgugaaagggcgcuuuaccauaagcagagaaaauagcaagaacacgcucuaucuccagaugaauagcuugcgcgcggaagauaccgcggucuaucacugugccaaggacuugggcgagagcgagaaagaggaaugggccucggacuauuacgauuucgggcgcgauuacccgggccaggacccgcgcggggucgugggaacguucgauaucuggggccauggcacgauggugaccgugagcucg

SEQ ID NO: 55823 - RNA, 432 nt, Artificial Sequence
  derived and/or modified sequence opt11 from anti-HIV_cap256-038-025899_VR-Chain
caagugcaauuggucgagagcgggggcggggucgugcaaccgggaaggagcuugcgcuugagcugugucgcgagcggguucacguucucgaacuaugccauguacugggucaggcaagcgcccgggaaagggcuagagugggugaccauaaucucguucgauggcucgaaccaguacuaugccgauagcgugaaagggcgcuuuaccauaagcagagaaaauagcaagaacacgcucuaucuccagaugaauagcuugcgcgcggaagauaccgcggucuauuacugugccaaggacuugggagagcgcgagaacgaggaaugggccucggacuauuacgauuucgggcgcgauuacccgggccaggacccgcgcggggucgugggcucgaucgauaccuggggccauggcacgauggugaccgugagcucg

SEQ ID NO: 55824 - RNA, 432 nt, Artificial Sequence
  derived and/or modified sequence opt11 from anti-HIV_cap256-038-024581_VR-Chain
cacauacaacuggucgagagcgggggcggggucgugcaaccgggcgggagccugcgcuugagcugugccgcgagcggguucccguucucgagcuuuggcaugcacugggucaggcaaacgcccgggcgcgggcuagaguggguggccauaaucuggagcgauggcucgcacaaggaauauacagauagcgugaaagggcgcuuuaccauaagcagagacaauagcaggagcacgauggaucuacagaugaauaacuugcgcccggaagauaccgcggucuauuacugugccaaggacuugggcgagcgcgagaacgaggaaugggccucggacuauuacgauuucgggcgcgauuacccgggccaggacccgcgcggggucgugggaucgaucgauaccuggggacauggcacgauggugaccgugagcuca

SEQ ID NO: 55825 - RNA, 432 nt, Artificial Sequence
  derived and/or modified sequence opt11 from anti-HIV_cap256-038-013345_VR-Chain
caagugcaauuggucgagagcgggggcggggucgugcaaccgggaaggagcuugcgccugagcugugccgugagcggguucacguucucaagcuauggcaugcacugggucaggcaagcgcccgggaaagggcucgaguggguggccgcgaucucguacgauggcucgaacaaguacuaugucgauagcgugaaagggcgauuuaccauaagcagggacaauagcaagaacacgcucuaucuccagaugaauagcuugcgagcggaagauaccgcggucuauuacugugccagggacuugggcgagcgcgagaucgaggaaugggccacggacuauuacgauuucucgaucggguacccgggccaggacccgcgcggggucgugggcguguucgauaucuggggccagggcacgauggugaccgugagcucg

SEQ ID NO: 55826 - RNA, 438 nt, Artificial Sequence
  derived and/or modified sequence opt11 from anti-HIV_cap256-038-011559_VR-Chain
caagugcaauuggucgagagcgggggcggggucgugcaaccgggcaggagcuugcgauugagcugugaagcgagcggguucacguucucgagcuauggcauggacugggucaggcaagcgcccgggaaagggcucgaguggguggcauugaucucgcacgauggaucgaacaagcacuaugccgauagcgugaaagggcgauuuaccauaagcagggacaauagcaggaacacgcucuaucuccagaugaauagcuugcgcgcggaagauaccgcgcucuauuacugugccaaggacuugggcgagagcgagaacgaggacgaggaaugggccucggacuauuacgauuucgggcgagauuacccgggccaggacucgcgcggggucgugggcacguucgauauguggggccagggcacgauggugacagugagcucg

SEQ ID NO: 55827 - RNA, 432 nt, Artificial Sequence
  derived and/or modified sequence opt11 from anti-HIV_cap256-038-009634_VR-Chain
caagugcaauuggucgagagcgggggcggggucgugcaaccgggcaggagcuugcgcuugagcugugccgcgagcggguucacguucacgagcuuuggcaugcacugggucaggcaagcgccagggaaagggcucgaguggguggccgugauaucguacgauggcaauaacaaguacuaugccgauagcgugaaagggcgcuuuaccauaagcagggaaaauagcaagaacacgcucuaucuccagaugaauagcuugcgcgcggaagauacagcggucuaucacugugccaaggacuugggcgagagcgagaucgaggaauggaccucggacuauuacgauuucgggcgcgauuacccgggccaggacccgcgcggggucuuuggaacguucgauaucuggggccauggcacgauggugaccgugagcucg

SEQ ID NO: 55828 - RNA, 432 nt, Artificial Sequence
  derived and/or modified sequence opt11 from anti-HIV_cap256-038-006730_VR-Chain
caagugcaacuggucgagagcgggggcggggucgugcaaccgggcaggagcuugcgcuugagcugugccgcgagcggguucacguucucgagcuuuggaaugcacugggucaggcaagcgcccgggaaagggcucgaguggguggccgugaucucgaaagauggcucggacaauagcuauguagauagcgugaaagggcgauuuaccauaagcagagacaauagcaagaacacgcucuaucuccagaugaauagccugcgcgcggaagauaccgcggucuauuacugugccagggacuugggcgagagcgagaacgaggaauggcccucggacuauuacgauuucgggcgcgauuacccgggccaggacccgcgcggggucauaggcacguucgaugucuggggccagggcacgauggugaccgugagcucg

SEQ ID NO: 55829 - RNA, 432 nt, Artificial Sequence
  derived and/or modified sequence opt11 from anti-HIV_cap256-038-004887_VR-Chain
caagugcaauuggucgagagcgggggcggggucgugcaaccgggcaggagcuugcgauugagcugugccgcgagcggguucucguucucgaccucgggcaugcacugggucaggcaagcgccagggaaagggauggaguggguggccgugaucucauacgauggaucgaacaaguacuaugccgauagcgugaaagggcgcuuuaccauaagcagggacaauagcaagaacacgcucuaucuccagaugaauagcuugcgcgcggucgauaccgcggucuauuacugugcaaaggacuugggcgagggcgagaacgaggaaugggccacggacuauuacgauuucucgaucggguacccgguccagaacccgcgagggcucgugggcgcguucgauaucuggggccagggcacgauggugaccgugagcucg

SEQ ID NO: 55830 - RNA, 432 nt, Artificial Sequence
  derived and/or modified sequence opt11 from anti-HIV_cap256-038-004840_VR-Chain
caagugcaacuggucgagagcgggggcggggucgugcaaccgggcaggagcuugcgcuugagcugugccgcgagcggguucacguucucgagcuuuggcaugcacugggucaggcaaucgcccgggaaagggcucgaguggguggccgugaucucguacgauggcaauaacaaguacuaugccgauagcgugaaagggcgcuuuaccauaagcagggaaaauagcaagaacacgcucuaucuccagaugaauagccugcgcacggacgauaccgcggucuauuacugugccaaggacuugggcgagagcgagaccgaggaauggcccucggacuauuacgauuucgggcgcgauuacccgggccaggacccgcgcggggucgugggcacguucgauaucuggggccauggcacgauggugaccgugagcucg

SEQ ID NO: 55831 - RNA, 432 nt, Artificial Sequence
  derived and/or modified sequence opt11 from anti-HIV_cap256-038-002181_VR-Chain
gaagugcaauuggucgagagcgggggcgggcucgugcaaccgggcaggagcuugcgauugagcugugccgcgagcggguucacguucgaggacuaugccaugcacugggucaggcaagcgcccgggaaagggcucgaguggguggccgugaucucguacgauggcucgaacaaguacuaugucgauagcgugaaagggcgcuuuaccauaagcagggacaauagcaagaacacgcucuaucuccagaugaauagcuugcgcgcggaagauaccgcggucuauuacugugccaaggacuugggcgagagcgagaacgaggaaugggccacggacuauuacgauuucucgaucggguacccgggccaggacccgcgaggggucgugggcauauucgauaucuggggccagggcacgauggugaccgugagcucg

SEQ ID NO: 55832 - RNA, 432 nt, Artificial Sequence
  derived and/or modified sequence opt11 from anti-HIV_cap256-038-001902_VR-Chain
caagugcaauuggucgagagcgggggaggggucgugcaaccgggcaggagcuugcgcuugagcugugccgcgagcggguucacguucucgagcuuuggcaugcacugggucaggcaagcgcccgggaaagggcucgaguggguggccgugaucucauacgauggcaauaacaaguacuaugccgauagcgugaaagggcgcuuuaccauaagcagggaaaauagcgagaacacgcucuaucuccagaugaauagcuugcgcgcggacgauaccgcggucuauuacugugccaaggacuugggcgagagcgagaacgaggaaugggccucggacuauuacgauuucgggcgcgauuacccgggccaggacacgcgaggggucgugggcacguucgauaucuggggacauggcacgauggugaccgugagcucg

SEQ ID NO: 55833 - RNA, 432 nt, Artificial Sequence
  derived and/or modified sequence opt11 from anti-HIV_cap256-038-000976_VR-Chain
caagugcaauuggucgagagcgggggaggggucgugcaaccgggcaggagcuugcgcuugagcugugccgcgagcggguucacguucucgagcuuuggcaugcacugggucaggcaagcgcccgggaaagggcucgaguggguggccgugaucucggacgauggcaauaacaaguacuaugccgauagcgugaaagggcgcuuuaccauaagcagggacaauagcaagaacacgcucuaucuacagaugaauagcuugcgcguggaagauaccgcggucuauuacugugucaaggacgugggcgagagcgagaacgaggaaugggccucggacuauuacgauuucgggcgcgauuacccgggccaggacacgcgcgcggucgugggcgcguucgauaucuggggccagggcacgauggugaccgugagcucg

SEQ ID NO: 55834 - RNA, 432 nt, Artificial Sequence
  derived and/or modified sequence opt11 from anti-HIV_cap256-038-000384_VR-Chain
caagugcaauuggucgagagcgggggcgggguagugcaaccgggaaagagcuugcgccugagcugugccgcgagcggguucacguucucgagcuauguaaugcacugggucaggcaagcgcccgggaaagggcucgaguggguggccgauaucucguacgauggcucgaacaaguacuaugccgauagcgugaaaggacgcuugaccauaagcagggacaauagcaagaacacgcucuaucuacagaugaauagcuugcgcgcggaagauaccgcggucuauuacugugucaaggacuugggcgagagcgagaaagaggaauggcccucagacuauuacgauuucgggcgcgauuacccgggccaggacucgcgcggggucgugggcguguucgauaucuggggccagggcacgauggugaccgugagcucg

SEQ ID NO: 55835 - RNA, 321 nt, Artificial Sequence
  derived and/or modified sequence opt11 from anti-HIV_206-314431_VR-Chain
caauucguccucacccaaccccccuccgucuccgccgcccccggccaaaacgucaccaucuccugcuccggcccccccucccacaucgaaaaaaacgacgucuccugguaccaacgccuccccggcauggcccccaaaauggucaucuacgaaucccgccgccgcccccucggcauccccguccgcuucaccgccucccgcuccggcuccuccgccacccucgucaucaccggccuccaaaccgccgacgaagccgacuacuacugcggcaccugggacggccgcaugaacuucggcaccggcaccaccgucaccguccuc

SEQ ID NO: 55836 - RNA, 321 nt, Artificial Sequence
  derived and/or modified sequence opt11 from anti-HIV_206-247594_VR-Chain
caauccauccucacccaaccccccuccgucucagccgcccccggccaaaacgucaccaucuccugcuccggcccccccucccacaucgaaaaaaacgacgucuccugguaccaacgcuuccccggcauggccccaaaaaugaucaucuacgaauccaaacgccgccccuucggcguccccggccgcuucuccgccucccgauccggcaaauccgccacccucgccaucaccggccuccaaaccggcgacgaagccgacuacuacugcggcaccugggacggccgcaugaacuucggcaccggcaccaccgucaccguccuc

SEQ ID NO: 55837 - RNA, 321 nt, Artificial Sequence
  derived and/or modified sequence opt11 from anti-HIV_206-116890_VR-Chain
caauccguccucacccaaccccccuccgucuccgccgcccccggccaaaacgucaccaucuccugcuccggcccccccucccacaucgaaaaaaacgacgucucaugguaccaacaccuccccggcgaagcccccaaaaugaucaucuacgaauccuggcgccgccccgccggcauccccgcccgcuucuccgccucccgcuccggcaaauccggcacccucgccaucaccggccuccaaaccggcgacgaagccgacuacuacugcggcaccuggaacggccgcaugaacuucggcaccggcaccaccgucaccguccuc

SEQ ID NO: 55838 - RNA, 333 nt, Artificial Sequence
  derived and/or modified sequence opt11 from anti-HIV_206-072383_VR-Chain
caauccguccucacccaaccacccucagucuccgccgcccccggccaacgcgucaucaucuccugcuccggcaacaacuccaccaucggcaacaacuucgucuccugguaccaacaaguccccggcaccgcccccaaacuccuaaucuacgaaaccaaccgccgccccuccggcauccccgaccgcuucucaggcuccaaauccggcaccuccgccacccucgccaucuccggccuccaaaccggcgacgaagccgacuucuacugcaccgucuggggcguccgcaaaggcgucgccgccgucuucggcaccggcacccgccucaccguccuc

SEQ ID NO: 55839 - RNA, 333 nt, Artificial Sequence
  derived and/or modified sequence opt11 from anti-HIV_206-037527_VR-Chain
caaucggucuugacccagcccccgagcgugagcgcggccccgggccagaaagugaucauaagcuguagcgggaacaauagcacgaucgggaaaauacucgugagcugguaccagcaagugcccgggaccgcgcccaagcucgugaucuaugaaacgaacaggcgcccgagcgggaucccggacagguucucgggcucgaaaucgggcacgagcgcgaccuuggccauaaccgggcuccagaccggggacgaggccgauuacuuuugcaaggucuggggcgugcgcaagggcguggccgcggucuuuggcacgggcacgaaagugaccgugcuc

SEQ ID NO: 55840 - RNA, 333 nt, Artificial Sequence
  derived and/or modified sequence opt11 from anti-HIV_206-009095_VR-Chain
caauccguccucacccaaccccccuccgucuccgccgcccccgcccaacgcgucaucaucuccugcuccggcgacaacuccaccaucggcaacaacuucgucuccugguaccaacaaguccccggcgccgcccccaaacuccucaucuacgaaaccaaccgccgccccuccggcauccccgaccgcuucucaggcuccaaauccggcaccaccgccacccucgccaucuccggccuccaaaccggcgacgaagcagacuaccacugcaccgucuggggcguccgaaaaggcgucgccgccgucuucggcaccggcaccaaagucaccguccuc

SEQ ID NO: 55841 - RNA, 321 nt, Artificial Sequence
  derived and/or modified sequence opt11 from anti-HIV_176-503620_VR-Chain
caauccguccucacccaaccccccuccgucuccaccgcccccggccaaaccgucaccgucuccugcuccggaggcaccuccaacaccggcaacaacuucgucuccugguaccaacaccuccccggcaccgcccccaaacuccucaucuacgaaaacaacaaacgcccccucggcguccccgaccgcuucuccggcgccaaauccggcaccuccgccacccucgcccucaccggccuccaaaccggcgacgaaggcgacuacuacugcgccaccugguccggcucccucaacaucggcaccggcaccaaagucuccguccuc

SEQ ID NO: 55842 - RNA, 321 nt, Artificial Sequence
  derived and/or modified sequence opt11 from anti-HIV_176-478726_VR-Chain
caauccguccucacccaaccccccuccgucuccgccgcccccggccaaaacgucaacaucuccugcuccggcccccccucccacaucgaacgcaacgacgucuccugguaccaacaccuccccggcgccgcccccaaaaugaucaucuacgaauccuggcgccgccccgccggcauccccgaccgcuucuccgccucccgcuccggcgccuccgccacccucgccaucaccggccuccaaaccggcgacgaagccgacuacuacugcggcaccuggaacggccgcaugaacuucggcaccggcaccaccgucaccguccuc

SEQ ID NO: 55843 - RNA, 321 nt, Artificial Sequence
  derived and/or modified sequence opt11 from anti-HIV_176-245056_VR-Chain
caauccguccucacccaaccccccuccgucuccgccgcccccggccaaaacgucaccaucuccugcuccggcccccccucccacaucgaaaaaaacggcgucuccugguaccaacaauuccccggcauggcccccaaaauggucaucuacgaauccaaacgccgccccuucggcguccccgcccgcuucuccgccucccgcuccggcaaauccgccacccuagccaucaccggccuccaaaccggcgacgaagccgacuacuacugcggcaccugggacggccgcaugaacuucggcaccggcaccaccgucaccguccuc

SEQ ID NO: 55844 - RNA, 321 nt, Artificial Sequence
  derived and/or modified sequence opt11 from anti-HIV_176-164413_VR-Chain
caauccguccucacccaaccccccuccgucuccgccgcccccggccaaaaagucaccaucuccugcuccggcggcaccuccaacaucggcaacaacuacgucuccugguaccaacgccuccccggcaccgcccccaaacuccucaucuacgaaaacaacaaacgccccuccggcauccccgaccgcuucuccggccccaaauccggcaccuccgccacccucgccaucaccggccuccaacccggcgacgaagccgacuacuacugcgccaccugguccggcucccucaacuucggcaccggcaccaaagucaccguccuc

SEQ ID NO: 55845 - RNA, 333 nt, Artificial Sequence
  derived and/or modified sequence opt11 from anti-HIV_176-094308_VR-Chain
caauccguccucacccaaccccccuccgucuccgccgcccccggccaaaaagucaucaucuccugcuccggcaacaacuccaccaucggcaacaacuucgucuccugguaccaacaaguccccggcacagcccccaaacuccucgucuacgaaaccuaccgacgccccuccggcauccccgaccgcuccuccggcuccaaauccggcacaaccgccacccaagccaucuccggccuccaaaccggcgacgaagccgacuaccacugcaccgucuggggcguccgcaaaggcgucgccgccgucuucggcaccggcaccaaagucaccguccuc

SEQ ID NO: 55846 - RNA, 333 nt, Artificial Sequence
  derived and/or modified sequence opt11 from anti-HIV_176-065321_VR-Chain
caaucggucuugacccagcccccgagcgugagcgcggccccgggcaggcgcgugaucauaagcuguagcgggaacaauagcacaaucgggaacaauuucgugagcugguaccagcaagugcccgggaccgcgcccaaacucuuggucuaugaaacgaacaggcgcccgagcgggaucccagacagguucucgggcucgaaaucgggcacgagcgcgaccuuggccauaagcgggcuccagaccggggacgaggccgauuacuauugcacggucuggggcgugcgcaagggcguggccgcggucuuuggcacgggcacgaaagugaccgugcuc

SEQ ID NO: 55847 - RNA, 324 nt, Artificial Sequence
  derived and/or modified sequence opt11 from anti-HIV_119-099719_VR-Chain
caauccguccucacccaaccccccuccgucuccgcagcccccggccaaaaagucaccaucuccugcucaggcuccaacuccuacaucggcaacaaauacaucuccugguaccaacaauuccccggcaccgcccccaaacuccucaucuacgaaaacaacaaacgccccuccggcguccccgaccgcuucuccgccuccaaauccgccaccuccgccacccucgccaucaccggccuccacaccggcgacgaagcagacuacuacugcgaaaccugcgacggcuccggcggcgucuucggcaccggcaccaaagucaccguccuc

SEQ ID NO: 55848 - RNA, 327 nt, Artificial Sequence
  derived and/or modified sequence opt11 from anti-HIV_119-099536_VR-Chain
gaacucacccaaccccccuccgucuccgccgccuccggccaaaacgucaacaucucaugcuccggcggcuccuccaacaucggcuccaacuacgucuccugguaccaacaauuccccggcaccgcccccaaacuccucaucuacgaaaccaacaaacgccccuccggcauccccgaccgcuucuccggcuccaaaucaggcgccuccgccacccucgccaucaccggccuccaaaccggcgacgaagccgacuacuacugcgccaccugggccgacucccuaaacuccgcccgcgucuucggcacaggcaccaaagucaccguccuc

SEQ ID NO: 55849 - RNA, 333 nt, Artificial Sequence
  derived and/or modified sequence opt11 from anti-HIV_119-098907_VR-Chain
caaucggucuugacccagcccccgagcgugagcgcgaccccgggccagaaagugaccauaagcuguagcgggagcaauagcaauaucggggacaaguacgugagcugguaccagcacuuucccgggaccgcgcccaagcucuuggucuaugaaacguacaggcgcccgagcgggaucccggacagguucucgggcucgaaaucgggcacgagcgcgaccuuggccauaaccgggcuccagaccggggacgaggccgauuacuauugcacgaucuggggcgugcgcaagggcgugggcgcggucuuuggcacgggcacgaaagugaucgugcuc

SEQ ID NO: 55850 - RNA, 324 nt, Artificial Sequence
  derived and/or modified sequence opt11 from anti-HIV_119-098555_VR-Chain
caauccguccucacccaaccccccuccgucuccgccgcccccggccaaaacgucacaaucuccugcucaggcuccgccuccaacaucggcaaaaacuucgucuccugguaccaacaacuccccggcaccgcccccaaacuccucaucuacggcuccaacaaccgccccuccggcguccccgaccgcuucuccggcuccaaauccggcaccuccgccucccucgcaaucaccggccuacaaaccggcgacgaagccgacuacuacugcgaaaccugggacggcuccggcgccgucuucggcaccggcaccaaagucaccguccuc

SEQ ID NO: 55851 - RNA, 324 nt, Artificial Sequence
  derived and/or modified sequence opt11 from anti-HIV_119-097828_VR-Chain
caauccguccucacccaaccccccuccgucuccgccgcccccggccaaaaagucaccaucuccugcuccggcuccuccuccaacaucggcaaaaacuacgucuccugguaccaacuccuccccggcaccgccccccgccucgucaucuacgaaaacgacgaacgccccuccggcacccccgaccgcuucuccggcuccaaauccggcaccuccgccacccucgccaucaccggccuccacaccggcgacgaagccgacuacuacugcgaaaccugggacggcuccggcggcgucuucggcaccggcaccaaagucaccguccuc

SEQ ID NO: 55852 - RNA, 324 nt, Artificial Sequence
  derived and/or modified sequence opt11 from anti-HIV_119-096480_VR-Chain
caauccguccucacccaaccccccuccgucuccggcgcccccggccaacgcaucaccaucuccugcuccggcucaaccuccaacaucggccaaaacuacgucuccugguaccaacaacuccccggcaccgcccccaaacuacucaucuccgacaacaaccgccgccccuccuggacccccgaccgcuucuccggcuccaaauccggcaccuccgccacccucgccaucaccggccuccaaaccggcgacgaagccgacuacuacugcgaaaccugggacggcuccggcggcgucuucggccccggcacccgcgucaccguccuc

SEQ ID NO: 55853 - RNA, 324 nt, Artificial Sequence
  derived and/or modified sequence opt11 from anti-HIV_119-095664_VR-Chain
caauccguccucacccaaccccccuccgucuccgccgcccccggccaaaaagucaccaucuccugcuccggcggcgccgccaacaucggcaaaaacuccgucuccugguaccaacaacuccccggcaccgcccccaaacuccucaucuacgacaacaaccgccgccccuccggcacccccgaccgcuucuccggcuccaaauccggcaccuccgccacccucgccaucuccggccuccaaaccggcgacgaagccgacuacuacugcgaaaccuggcacggcuccggcggcgucuucggcaccggcaccaaagucaccguccuc

SEQ ID NO: 55854 - RNA, 321 nt, Artificial Sequence
  derived and/or modified sequence opt11 from anti-HIV_119-095212_VR-Chain
caauccguccucacccaaccccccuccgucuccgccgcccccggccaaaaagucaccaucuccugcuccggcuccaccuccaacaucggcaaauccgacgucuucugguaccaacaacuccccggcaccgcccccaaacuccucaucuccgaaaccucccgccgccccuccggcauccccgaccgcuucuccggcgccaaauccggcaccuccgccacccucgccaucaccggccuccaaaccggcgacgaagccgacuacuucugcuccaccugguccggcucacucaacuucggcaccggcacccgcgucaccguccuc

SEQ ID NO: 55855 - RNA, 333 nt, Artificial Sequence
  derived and/or modified sequence opt11 from anti-HIV_119-094773_VR-Chain
caauccguccucacccaaucccccaccgucuccgccgcccccggccaaaccgucaccaucuccugcuccggcggcaccuccaacgucggcaaaaacuucgucuccugguaccaacaauucccccgcaccgcccccaaacuccucaucuacgaaaacaacaaacgccccuccggcauccccgaccgcuucuccggcuccaaauccggcaccuccgccacccuagucaucaccggccuccaaaccggcgacgaagccgacuucuacugcggcaccugggacggcucccuccgcaccggcggcguaaucggcaccggcacacgcgucaccguccuc

SEQ ID NO: 55856 - RNA, 324 nt, Artificial Sequence
  derived and/or modified sequence opt11 from anti-HIV_119-094508_VR-Chain
caauccguccucacccaaccccccuccgucuccgccacccccggccaacgcgucaccgucuccugcuccggcuccuccuccaacaucggcaaccacuacgucuccugguaccaacaaguccccggcaccgcccccaaacuccucaucuccgaaaacucccgccgccccuccggcacccccgaccgcuucuccggcuccaaauccggcaccuccgccacccucgccaucaccggccuccaaaccggcgacgaagccgacuacuacugcgaaaccugggacggcuccggcggcgucuucggcaccggaaccaaagucaccguccuc

SEQ ID NO: 55857 - RNA, 324 nt, Artificial Sequence
  derived and/or modified sequence opt11 from anti-HIV_119-093795_VR-Chain
caauccguccucacccaaccccccuccgucucagccgcccccggccaaaaagucaccaucuccugcuccggauccuccuccaacaucggcaacaacuacgucuccugguaccaauaccuccccggcaccgcccccaaacuccucaucuccgaaaacaaccgccgccccuccggcacccccgaccgcuucuccggcuccaaauccggcaccuccgccacccucgccaucaccggccuccaaaccggcgacgaagccgacuacuacugcgaaaccugggacggcuccggcggcgucuucggcaccggcaccaaagucaccguccuc

SEQ ID NO: 55858 - RNA, 321 nt, Artificial Sequence
  derived and/or modified sequence opt11 from anti-HIV_119-093732_VR-Chain
caaucaguccugacccagcccccaagcguaagcgcagccgcaggccaaaacguaaacauaagcugcagcggacgcaaaagcaacgucggaggcaacuacguaagcugguaccaacaauuccccggaaccgcacccaaacuccuaaucuacgaagacaacaaacgcccaagcuggaucccagacagauucacagccucacgcucaggcacaagcgcaacccuaggcauaaccggacuccagaccggagacgaagccgacuacuucugcucaaccuggagcggaagccuaaacuucggcacaggcacacgcguaaccguacuc

SEQ ID NO: 55859 - RNA, 333 nt, Artificial Sequence
  derived and/or modified sequence opt11 from anti-HIV_119-092903_VR-Chain
caauccguccucacccaaccccccuccgucuccgccgccccccgccaaaaagucaccaucuccugcuccggcuccuccuccaacaucggcaaccacuacgucuccugguaccaacaacuccccggcaccgcccccaaacuccucaucuacgaaaacaacaaacgccccuccggcauccccgaccgcuucuccggcuccaaauccggcaccuccgccacccucgccaucaccggccuccaaaccggcgacgaagccgacuacuacugcgccaccugggccccccgccucaacuccgcccgcgucuucggcaacggcaccauggucaccguccuc

SEQ ID NO: 55860 - RNA, 333 nt, Artificial Sequence
  derived and/or modified sequence opt11 from anti-HIV_119-092284_VR-Chain
caaucggucuugacccagcccccgagcgugagcggggccccgggccagcgcgugaccauaagcuguaccgggagcucgagcaauaucgggggcuaugacguacacugguaccagcaagugcccgggaccgcgcccaagcucuuacucuaugaaaaugacagacgcccgagcgggaucccggacagguucucgggcucgaaaucgggcacgagcgcgaccuuggucauaaccgggcuacagaccggggacgaggccgauuucuauugcgggaccugggacgggagccugcgcacgggcggggucauaggcacgggcacgcgagugaccgugcuc

SEQ ID NO: 55861 - RNA, 333 nt, Artificial Sequence
  derived and/or modified sequence opt11 from anti-HIV_119-091586_VR-Chain
caaucgguccugacccagcccccaagcaugagcgcggcaccgggccagcgcgugaccauaagcuguagcgggaccucgagcgauaucgggcgcaauuacgugagcugguaccagcaauuucccggggccgcgcccaaggucuugaucuaugaaaauagcaaucgcccgagcgggaucccggacagguucucgggcucgaaaucgggcacgagcgcaaccuuggccauaagcgggcuccagaccggggacgaggccgauuacuguugcgcggucuggggcgugcgcagaggcgcgggcgcggucuuuggcgcgggcacgaaagugaccgugcuc

SEQ ID NO: 55862 - RNA, 333 nt, Artificial Sequence
  derived and/or modified sequence opt11 from anti-HIV_119-091023_VR-Chain
caauccguccucacccaaccacccuccgucuccgccgcccccggccaacgcgucaccaucuccugcuccggcuccaccuccaacaucggcaacaacuucgucuccugguaccaccacguccccggcaccgcccccaaacuccucaucuacgacaacgucaaacgccccaccaacguccccgaccgcuucuccggcuccaaauccggcaccuccgccacccucgccaucuccggccuccaaaccggcgacgaagccgacuacuggugcgccgucuggggcguccgccgaggcgccggcgccgucuucggcgccggcaccaaagucaccguacuc

SEQ ID NO: 55863 - RNA, 333 nt, Artificial Sequence
  derived and/or modified sequence opt11 from anti-HIV_119-090334_VR-Chain
caaucggucuugacccagcccccgagcgugagcggggccccgggccagcgcgugaccauaagcuguaccgggagcgcgagcaauaucggggacucggacgugcacugguaccagcaauugcccgggaccgcgcccaagcucuuaaucuuugacaaugacaagcgcccgagcgggaucccagacagguucucgggcucgaaaucgggcacgagcgcgaccuuggccauaaccgggcuccagagcggggacgaggccgauuacuacugcgcggucuggggcgugcgccagggcgcgggcgcggucuuuggcacgggcacgaaagugaccgugcuc

SEQ ID NO: 55864 - RNA, 333 nt, Artificial Sequence
  derived and/or modified sequence opt11 from anti-HIV_119-088694_VR-Chain
caauccguccucacccaaccccccuccgucuccgccgcccccggccaaaaagucaccaucuccugcuccggcuccuccuccaacauccccaucaacggcgucuccugguaccaacaauuccccggcaccgcccccaaacuccucgucuacgaaaccuaccgccgccccuccggcauccccgaccgcuucuccggcuccaaauccggcaccuccgccacccucgccaucaccggccuacaaaccggcgacgaagccgacuacuacugcaccgucuggggcguccgaaaaggcgucggcgccgucuucggcaccggcaccaaagucaccguccuc

SEQ ID NO: 55865 - RNA, 333 nt, Artificial Sequence
  derived and/or modified sequence opt11 from anti-HIV_119-088499_VR-Chain
caauccguccucacccaaccccccuccgucuccgccgcccccggccaaaaagucaccaucuccugcuccggcuccaacuccuacaucggcaacaaauacgucuccugguaccaacaauuccccggcaccgcccccaaacuccucaucuacgaaaccaacaaacgccccuccggcaucccagaccgcuucuccggcuccaaauccggcaccuccgccacccucgccaucaccggccuccaaaccggcgacgaagccgacuacuacugcgccaccugggccccccgccucaacuccgcccgcgucuucggcaacggcacaauggucaccguccuc

SEQ ID NO: 55866 - RNA, 333 nt, Artificial Sequence
  derived and/or modified sequence opt11 from anti-HIV_119-088298_VR-Chain
caaucggucuugacacagcccccgagcgugagcgcggccccgaaagagaaagugaccauaagcuguagcgggggcacgagcaauaucgggcgcaauuacgugagcugguaccagcaagugcccgggaccgcgcccaagcucuugaucuaugaaaauaacaagcgcccgagcgggaucccggacagguucucgggcucgaaaucgggcacgagcgcgaccuuggucauaaccgggcuccagaccggggacgaggccgauuucuauugcgggaccuggggcgggagcuugcgcacgggcggggucuugggcacgggcacgcgcgugaccgugcuc

SEQ ID NO: 55867 - RNA, 324 nt, Artificial Sequence
  derived and/or modified sequence opt11 from anti-HIV_119-087488_VR-Chain
caauccguccucacccaaccccccuccgucuccgccgcccccggccaaaaagucaccaucuucugcuccggccgcuacuccaacaucgaauccaacuacgucuccugguaccaacaacuccccggcaccgcccccaaacuccucauccacgaaaacaaccgccgccccuccggcacccccgaccgcuucuccggcuccaaauccggcaccuccgccacccucgccaucaccggccuccacaccggcgacgaagccgacuacuacugcgaaaccugggacggcuccggcggcgucuucggcaccggcaccaaagucaccguccuc

SEQ ID NO: 55868 - RNA, 333 nt, Artificial Sequence
  derived and/or modified sequence opt11 from anti-HIV_119-087423_VR-Chain
caauccguccuaacccaaccccccuccgucuccgccgcccccggccaaaaagucaccaucuccugcuccgccuccuccuccaacaucggcaacaacuacgucuccugguaccaacaacuccccgcaaccgcccccaaacuccucaucuacgacaccgacaaacgccccuccggcauccccgaccgcuucuccggcuccaaauccggcaccuccgccacccucgccaucaccggccuccaaaccggcgacgaagccgacuacuacugcaccgucuggggcguccgcaaaggcgucggcgccgucuucggcaccggcaccaaagucaccguccuc

SEQ ID NO: 55869 - RNA, 324 nt, Artificial Sequence
  derived and/or modified sequence opt11 from anti-HIV_119-087371_VR-Chain
caaucggucuugacccagcccccgagcuugagcgcggccccgggccagcgcgugaccauaagcuguagcgggggcgcgagcaauaucgggaaaaauagcgugagcugguacgugcaagugcccgggaccgcgcccaagcucuugaucuaugaaaauaaccagcgcccgagcgggaucucggacagguucucgggcucgaaaucgggcucgagcgcgaccuugggcauaaccgggcuccagaccgcggacgaggccgauuacuauugcgagaccugggacgggagcgggggcguguucgggaccgggaccaaggucacggucuug

SEQ ID NO: 55870 - RNA, 321 nt, Artificial Sequence
  derived and/or modified sequence opt11 from anti-HIV_119-087279_VR-Chain
caauccguccucacccaaccccccuccgucuccgccgcccccggccaaaaagucaccaucuccugcuccggcuccuccuccaacaucggcaaaaacuacgucuccugguaccaacaauuccccggcaccgcccccaaacuccucauguacgaaaacaacaaacgccccuccggcguccccgaccgcuucuccggcuccaaaucuggcaccuccgccacccucgacaucuccggccuccaaaccggcgacgaagccgacuacuacugcuccaccugguccggcucccucaacuucggcaccggcacccgcguaaccguccuc

SEQ ID NO: 55871 - RNA, 324 nt, Artificial Sequence
  derived and/or modified sequence opt11 from anti-HIV_119-087146_VR-Chain
caauccguccucacccaaccccccuccgucuccgccgcccccggccaaaaagucaccaucucaugcucaggcuccuccuccaacaucggcaaaaacuccgucuccugguaccaacaauuccccggcaccgcccccaaacuccucaucuacgaaaacaacaaacgccccuccggcauccccgaccgcuucuccggcuccaaauccggcaccuccgccacccucgccaucaccggccuccacaccggcgacgaagccgacuacuacugcgaaaccugggacggcuccggcggcgucuucggcaccggcaccaaagucacaguccuc

SEQ ID NO: 55872 - RNA, 324 nt, Artificial Sequence
  derived and/or modified sequence opt11 from anti-HIV_119-087048_VR-Chain
caguucgugcucacgcaaccgcccucggucucggccgcgcccaggcaaaaggucauaaucucgugcucgggcucgagcucgaacauaggcaagaacuacgucucaugguaucaacagcuaccgggcacggccccgaaauugcucauauacgauaacgauaaaaggcccucgggcauaagcgaucgcuuuagcgcgagcaagagcgggaccucggccacgcucgcgaucacgggccugcacacgggcgaugaagcggacuauuacugugaaacgugggauggcucgggcggggucuuuggcacgggcacgaaagugaccgugcuc

SEQ ID NO: 55873 - RNA, 321 nt, Artificial Sequence
  derived and/or modified sequence opt11 from anti-HIV_119-085802_VR-Chain
caauccauccucacccaaccccccuccgucuccgccgcccccggccaacgcgucaccauccccugcuucggcggccacuccaacaucggcuccaacuacgucucaugguaccaacaccuccccggcaccgcccccaaacuccucaucuucgaaaacaacaaacgccccuccggcauccccgaccgcuucuccggcgccaaauccggcacauccgccacccucgccaucaccggccuccaaaccggcgacgaagccgacuacuucugcgccaccugguccggcggccucaacuucggcaccggcaccaaagucaccguccuc

SEQ ID NO: 55874 - RNA, 324 nt, Artificial Sequence
  derived and/or modified sequence opt11 from anti-HIV_119-085784_VR-Chain
caauccuuccucacccaaccacccuccgucuccgccgcccccggacaaaaagucaccaucuccugcuccggcuccaacuccaacaucggcaacaacuacgucuccugguaccaauaccuccccggcaccgcccccaaacuccucaucuacgaaaacgaccgccgccccuccggcacccccgaccgcuucuccggcuccaaaucaggcaccuccgccacccucgccaucaccggccuacaaaccggcgacgaagccgacuacuacugcgaaaccugggacggcuccggcggcgucuucggcaccggcaccaaagucaccguccuc

SEQ ID NO: 55875 - RNA, 333 nt, Artificial Sequence
  derived and/or modified sequence opt11 from anti-HIV_119-085370_VR-Chain
caauccguccucacccaaccccccuccgucuccgccgcccccggccaaaccgucaccaucuccugcuccggcuccuccuccaacaucggcaacaccuacgucuccugguaccaacaccuccccggcaccgcccccaaacuccucaucuacgacaacaacauccgccccuccggcauccccgaccgcuucuccgccuccaaauccggcaccuccgccacccucgccaucaccggccuccaaaccggcgacgaagccgacuacuacugcgccaccugggcccccucccucaacuccgcccgcgucuucggcuccggcacccgcgucgccguccuc

SEQ ID NO: 55876 - RNA, 321 nt, Artificial Sequence
  derived and/or modified sequence opt11 from anti-HIV_119-085276_VR-Chain
caauccauccucacccaaccacccuccgucuccgccgcccccggccaacgcgucaccaucuccugcuccggcuccuccuccaacaucggcaacaacuacgucuccugguaccaacacguccccggcaccgcccccaaacuccucaucuacgaaaacaaccgccgacccuccggcacccccgaccgcuucuccggcgccaaauccggcaccuccgccacccucgccaucaccggccuccaaaccggcgacgaagccgacuacuucugcuccaccugguccggcucccucaacuucggaaccggcaccaaagucaccguccuc

SEQ ID NO: 55877 - RNA, 333 nt, Artificial Sequence
  derived and/or modified sequence opt11 from anti-HIV_119-084885_VR-Chain
caaucagucuugacccagcccccgagcgugagcgcggccccgggcgagaaagugaccauaagcuguagcgggagcucgagcaagaucgggaacaauuucgugagcugguaccagcaagugcccgggaccgcgcccaagcucuuggucuaugaaucguacaggcgcccgagcgggaucccggacagguucucgggaucgaaaucgggcacgagcgcgaccuuggccauaaccgggcuccagaccggggacgaggccgauuacuauugcacggucuggggcgugcgcaagggcgugggcgcggucuuuggcacgggcacgaaagugaccgugcuc

SEQ ID NO: 55878 - RNA, 333 nt, Artificial Sequence
  derived and/or modified sequence opt11 from anti-HIV_119-084874_VR-Chain
caaucgguccugacccagcccccgagcgugagcggggccccgcgccagcgcguaaccauaagcuguagcgggagcgcgagcaauaucgggaaaaauagcgugagcugguaccagcaagugcccgggaccgcgcccaagcucuugaucuaugaaaauaacaagcgcccgagcggaaucccggacagguucucgggcucgaaaucgggcacgagcgcgaccuuggucauaaccgggcuccagaccggggacgaggccgauuucuauugcgggaccugggacgggagcuugcgcacgggcggggucauaggcacgggcacacgcgugaccgugcuc

SEQ ID NO: 55879 - RNA, 333 nt, Artificial Sequence
  derived and/or modified sequence opt11 from anti-HIV_119-084691_VR-Chain
caauccguccucacccaaccccccuccgucuccgccgcccccggccaaaaagucgucaucuccugcuccggcucauccuccaucaucgaaaaaaacuccaucucaugguaccaacaaggccccggcgccgcccccaaacuccucaucuacgaaaacgacaaacgccccuccggcauccccgaccgcuucuccggcuccaaauccgccaccuccgccacccucgccaucgucggccuccaaaccggcgacgaagccgacuacugcugcgccgucuggggcguccgccgcggcgccggcgccguauucggcgccggcaccaaagucaccguccuc

SEQ ID NO: 55880 - RNA, 324 nt, Artificial Sequence
  derived and/or modified sequence opt11 from anti-HIV_119-083793_VR-Chain
caauccguccucacccaaccccccuccgucuccgccgcccccggccaaaaagucaccaucuccugcuccggcuccuccuccaacaucggcaaaaacuccgucuccugguaccaacaacuccccgccaccgcccccaaacuccucaucuacgaauccaacaaacgccccuccggcauccccgaccgcuucuccggcuccaaauccggcaccuccgccacccucgccaucaccggccuccaaaccggcgacgaagccgacuacuacugcgccaccugggacggccgcgucuccgucaucggcaccggcaccaaagucaccguccuc

SEQ ID NO: 55881 - RNA, 324 nt, Artificial Sequence
  derived and/or modified sequence opt11 from anti-HIV_119-083163_VR-Chain
caauccguccucacccaaccccccuccgucuccggcgcccccggccaacgcgucaucaucuccugcaccggcuccuccuccaacaucuggggcuacgacguccaaugguaccaacaacuccccggcaccgcccccaaacuccuccucuacgaaaacgaccgccgacccuccggcacccccgaccgcuucuccggcuccaaauccggcaccucagccacccucgccaucaccggccuccacaccggcgacgaagccgacuacuacugcgaaaccugggacggcuccggcggcgucuucggcaccggcaccaaagucaccguccuc

SEQ ID NO: 55882 - RNA, 333 nt, Artificial Sequence
  derived and/or modified sequence opt11 from anti-HIV_119-082331_VR-Chain
caaucggucuugacccagcccccgagcauaagcgcggccccgggccagaaagugaccauaagcuguagcgggggcucgagcaauaucggggccaauuacgugagcugguaccagcacuugcccgggaccgcgcccaagcucuugaucuaugaaacgaacaagcgcccgagcgggaucccggacagguucucgggcucgcaaucgggcacgagcgcgaccuuagucauaaccgggcuccagaccggggacgaggccgauuucuauugcggaaccuggggcgggagcuugcgcgcgggcggggucauaggcacgggcacgcgcgugaccgugcuc

SEQ ID NO: 55883 - RNA, 324 nt, Artificial Sequence
  derived and/or modified sequence opt11 from anti-HIV_119-082070_VR-Chain
cagagcgugcucacgcaaccgccaucggucucggccgcgcccgggcaaaaggucgugaucucgugcucgggcucaagcucgaucauagaaaagaacucgaucucgugguaucaacagggcccgggcgcggccccgaaauugcucauauacgagaacgaucgcaggcccucgggcacgcccgaucgcuuuagcgggagcaagagcgggaccucggccacgcucgcgaucacgggcuugcaaacgggcgaugaagcggacuauuacugugaaacgugggauggcucgggcggggucuuuggcacgggcacgaaagugaccgugcuc

SEQ ID NO: 55884 - RNA, 333 nt, Artificial Sequence
  derived and/or modified sequence opt11 from anti-HIV_119-081512_VR-Chain
caauccguccucacccaaccacccuccgucuccgccgcccccggccaaaacgucaccuucuccugcuccggcuccaacuccaacaucggcgacaacuacgucuccugguaccaacaaauccccggcaccgcccccaaacucgucaucuacgacaacaacaaacgccccuccggcauccccgaccgcuucuccggcuccaaauccggcaccuccgccacccucgucaucaccggccuccaaaccggcgacgaagcagacuucuacugcggcaccugggacggcucccuccgcaccggcggcgucaucggcaccggcacacgcgucaccguccuc

SEQ ID NO: 55885 - RNA, 333 nt, Artificial Sequence
  derived and/or modified sequence opt11 from anti-HIV_119-080816_VR-Chain
caacucguccucacccaaccccccuccgccuccggcacccccggccaacgcgucaccaucuccugcuccggcuccuccuccaacaucggcuccaacuucgucuccugguaccaacaacgccccggcaccgcccccaaacuccucaucuacgaaaccaacaaacgccccuccggcauccccgaccgcuucuccggcuccaaauccggcaccuccgccacccucgccauaaccggccuccaaaccggcgacgaagccgacuacuacugcgccaccugggccccccgccucaacuccgcccgcgucuucggcaacggcaccauggucaccguccuc

SEQ ID NO: 55886 - RNA, 333 nt, Artificial Sequence
  derived and/or modified sequence opt11 from anti-HIV_119-079302_VR-Chain
caauccguccucacccaaccacccuccgucuccgccgcccccggccaaaaagucaccaucuccugcuccggcuccuccuccuacaucggcaacaaauacgucuccugguaccaacaauuccccggcaccgcccccaaacuccuaaucuacgaaaacaacaaacgccucuccggcauccccgaccgcuucuccgccuccaaauccgccaccuccgccacccucgccaucucaggccuccaaaccggcgacgaagccgacuucuacugcggcaccugggacggcucccuccgcaccggcggcgucaucggcaccggcacccgcgucaccguccuc

SEQ ID NO: 55887 - RNA, 327 nt, Artificial Sequence
  derived and/or modified sequence opt11 from anti-HIV_119-079292_VR-Chain
caauccguccucacccaaccccccuccgucuccgccgcccccggccaaaaagucaccaucuccugcuccggcuccaacuccaacaucggcaacaacuacgucuccugguaccaacaacuccccggcaccgcccccaaacuccucaucuacgacaacaacaaacgccccuccggcauccccgaccgcuucuccggcuccaaauccggcaccuccgccacccucggcaucaccggccuccaaaccggcgacgaagccaacuacuacugcggcaccugggacaccucccuaucaggcgucuucggcaccggcaccgaagucaucguccuc

SEQ ID NO: 55888 - RNA, 321 nt, Artificial Sequence
  derived and/or modified sequence opt11 from anti-HIV_119-079289_VR-Chain
caauccgcccucacccaaccccccuccgucuccgccgcccccggccaacgcgucaccaucuccugcuccggcaacaacuccaacaucggcaacaacuucgucuccugguaccaacuccuccccggcaccgcccccaaacuccucaucuacgaaaacaacaaacgcuccuccggcauccccgaccgcuucuccggcucaaaauccggcaccuccgccacccucggcaucaccggccuccaaaccggcgacgaagccgacuacuucugcuccaccugguccggcucccucaacuucggcaccggcacccgcgucaccguccuc

SEQ ID NO: 55889 - RNA, 324 nt, Artificial Sequence
  derived and/or modified sequence opt11 from anti-HIV_119-078935_VR-Chain
caauccguccucacccaaccccccuccguauccgccgcccccggccaacgcgucaccaucuccugcuccggcaccuccgccaacaucgaaaacuacuacgucuccugguaccaacaacuccccggcaccgcccccaaacucaucaucuacgacgacaacaaacgccccuccggcaucccccaacgcuucuccggcuccaaauccggcaccuccgccacacucggcaucaccggccuccaaaccggcgacgaagccgaauacuacugcgaaaccugggacggcuccggcggcgucuucggcaccggcaccaaagucaccguccuc

SEQ ID NO: 55890 - RNA, 324 nt, Artificial Sequence
  derived and/or modified sequence opt11 from anti-HIV_119-078702_VR-Chain
caaucaguccuaacccagcccccaagcguaagcgcagccccaggccaaaaaguaaccauaagcugcagcggaagcucaagcguauucggcaaaaacuacguaagcugguaccaacaccuacccggaaccgcacccaaacuccuaaucuacgaaaacaccaaacgcccaagcggaaucccagacagauucucaggaucaaaaucaggcacaagcgcaacccuggccauaaccggacuccagaccggagacgaagccgacuacuacugcgaaaccugggacggaagcggaggcguauucggaagcggaaccaaagucacaguccua

SEQ ID NO: 55891 - RNA, 324 nt, Artificial Sequence
  derived and/or modified sequence opt11 from anti-HIV_119-078593_VR-Chain
caauccuuccucacccaaccccccuccgucuccgccgcccccggccaaaaagucaccaucuccugcuccggcuccaacuccaacaucggcaacaacuacgucuccugguaccaacaaguccccggcaccgcccccaaacuccucaucuacgaaaacaacaaacgccccuccggcauccccgaccgcuucuccggcuccaaauccggcaccuccgccacccucgucaucaccggccuccacaccggcgacgaagccgacuacuacugcgaaaccugggacggcuccggcggcgucuucggcaccggcuccaacgucacccuccuc

SEQ ID NO: 55892 - RNA, 333 nt, Artificial Sequence
  derived and/or modified sequence opt11 from anti-HIV_119-077708_VR-Chain
caauccguccucacccaaccccccucacucuccgccgcccccggccaaaaagucaccaucuccugcuccggcaccaccuccaacaucggcaacaacuacgucuccugguaccaacaccuccccggcaccgcccccaaacuccucaucuacgaaaacaccaaacgccccuccggcauccccgaccgcuucuccggcuccaaauccggcaccuccgccacccucggcaucaccggccuccaaaccggcgacgaagccgacuacuacugcaccgucuggggcguccgcaaaggcgucggcgccgucuucggcaccggcaccaaagucaccguccuc

SEQ ID NO: 55893 - RNA, 321 nt, Artificial Sequence
  derived and/or modified sequence opt11 from anti-HIV_119-076904_VR-Chain
caauccguccucacccaaccccccuccgucuccgccgcccccggacaaaaagucaccaucuccugcucccgcuccuccucccacaucgaaaacuccuacgucuccugguaucaacaccuccccggcaccgcccccaaacuccucaucuacgaaaacaacaaacgccccuccggcauccccgaccgauucuccggcuccaaauccggcaccuccgccacccucggcaucuccggccuccaaaccggcgacgaagccgacuacuucugcuccaccugguccggcucccucaacuucggcaccggcacccgcgucaccguccuc

SEQ ID NO: 55894 - RNA, 324 nt, Artificial Sequence
  derived and/or modified sequence opt11 from anti-HIV_119-075862_VR-Chain
caauccguccucacccaaccccccuccaucuccgcagcccccggccaaaaagucaccaucuccugcuccggcuccgccuccaacaucggcaaaaacuccgucucaugguaccaacaauuccccggcaccgcccccaaacuccucaucuacgaaaacaaccgccgccccuccggcacccccgaccgauucuccggcucaaaauccggcaccuccgccacccucgccaucaccggccuccaaaccggcgacgaagccgacuacuacugcgaaaccugggacggcuccggcggcgucuucggcaccggcaccaaagucaccguccuc

SEQ ID NO: 55895 - RNA, 333 nt, Artificial Sequence
  derived and/or modified sequence opt11 from anti-HIV_119-075465_VR-Chain
caauccguccucacccaaccccccuccgucuccgccgcccccggccaaaaagucgucaucuccugcuccggauccuccuccaucaucggcaacaacuacgucuccugguaccaacaacuccccggcaccgcccccaaacuccucaucuacgaaaacaaccgccgccccuccggcauccccgaccgcuucuccggcuccaaauccggcaccuccgccacccucgccaucuccggccuccaaaccggcgacgaagccgacuacugcugcgccgucuggggcguccgccgcggcgccggcgccgucuucggcgccggcaccaaagucaccguccuc

SEQ ID NO: 55896 - RNA, 330 nt, Artificial Sequence
  derived and/or modified sequence opt11 from anti-HIV_119-074822_VR-Chain
ucggucuugacccagcccccgagcgugagcgcggccccgggccagaacauaaccauaagcuguagcgggggcucgagcaauaucgcgaaaaauuacauaagcugguaccagcacuugcccgggaccgcgcccaagaucgugaucuaugacaaugacaaacgcccgcucgggaucccggacagguucucggccucgaaaucgggcacgagcgcgaccuugggcauaaccgggcuacagaccggggacgaggccgauuacuauugcgcggucuggggcgugcgcaggggcgugggcgcggucuuuggcgcgggcacgaaagugaucgugcuc

SEQ ID NO: 55897 - RNA, 333 nt, Artificial Sequence
  derived and/or modified sequence opt11 from anti-HIV_119-074629_VR-Chain
caaucggucuugacccagcccccgagcgagagcgcggccccgggccagaaagugaccauaagcuguagcgggggcacgagcaauaucgggaacaauuacgugagcugguacaggcgcuugcccgggaccgcgcccaagcucuuaaucuaugaaaauaacaggcgcccgagcgggaucccggacagguucucgggcucaaaaucgggcacgagcgcgaccuuggccauaagcgggcuccagaccggggacgaggccgauuacuguugcgcggucuggggcgugcgcaggggcgcgggcgcggucuuuggcgcgggcacgaaagugaccgugcuc

SEQ ID NO: 55898 - RNA, 324 nt, Artificial Sequence
  derived and/or modified sequence opt11 from anti-HIV_119-074500_VR-Chain
caauccguccucacccaaccccccuccgucuccgccgcccccggccaaaaagucaccauguccugcuccggcuccuccuccaacaucggcaacaacuacgucuccugguaccaauaccuccccggcaccgcccccaaacuccuaaucuacgaaaacgaccgccgccccuccggcauccccgaccgcuucuccgccuccaaauccggcaccuccgccacccucgccaucaccggccuccaaaccggcgacgaagccgacuacuacugcgaaaccugggacggcuccggcggcgucuucggcaccggcaccaaagucaccguccuc

SEQ ID NO: 55899 - RNA, 333 nt, Artificial Sequence
  derived and/or modified sequence opt11 from anti-HIV_119-073911_VR-Chain
caauccguccucacccaaccccccuccgucuccgccgcccccggccaacgcgucaccaucuccugcuccggcuccuccuccaacaucgaaaacaacuacgucucaugguaccaacaccuccccggcaccgcccccaaacuccucgucuacgacgacaacaaacgccccuccggcaucccccaccgcuucuccgccuccaaauccggcaccuccgccacccucgccaucaccggccuacaaaccggcgacgaagccgacuacuacugcacccucuggggcguccgcaaaggcgucggcgccgucuucggcaccggcaccaaagucaccguccuc

SEQ ID NO: 55900 - RNA, 324 nt, Artificial Sequence
  derived and/or modified sequence opt11 from anti-HIV_119-072765_VR-Chain
caauccguccucacccaaccccccuccguauccgccgcccccggccaaaaaguaaccaucuccugcuccggcaacuccuccaacaucggcaacaacuucgucuccugguaccaacaaguccccggcaccgcccccaaacuccucgucuacgaaaccuaccgccgccccuccggcacccccgaccgcuucuccggcuccaaauccggcaccuccgccacccucgccaucucaggccuccaaaccggcgacgaagccgacuacuacugcggcaccugggacggcuccggcggcgucuucggcaccggcaccaaagucaccguccuc

SEQ ID NO: 55901 - RNA, 333 nt, Artificial Sequence
  derived and/or modified sequence opt11 from anti-HIV_119-072313_VR-Chain
caauucguccucacccaaccacccuccgucuccgccgcccccggccaaaaagucaccaucuccugcuccgccuccucauccaucaucggcaaaaacuacgucuccugguaccaacaauuccccggcaccgcccccaaacuccucaucuacgaagacaacaaacgccccuccggcauccccgaccgcuucuccggcucaaaauccggcaccucagccacccuagccaucaccggccuccaaaccggcgacgaagccgacuacuacugcaccgucuggggcguccgcaaaggcgucggcgccgucuucggcaccggcaccaaagucaccguccuc

SEQ ID NO: 55902 - RNA, 333 nt, Artificial Sequence
  derived and/or modified sequence opt11 from anti-HIV_119-072280_VR-Chain
caauccguccucacccaaccccccuccgucuccgccgcccccggccaaaaagucuccaucuccugcuccggcuccgacuccaaccucggcgacaacuacgucuccugguaccaacaauuccccggcaccgcccccaaacuccucauccacgacaacaacaaacgccccuccggcacccccgaccgcuucuccggcuccaaauccggcaccuccgccacccucgccaucaccggccuacaaaccggcgacgaagccgacuacuacugcgccaccugggccccccgccucaacuccgcccgcgucuucggcaacggcaccauggucaccguccuc

SEQ ID NO: 55903 - RNA, 333 nt, Artificial Sequence
  derived and/or modified sequence opt11 from anti-HIV_119-071693_VR-Chain
caauccguccucacccaaccccccuccgucuccgccgccccaggccaaaaagucgucaucuccugcuccggcucauccuccaucaucgaaaaaaacuccaucuccugguaccaacaaggccccggcgccgcccccaaacuccucaucuacgaaaacgacaaacgccccuccggcauccccgaccgcuucucaggcucaaaauccggcaccuccgccacccucgccaucaccggccuccaaaccggcgacgaagccgacuacuacugcaccaucuggggcguccgcaaaggcgucggcgccgucuucggcaccggcaccaaagucaccguccuc

SEQ ID NO: 55904 - RNA, 321 nt, Artificial Sequence
  derived and/or modified sequence opt11 from anti-HIV_119-071353_VR-Chain
caauccguccucacccaaccccccuccgccuccgccgcccccggccaaaaagucaccaucuccugcuccggcuccaacuccaacaucggcaacaacuucgucuccugguaccaacucuuccccggcaccgcccccaaacuccucaucuucgaaaacaacaaacgccccuccggcauccccgaccgcuucuccggcgccaaauccggcaccuccgccacccucgccaucaccggccuccaaaccggcgacgaagccgacuacuucugcuccaccugguccggcucccucaacuucggcaccggcacccgcgucaccguccuc

SEQ ID NO: 55905 - RNA, 324 nt, Artificial Sequence
  derived and/or modified sequence opt11 from anti-HIV_119-069711_VR-Chain
caauccguccucacccaaccacccuccgucuccgccgcccccggccaaaaagucaccaucuccugcuccggcuccuccuccaacaucggcaacaacuacgucuccugguaccaacaacuccccggcaccgcccccaaacuccucaucuacgacaacaacaaccgccccuccggcguccccgaccgcuucuccggcuccaaauccggcaccuccgccacccucgccaucaccggccuccaaaccggcgacgaagccgacuacuacugcgaaaccugggacgacuccggcggcgucuucggcaccggcaccaaagucaccguccuc

SEQ ID NO: 55906 - RNA, 333 nt, Artificial Sequence
  derived and/or modified sequence opt11 from anti-HIV_119-069061_VR-Chain
caauccguccucacccaaccccccuccgucuccgccgcccccggccaaaaagucaccaucuccugcuccggcuccuccuccaacaucggcuccaacuacgucuccugguaccaacaacuccccggcaccgcccccaaacuccucgucuacgacaacaacgaacgccccuccggcauccccgaccgcuucuccggcuccaaauccggcaccuccgccacccucgccaucaccggccuccaaaccggcgacgaagccgacuacuacugcgccaccugggccccccgccucaacuccgcccgagucuucggcaacggcaccauggucaccguccuc

SEQ ID NO: 55907 - RNA, 324 nt, Artificial Sequence
  derived and/or modified sequence opt11 from anti-HIV_119-068202_VR-Chain
caauccguccucacccaagaacccuccgucucaggcgcccccggccaacgcgucaccaucuccugcaccggcuccaacuccaacaucggcggccacgacguccacugguaccaacaacuccccggcaccgcccccaaacuccucaucuacgacaacgacaaacgccccuccggcauccccgaccgcuucuccggcuccaaauccgacaccuccgccucccucggcaucaccggccuccaaaccggcgacgaagccgacuacuacugcgaaaccugggacggcuccggcggcgucuucggcaccggcaccaaagucaccguccuc

SEQ ID NO: 55908 - RNA, 324 nt, Artificial Sequence
  derived and/or modified sequence opt11 from anti-HIV_119-068063_VR-Chain
caauccgcccucacccaaccccccuccgccuccggcucccucggccaauccgucaccaucuccugcaccggcacccgcuccgacgucggcaacuacuacgucuccugguaccaacaacuccccggcaccgcccccaaacuccucaucuccgaaaacaaccgccgccccuccggcacccccgaccgcuucuccggcuccaaauccggcaccuccgccacccucgccaucuccggccuccaaaccggcgacgaagccgacuacuacugcggcaccugggacggcuccggcggcgucuucggcaccggcaccaaagucaccguccuc

SEQ ID NO: 55909 - RNA, 333 nt, Artificial Sequence
  derived and/or modified sequence opt11 from anti-HIV_119-067980_VR-Chain
caaucggucuugacccagcccccgagcgugagcgcggccccgggccagaaagugaccauaagcuguagcgggaacucgagcaauaucgggaacaauuucgugagcugguaccagcaagugcccgggaccgcgcccaagcucuuggucuaugaaacguacagacgcccgagcgggaucccggacagguucucgggcucgaaaucgggcacgagcgcgaccuuggccauaaccgggcuccagaccggggacgaggccgauuaccauugcgcgaucuggggcgugcgcaagggcgugggcgcggucuuuggcacgggcacgaaagugaccgugguc

SEQ ID NO: 55910 - RNA, 324 nt, Artificial Sequence
  derived and/or modified sequence opt11 from anti-HIV_119-067866_VR-Chain
caauccguccucacccaaccccccuccgucuccgccgcccccggccaaaaagucaccaucuccugcucaggcuccaccuccaccaucggcaacaacuacgucuccugguaccaacaccuccccggcaccgcccccaaacuccucaucuacgacaacaacaaacgccccgccggcauccccgaccgcuucacagccuccaaauccggcaccuccgccacccucgccaucaccggccuccacaccggcgacgaagcagacuacuacugcgaaacaugggacggcuccggcggcgucuucggcaccggcaccaaagucaccguccuc

SEQ ID NO: 55911 - RNA, 321 nt, Artificial Sequence
  derived and/or modified sequence opt11 from anti-HIV_119-067756_VR-Chain
caauccguccucacccaaccccccuccgucuccgccgcccccggccaaaaagucgucaucuccugcuccggcuccaccuccaacaucggcaaaaacuucgucuccugguaccaacaacuccccggcaccgcccccaaacuccuaaucuacgaaaacucccgccgccccuccggcauccccgaccgcuucuccggcgccaaauccggcaccuccgccacccucgccaucaccggccuccaaaccggcgacgaagccgacuacuucugcuccaccugguccggcucccucaacuucggcaccggcacccgcgucaccguccuc

SEQ ID NO: 55912 - RNA, 321 nt, Artificial Sequence
  derived and/or modified sequence opt11 from anti-HIV_119-066859_VR-Chain
caauccguccucacccaaccccccuccgucuccgccgcccccggccaaaaagucaccaucaccugcuccggcuccgccuccaacaucgaaaacaacuacgucuccugguaccaacaauuccccggccccgcccccaaacuccucaucuacgaaaacgacaaacgccccuccggcauccccgaccgcuucuccggcuccgccuccggcaccuccgccacccucgccaucaccggccuccaaaccggcgacgaagccgacuacuucugcuccaccugguccggcucacucaacuucggcaccggcacccgcgucaccguccuc

SEQ ID NO: 55913 - RNA, 333 nt, Artificial Sequence
  derived and/or modified sequence opt11 from anti-HIV_119-065821_VR-Chain
caauccguccucacccaaccccccuccgucuccgccacccccggccaacgcgucaccgucuccugcuccggcuccucauccaacaucggcaaccacuacgucuccugguaccaacaaguccccggcaccgcccccaaacuccucaucuacgacaacuccaaccgccccuccggcauccccgaccgcuucuccggcuccaaauccggcaccuccgccacccucggcaucaccggccuccaaaccggcgacgaagccgacuacuacugcaccgucuggggcguccgcaaaggcgucggcgcagucuucggcaccggcaccaaagucaccguccuc

SEQ ID NO: 55914 - RNA, 333 nt, Artificial Sequence
  derived and/or modified sequence opt11 from anti-HIV_119-065191_VR-Chain
caauccguccucacccaaccccccuccgucuccgccgcccccggccaaaaagucaccauauccugcuccggcaacaacuccaacaucggcaacaacuacgucuccugguaccaacaacuccccggcaccgcccccaaacuccucaucuucgaaaaccacaaacgccccuccggcauccccgaccgcuucuccggcuccaaauccggcaccucagccacccucggcaucaccggccuccaauccggcgacgaagccgacuacuacugcgccaccugggccccccgccucaacuccgcccgcgucuucggcaccggcaccaaagucaccguccuc

SEQ ID NO: 55915 - RNA, 333 nt, Artificial Sequence
  derived and/or modified sequence opt11 from anti-HIV_119-064667_VR-Chain
caaucggucuugacccagcccccgagcgugagcgcggccccgggccagaaagugaccauaagcuguagcgggagcaauagcuauaucgggaacaaguacgugagcugguaccagcaagugcccgggaccgcgcccaagcucuugaucuaugaaaauaacaagcgcccgagcgggaucccggacagguucucgggcucaaaaucgggcacgagcgcgaccuuggucauaaccgggcuccagaccggggacgaggccgauuucuauugcgggaccugggacgggagcuugcgcacgggcggggucauaggcacgggcacgcgcgugaccgugcuc

SEQ ID NO: 55916 - RNA, 324 nt, Artificial Sequence
  derived and/or modified sequence opt11 from anti-HIV_119-063791_VR-Chain
caauccguccucacccaaccccccuccgucuccgcagcccccggccaaaaaguccccaucuccugcuccggcaacuccuccaacaucggaaacaacuacgucuccugguaccaacaacuccccggcaccgcccccaaacuccucaucuacgaaaacaacaaacgccccuccggcauccccgaccgcuucuccggcuccaaauccggcaccuccgccacacucgccaucaccggccuccacaccggcgacgaagccgacuacuacugcgaaaccugggacggcuccggcggcgucuucggcaccggcaccaaagucaccguccuc

SEQ ID NO: 55917 - RNA, 333 nt, Artificial Sequence
  derived and/or modified sequence opt11 from anti-HIV_119-062989_VR-Chain
caauccguccucacccaaccccccucagucuccgccgcccccggccaacgcgucaccaucuccugcuccggcuccuccuccaacaucggcaacaacuucgucuccugguaccaacaauuccccggcaccguccccaaacuccucaucuacgaaaacaaccgccgccccucaggcauccccgaccgcuucuccggcuccaaauccggcaccuccgccacccucgccaucaccggccuccaaaccggcgacgaagccgacuacuacugcgccgucuggggcguccgccgcggcguaggcgccgucuucggcgccggcaccaaagucaucguccuc

SEQ ID NO: 55918 - RNA, 321 nt, Artificial Sequence
  derived and/or modified sequence opt11 from anti-HIV_119-062286_VR-Chain
caaucggucuugacccagcccccgagcgugagcgcggccccgggccagaaagugaccauaagcuguagcgggagcgcgagcaauaucgggaaaaauuucgugagcugguaccagcaauugcccgggaccgcgccaaagcucuugaucucggaaaauaacaggcgcccgagcgggaccccggacagguucucgggcucgaaaucgggcgcgagcgcgaccuuagucauaagcgggcuccagaccggggacgaggccgauuacuauugcgcgaccuggagcgggagcuugagcauaggcacgggcacgaaaguaaccgugcuc

SEQ ID NO: 55919 - RNA, 321 nt, Artificial Sequence
  derived and/or modified sequence opt11 from anti-HIV_119-061416_VR-Chain
caauccguccuaacccaaccccccuccgucuccgccgcccccggccaaaaagucgucaucuccugcuccggcuccuccuccaucuucgaaaaaaacuccaucuccugguaccaacaaggccccggcgccgcccccaaacuccucaucuacgaaaacgacaaacgccgcucaggcauccccgaccgcuucuccggcuccaaauccgccaccuccaccacccucgccaucgucggccuccaaaccggcgacgaagccgacuacuucugcuccaccugguccggcucccucaacuucggcaccggcacccgcgucaccguccuc

SEQ ID NO: 55920 - RNA, 321 nt, Artificial Sequence
  derived and/or modified sequence opt11 from anti-HIV_119-061344_VR-Chain
caauccguccucacccaaccccccuccgucuccgccgcccccggccaaaaagucaccaucuccugcuccggcuccuccuccgucuucggcaaaaacuacgucuccugguaccaacaccuccccggcaccgcccccaaacuccucaucuacgaaaacaacaaacgccccuccggcauccccgaccgcuucuccggcgccaaauccggcaccgccgccacccucgccaucaccggccuccaaaccggcgacgaagccgacuacuacugcgccaccugguccggcucccucaacuucggcaccggcaccaaagucaccguccuc

SEQ ID NO: 55921 - RNA, 324 nt, Artificial Sequence
  derived and/or modified sequence opt11 from anti-HIV_119-060240_VR-Chain
caaucaguccucacacaaccccccuccgaauacggcgcccccggccacaacgucaccgucuccugcuccggcaccaccuccaacaucgaaaacaacuucgucuccugguaccuaaucguccccggcaccgcccccaaacuccucaucuucgacaacgacaaacgccccuccggcauccccgaccgcuucuccggcuccaaauccggcaccuccgccacccucgccaucaccggccuccaaaccggcgacgaagccgacuacuacugcgccaccugggacggccgcgucuccgucaucggcaccggcaccaaagucaccguccuc

SEQ ID NO: 55922 - RNA, 333 nt, Artificial Sequence
  derived and/or modified sequence opt11 from anti-HIV_119-060184_VR-Chain
caauccguccucacccaaccccccuccgucuccggcgcccccggccaacgcgucaccaucuccugcuccggcuccuccucaaacaucggcuccaacaccgucaacugguaccaacaacuccccggcaccgcccccaaacuccucaucuacgacaacaacaaacgccccuccggcauccccgaccgcuucuccggcuccaaauccggcaccuccgccacccucgucaucaccggccuccaaaccggcgacgaagccgacuucuacugcggcacaugggacggcucccuccgcaccggaggcgucaucggcaccggcacccgcgucaccguccuc

SEQ ID NO: 55923 - RNA, 321 nt, Artificial Sequence
  derived and/or modified sequence opt11 from anti-HIV_119-058035_VR-Chain
caauccguccucacccaaccccccuccgucuccgccgcccccggccaaaaagucaccaucuccugcuccggcuccgccuccaacaucggcaaaaacuucgucuccugguaccaacaacuccccggcaccgcccccaaacuccucaucuacgaaaacaaccgccgccccuccggcacccccgaccgcuucuccggcgccaaauccggcaccucagccacccucgccaucaccggccuccaaaccggcgacgaagccgacuacuucugcuccaccugguccggcucccucaacuucggcaccggcacccgcgucaccguccuc

SEQ ID NO: 55924 - RNA, 321 nt, Artificial Sequence
  derived and/or modified sequence opt11 from anti-HIV_119-057858_VR-Chain
caauccguccucacccaaccccccuccgucuccgccgcccccggccaaaacgucaacaucucaugcuccggcggcuccuccaacaucggcuccaacuacgucuccugguaccaacaauuccccggcaccgcccccaaacuccucaucuacgaaaacaacaaacgccccuccggcauccccgaccgcuucuccggcgccaaauccggcaccuccgccacccucgccaucaccggccuccaaaccggcgacgaagccgacuacuucugcuccaccugguccggcucccucaacuucggcaccggcacccgcgucacaguccuc

SEQ ID NO: 55925 - RNA, 324 nt, Artificial Sequence
  derived and/or modified sequence opt11 from anti-HIV_119-057473_VR-Chain
caauccguccucacccaaccccccuccgucuccgccgcccccggccaaaaagucaccaucuccugcuccggcuccuccuccaacaucggcaacaacuacgucuccugguaccaacaccuccccggcaccgcccccaaacuccucaucuacgacaccuacucccgccccuccggcauccccgaccgcuucuccggcuccaaauccggcaccuccgccacccucgccaucaccggccuccaaaccggcgacgaagccgacuacuacugcggcaccugggacggcuccggcggcgucuucggcaccggcaccaaagucaccguccuc

SEQ ID NO: 55926 - RNA, 321 nt, Artificial Sequence
  derived and/or modified sequence opt11 from anti-HIV_119-057090_VR-Chain
caauccguccucacccaaccccccuccgucuccgccgcccccggccaaaccgucaccaucuccugcuccggcuccaccuccaacaucggcaaaaacgacgucuccugguaccaacaacuccccggcaccgcccccaaacuccucaucuccgaaaacaaccgccgccccuccggcacccccgaccgcuucuccgccuccaaauccggcaccuccgccacccucgccaucaccggccuccaaaccggcgacgaagccgacuacuucugcuccaccugguccggcucccucaacuucggcaccggcacccgcgucaccguccuc

SEQ ID NO: 55927 - RNA, 333 nt, Artificial Sequence
  derived and/or modified sequence opt11 from anti-HIV_119-055754_VR-Chain
caaucggucuugacccagcccccgagcgugagcgcggccccgggccagaaagugaccauaagcuguagcgggaacucaagcucgaucgggaacaauuucgugagcugguaccagcaauugcccgggaccgcgcccaagcucuuggucuaugaaaauuacaggcgcccgagcgggaucccggacagguucucgggcucgaaaucgggcacgagcgcgaccuuggccauagacgggcuccagaccugggacgaggccgauuaccauugcgcgaucuggggcgugcgcaagggcgugggcgcggucuuuggcacgggcacgaaagugaccgugguc

SEQ ID NO: 55928 - RNA, 324 nt, Artificial Sequence
  derived and/or modified sequence opt11 from anti-HIV_119-054899_VR-Chain
caauccguccucacccaaccccccuccgucuccgccgcccccggccaaaaagucaccaucuccugcuccggcuccaacuccuacaucggcaacaaauacgucuccugguaccaacaauuccccggcaccgcccccaaacuccucauccacgaaaacaaccgccgccccuccggcacccccgaccgauucuccggcuccaaauccggcaccuccgccacccucgccaucuccggccuccaaaccggcgacgaagccgacuacuacugcgaaaccugggacggcuccggcggcgucuucggcaccggcaccaaagucaccguccuc

SEQ ID NO: 55929 - RNA, 324 nt, Artificial Sequence
  derived and/or modified sequence opt11 from anti-HIV_119-054501_VR-Chain
caauccguccucacccaaccccccuccgucuccgccgcccccggccaaaaagucaccaucuccugcuccggcaccuccuccaacaucggcaacaacuacgucuccugguaccaacaccuacccggcaccgcccccaaacuacucaucuucgaaaccaacaaacgccccuccggcauccccgaccgcuucucagccuccaaauccggcaccuccgccacccuagccaucaccggccuccaaaccggcgacgaagccgacuacuacugcgaaaccugggacggcuccggcggcgucuucggccccggcacccgcgucaccguccuc

SEQ ID NO: 55930 - RNA, 324 nt, Artificial Sequence
  derived and/or modified sequence opt11 from anti-HIV_119-051867_VR-Chain
caauccguccucacccaaccccccuccgucuccgccgcccccggccaaaaagucaccaucuccugcucaggcaacuccuccaacaucggcaacaacuucaucuccugguaccaacaacuccccggcaccgcccccaaacuacucaucuacgaaaacgaccgccgccccuccggcacacccgaccgcuucuccggcuccaaauccggcaccuccgccacccucgccaucaccggccuccaaaccggcgacgaagccgacuacuacugcgaaaccugggacggcuccggcggcgucuucggcaccggcaccaaagucaccguccuc

SEQ ID NO: 55931 - RNA, 324 nt, Artificial Sequence
  derived and/or modified sequence opt11 from anti-HIV_119-051814_VR-Chain
caauccguccucacccaaccccccuccgucuccgccgcccccggccaaaaagucaccaucuccugcuccggcuccaacuccaacaucggcaacaaagacgucuccugguaccaacaaauccccgccaccgcccccaaacuccucaucuacgaaaacaacaaacgccccuccggcauccccgaccgcuucuccggcuccaaauccggcaccuccgccacccucgccaucaccggccuccaaaccggcgacgaagccgacuacuacugcgccaccugggacggccgcgucuccgucaucggcaccggcaccaacgucaucguccuc

SEQ ID NO: 55932 - RNA, 321 nt, Artificial Sequence
  derived and/or modified sequence opt11 from anti-HIV_119-051567_VR-Chain
caauccguccucacccaaccccccuccgucuccgccgcccccggccaaaaagucaccaucuacugcuccggcucccgcuccaacaucggccgcaacuacgccuccugguaccaacaacuccccggcaccgcccccaaacuccucaucuucgacaacaaccgacgccccuccggcauccccgaccgcuucuccggcgccaaauccggcaccuccgccacccucgccaucaccggccuccaaaccggcgacgaagccgacuacuucugcuccaccugguccggcucccucaacuucggcaccggcacccgcgucaccguccuc

SEQ ID NO: 55933 - RNA, 324 nt, Artificial Sequence
  derived and/or modified sequence opt11 from anti-HIV_119-051483_VR-Chain
caauccguccucacacaaccacccuccgucuccgccgcccccggccaaaaacucaccaucuccugcuccggcaccuccuccaacaucggcaacaacuacgucuccugguaccaacaccuccccggcaccgcccccaaacuccucaucuacgaaaacaaccgccgacccuccggcauccccgaacgcuucuccgccuccaaauccggcaccuccgccacccucggcauaaccggccuccaaaccggcgacgaagccgacuacuacugcgaaaccugggacgacuccggcggcgucuucggcaccggcaccaaagucaccguccuc

SEQ ID NO: 55934 - RNA, 333 nt, Artificial Sequence
  derived and/or modified sequence opt11 from anti-HIV_119-050913_VR-Chain
caaucaguacucacccaaccccccuccgucuccgccgcccccggccaaaaagucaccaucuccugcuccggcggcaccuccaacaucggcaacaacuacgucuccugguaccaacaacuccccggcaccgccccccgccuccucaucuacgaaaccaacaaacgccccuccggcauccccgaccgcuucuucggcuccaaauccggcaccuccgccacccucgccaucuccggccuccaaaccggcgacgaagccgacuacuacugcaccgucuggggcguccgcaaaggcgucggcgccgucuucggcaccggcaccaaagucaccguccuc

SEQ ID NO: 55935 - RNA, 333 nt, Artificial Sequence
  derived and/or modified sequence opt11 from anti-HIV_119-050187_VR-Chain
caauccguccucacccaaccccccucagucuccgccgcccccggccaaaaagucaccaucuccugcuccggcuccuccuccaacaucggcaaaaacuccgucuccugguaccaacaauuccccggcaccgcccccaaacuccucaucuacgaaaacaacaaacgccccuccggcauccccgaccgcuucuccgacucccaauccggcaccuccgccacccucgccaucaccggccuacaaaccggcgacgaagcagacuacuccugcgccaccugggccgccucccucaacuccgcccgcgucuucggcaccggcacccgcgucaccguccuc

SEQ ID NO: 55936 - RNA, 324 nt, Artificial Sequence
  derived and/or modified sequence opt11 from anti-HIV_119-049069_VR-Chain
cagagcgugcucacgcaaccgcccucggucucggccgcgcccgggcaaaaggucacgaucucgugcucgggcucgaccucgaacauaggcaagagcgaugucuuuugguaucaacagcucccgggcacggccccgaaauugcucauaagcgagaccucgcgcaggcccucgggcacgcccgaucgcuuuagcgggagcaagagcgggaccucggccacgcucacgaucacgggcuugcaaacgggcgaugaagcggacuauuacugugaagcgugggauggcucgggcggggucuuuggcacaggcacgaaagugaccgugcuc

SEQ ID NO: 55937 - RNA, 333 nt, Artificial Sequence
  derived and/or modified sequence opt11 from anti-HIV_119-048517_VR-Chain
caaucggucuugacccagcccccgagcgugagcgcggccccgggccagaaagugaccauaagcuguagcgggagcaaguucaauaucgggaacaaggacgugagcugguaccagcacucgcccgggaccgcgcccaagcucuugaucuaugaaaauaacaagcgcccgagcgggaucccggacagguucucgggcucgaaaucgggcacgagcgcgaccuugggcauaagcgggcuccagaccggggacgaggccgauuacuguugcgcggucuggggcgugcgcaggggcgcgggcgcggucuuuggcgcgggcacgaaagugaccgugcuc

SEQ ID NO: 55938 - RNA, 333 nt, Artificial Sequence
  derived and/or modified sequence opt11 from anti-HIV_119-048470_VR-Chain
caaucggucuugacccagcccccgagcgugagcgcggccccgggccagaaagugaccauaagcuguagcgggagcacgagcaauaucgggaaaaaucucgugagcugguaccagcaauuucccgggaccgcgcccaagcucuugaucuaugaaaauaacaggcgcccgagcgggaucccggacagguucucgggcucgaaaucgggcacgagcgcgaccuuggucauaaccgggcuccagaccggggacgaggcagauuucuauugcgggaccuggggcgggagcuugcgcgcgggcggagucauaggcacgggcacgcgcgugaccgugcuc

SEQ ID NO: 55939 - RNA, 282 nt, Artificial Sequence
  derived and/or modified sequence opt11 from anti-HIV_119-048303_VR-Chain
uccguccucacccaaccccccuccgucuccgccgcccccggccaaaacaucaccaucuccugcuccggcuccaucuccaacaucgccuccaacuucaucuccugguaccaacaacuccccggcaccgcccccaaaaucaucaucuacgacaacgaccaacgcccccucggcauccccgcccgcuucuccggcuccaaauccggcgccuccgccacccucgucaucaccggccuccaaaccggcgacgaagccgacuacuacugcggcaccugggacggcucc

SEQ ID NO: 55940 - RNA, 333 nt, Artificial Sequence
  derived and/or modified sequence opt11 from anti-HIV_119-048021_VR-Chain
caauccguccuaacccaaccccccucagucuccgccgcccccggccaaaaagucaccaucuccugcuccggcuccuccuccaacaucggcaacaacuacgucuccugguaccaacaacuccccggcaccgcccccaaacuccucaucuacgacaacaacaaacgccccuccggcauccccgaccgcuucuccggcuccaaauccggcaccuccgccacccucgucaucaccggccuccaaaccggcgacgaagccgacuucuacugcggcaccugggacggcucccuauccggcggcggcgucaucggcaccggcacccgcgucaccguccuc

SEQ ID NO: 55941 - RNA, 324 nt, Artificial Sequence
  derived and/or modified sequence opt11 from anti-HIV_119-047928_VR-Chain
caauccguccucacccaaccccccuccgucuccgccgcccccggccaaaaagucaccaucuccugcuccggcuccaacuccaacaucggcaacaacugcgucuccugguaccaacaaguccccggcaccgcccccaaacuccucaucuacgaaaacaaccgccgccccuccggcauccccgaccgcuucuccggcuccaaauccggcaccuccgccacccucgccaucuccggccuccaaaccggcgacgaagccgacuacuacugcggcaccugggacggcuccggcggcgucuucggcaccgccaccaaagucaccguccua

SEQ ID NO: 55942 - RNA, 324 nt, Artificial Sequence
  derived and/or modified sequence opt11 from anti-HIV_119-047384_VR-Chain
caauccguccucacccaaccccccuccgucuccgccgcccccggccaaaaagucaccaucuccugcuccggcuccaacuccaacaucggcaacaaagacgucuccugguaccgccaagucccccccaccgcccccaaacuccucaucuacgaaaacaacaaacgccccuccggcauccccgaccgcuucucaggcuccaaauccggcaccuccgccacccucgccaucaccggccuccaaaccggcgacgaagccgacuacuacugcgccaccugggacggccgcgucuccgucuucggcaccggcaccaaagucgccguccuc

SEQ ID NO: 55943 - RNA, 333 nt, Artificial Sequence
  derived and/or modified sequence opt11 from anti-HIV_119-047145_VR-Chain
caauccguccucacccaaccccccuccgucuccgccgcccccggccaaaccgucaacaucuccugcuccggcuccaacuccaacaucggcuccaaauacgucuccugguaccaacacuuccccggcaccgcccccaaacuccucaucuacgaaaacaacaaacgcuccuccggcauccccgaccgcuucuccggcuccaaauccgccaccuccgccacccucgccaucaccggccuccaaaccggcgacgaagccgacuacuacugcgccaccugggcccccucccucaacuccgcccgcgucuucggcaccggcaccaaagucaccguccuc

SEQ ID NO: 55944 - RNA, 333 nt, Artificial Sequence
  derived and/or modified sequence opt11 from anti-HIV_119-046752_VR-Chain
caauccguccucacccaaccccccuccgucuccgccgcccccggccaaaaagucaccaucuccugcuccggcaacuccuccucaaucggcaacaacuucgucuccugguaccaacaacuccccggcaccgcccccaaacuccucgucuacgaaaacuaccgccgccccuccggcaucuccgaccgcuucuccggcuccaaaucaggcaccuccgccacccucgccaucaccggccuccaaaccggcgacgaagccgacuacuacugcaccgucuggggcguccgcaaaggcgucggcgcagucuucggcaccggcaccaaagucaccguccuc

SEQ ID NO: 55945 - RNA, 324 nt, Artificial Sequence
  derived and/or modified sequence opt11 from anti-HIV_119-046660_VR-Chain
caaucaguccucacccaaccccccuccgucuccgccgcccccggccaaaaagucaccaucuccugcuccggauccuccuccaacaucggcaaccacuacgucuccugguaccaacaacuccccggcaccgcccccaaacuccucaucuacgacaacaacaaacgccccuccggcauccccgaccgcuucucagccuccaaauccggcaccuccgccacccucggcaucaccggccuccaaaccggcgacgaagccgacuacuacugcgccaccugggacggccgcgucuccgucaucggcaccggaaccaaagucaccgucguc

SEQ ID NO: 55946 - RNA, 333 nt, Artificial Sequence
  derived and/or modified sequence opt11 from anti-HIV_119-046202_VR-Chain
caauccguccucacccaaccccccucagucuccgccgcccccggccaaaaagucaccaucuccugcuccggcuccuccuccaacaucggcaacaacuacgucuccugguaccaacaacuccccggcaccgcccccaaacuccucgucuacgaaaacuaccgccgccccuccggcauccccgaccgcuucuccggcuccaaauccggcaccuccgccacccucgccaucaccggccuccaaaccggcgacgaagccgacuaccacugcgccaucuggggcguccgcaaaggcgucggcgccgucuucggcaccggcaccaaagucaccgucguc

SEQ ID NO: 55947 - RNA, 333 nt, Artificial Sequence
  derived and/or modified sequence opt11 from anti-HIV_119-045790_VR-Chain
caauccguccucacccaaccccccuccgucuccgcagcccccggccaaaaagucaccaucuccugcuccggcuccuccuccaacaucggcaacaacuacgucuccugguaccaauaccuccccggcaccgcccccaaacuccucuucuacgaagacaaccgacgccccuccggcacccccgaccgcuucuccggcuccaaauccggaacauccgccacccucgccauauccggccuccaaaccggcgacgaagccgacuacuacugcaccaucuggggcguccgcaaaggcgucggcgccgucuucggcaccggcaccaaagucaccguccua

SEQ ID NO: 55948 - RNA, 333 nt, Artificial Sequence
  derived and/or modified sequence opt11 from anti-HIV_119-044670_VR-Chain
caauccguccucacccaaccccccuccgucuccggcgcccccggcgaacgcgucaccaucuccugcaccggcaacaccuccaacaucggcaccuacgacguccaaugguaccaacaccuccccggcaccgccccccgacuccucaucuaccacaacgucaaccuccccuccggcguccccgaccgcuucuccgccuccaaauccggcaccuccgccacccucgccaucaccggccuccaaaccggcgacgaagccgacuacuacugcaccaucuggggcguacgcaaaggcgucggcgccgucuucggcaccggcaccaaagucaccguccuc

SEQ ID NO: 55949 - RNA, 321 nt, Artificial Sequence
  derived and/or modified sequence opt11 from anti-HIV_119-044140_VR-Chain
caauccguccucacccaaccccccuccgucuccgccgcccccggccaaaaagucaccaucuccugcuccggcggcaccuccaacaucggcaaccacuucgucuccugguaccgccaccuccccggcaccgcccccaaacuccucaucuacgaaaacaacaaccgccccuccggcauccccgaccgcuucuccggcgccaaauccggcaccuccgccacccucgccaucaccggccuccaaacaggcgacgaaggcgacuacuacugcgccaccugguccggcucccucaacaucggcaccggcaccaaagucaccguccuc

SEQ ID NO: 55950 - RNA, 333 nt, Artificial Sequence
  derived and/or modified sequence opt11 from anti-HIV_119-042776_VR-Chain
caauccguccucacccaaccccccuccgucuccgccgcccccggccaaaaagucacaaucuccugcuccggcuccucauccaacaucggcaacaacuacgucuccugguaccaacaccuccccggcaccgcccccaaacuccucaucuacgaauccgcccgccgccccuccggcacccccgaccgcuucuccggcuccaaauccggcaccuccgccacccucgcaaucaccggccuccaaaccggcgacgaagccgacuacuacugcacccucuggggcguccgcaaaggagucggcgccgucuucggcaccggcacccgcgucaccguccuc

SEQ ID NO: 55951 - RNA, 333 nt, Artificial Sequence
  derived and/or modified sequence opt11 from anti-HIV_119-042581_VR-Chain
caauccguccucacccaaccccccuccgucuccgccgcccccggccaaaaagucaccaucuccugcuccggcuccuccuccaacaucggcaacaacuucgucuccugguaccaacaacuacccggaaccgcccccaaacuccucaucuucgaaacccaccgccgccccuccggcauccccgaccgcuucuccggcuccaaauccggcaccuccgccacccucgccaucaccggccuccaauccggcgacgaagccgacuacuacugcgccgucuggggcguccgccaaggcgccggcgccgucuucggcaccggcaccaaagucaccguccuc

SEQ ID NO: 55952 - RNA, 333 nt, Artificial Sequence
  derived and/or modified sequence opt11 from anti-HIV_119-040905_VR-Chain
caauccguccucacccaaccccccuccgucuccgccgcccccggccaaaaagucaccaucuccugcuccggcaacuccuccaacaucggcgacaacuucgucuccugguaccaacaacuccccggaaucgcccccaaacuccucgucuacgaaaccaacaaacgccccuccggcauccccgaccgcuucgccggcuccaaauccggcaccucagccacccucgucaucaccggccuccaaaccggcgacgaagccgacuucuacugcggcaccugggacggaucccuccgcaccggcggcgucaucggcaccggcacccgcgucaccguccuc

SEQ ID NO: 55953 - RNA, 321 nt, Artificial Sequence
  derived and/or modified sequence opt11 from anti-HIV_119-040322_VR-Chain
caauccguccucacccaaccccccuccgucuccgccgcccccggccaaaaagucgucaucuccugcuccggcuccuccuccaucaucgaaaaaaacuccaucuccugguaccaacaaggccccggcgccgcccccaaacuacucaucuacgaaaacgacaaacgccccuccggcauccccgaccgcuucucaggcuccaaauccggcaccaccggcacccucgccaucaccggccuccaaaccggcgacgaagccgacuacuucugcgccaccugguccggccgccucaacaucggcaccggcaccaaagucaccguccuc

SEQ ID NO: 55954 - RNA, 324 nt, Artificial Sequence
  derived and/or modified sequence opt11 from anti-HIV_119-039892_VR-Chain
caauccguccucacccaaccccccuccgucuccgccgcccccggccaaaaagucaccaucucaugcuccggcuccaacgccaacaucggcaacaaagacgucuccugguaccaacaacuccccgccaccgcccccaaacuccucaucuacgaauccaacaaacgccccuccggcauccccgaccgcuucuccggcuccaaauccggcaccuccgccacccucgccaucaccggccuccaaaccggcgacgaagccgacuacuacugcgccaccugggacggccgcgucuccggaaucggcaccggcaccaaagucaccguccuc

SEQ ID NO: 55955 - RNA, 324 nt, Artificial Sequence
  derived and/or modified sequence opt11 from anti-HIV_119-039764_VR-Chain
caauccguccucacccaaccccccuccgucuccgccgcccccggccaaaaagucaccaucuccugcuccggcuccgccuccaacaucggcaaaaacuucgucuccugguaccaacaaguccccggcaccgcccccaaacuccucaucuacgaaaacaaccgccgccccuccggcacccccgacagauucuccggcuccaaauccggcaccuccggcacccucgccaucuccggccuccaaaccggcgacgaagccgacuacuacugcgaaaccugggacggcucaggcggcgucuucggcaccggcaccaaagucaccguccuc

SEQ ID NO: 55956 - RNA, 333 nt, Artificial Sequence
  derived and/or modified sequence opt11 from anti-HIV_119-039188_VR-Chain
caaucggucuugacccagcccccgagcuuaagcggggccccgggccagaccgugaccauaagcuguagcgggagcucgagcaauaucgggaacaauuacgugagcugguaccagcaauuacccgggaccgcgcccaagcuccugaucuaugacucgaacaggcgcccgagcgggaucccggacagauucucaggcucgaaaucgggcacgagcgcgaccuuggccauaagcgggcuccagaccggggacgaggccgauuacuguugcgcggucuggggcgugcgcaggggcgcgggcgcggucuuuggcgcgggcacgaaagugaccgugcuc

SEQ ID NO: 55957 - RNA, 321 nt, Artificial Sequence
  derived and/or modified sequence opt11 from anti-HIV_119-039058_VR-Chain
caauccguccucacccaaccccccuccgucuccggcgcccccggccaacgcgucaccaucuccugcaccggcuccuccuccaacaucggcaacaacuacgucuccugguaccgccgccuccccggcaccgcccccaaacuccucaucuacgaaaacaacaaacgccccuccggcauccccgaccgcuucuccggcgccaaaucaggcaccuccgccacccucgccaucaccggccuccaaaccggcgacgaagccgacuacuucugcuccaccugguccggcucccucaacuucggcaccggcacccgcgucaccguccuc

SEQ ID NO: 55958 - RNA, 321 nt, Artificial Sequence
  derived and/or modified sequence opt11 from anti-HIV_119-038837_VR-Chain
caauccguccucacccaaccccccuccgucuccgccgcccccggccaaaaagucaccaucuccugcuccggcggcaccuccaacaucggcaacaacuucgucuccugguaccaacaccuccccggcaccgcccccaaacuccucaucuucgaaaacaacaaacgccccuccggcguccccgaccgcuucuccggcgccaaauccggcaccuccgccacccucgccaucaccggccuccaaaccggcgacgaaggcgacuacuacugcgccaccugguccggcucccucaacaucggaaccggcaccaaagucaccguccuc

SEQ ID NO: 55959 - RNA, 321 nt, Artificial Sequence
  derived and/or modified sequence opt11 from anti-HIV_119-038396_VR-Chain
caauccguccucacccaaccccccuccgucuccgccacccccggccaaaaagucaccaucuccugcuccggcuccaacuccaacaucggcaacaaauacgucuccugguaccaacucuuccccggaaccgcccccaaacuccucaucuccgaaaacaaccgccgccccuccggcacccccgaccgcuucuccggcuccaaauccggcaccuccgccacccucgccaucaccggccuccaaaccggcgacgaagccgacuacuacugcgccaccugguccggcucccucaacaucggcaccggcaccaaagucaccguccuc

SEQ ID NO: 55960 - RNA, 321 nt, Artificial Sequence
  derived and/or modified sequence opt11 from anti-HIV_119-036918_VR-Chain
caauccguccucacccaaccccccuccgucuccgccgcccccggccaaaaagucaccaucuccugcuccggcgccaccuccaacaucugggaccacuacgucuccugguaccuccaaguccccggcaccgccccccgccuccucaucuacgacaacgacaaacgccccuccggcauccccgaccgcuucuccggcuccaaauccggcaccuccgccacccucgccaucaccggccuccaaaccggcgacgaaggcgacuacuacugcgccaccugguccggcucacucaacaucggcaccggcaccaaagucaccguccuc

SEQ ID NO: 55961 - RNA, 324 nt, Artificial Sequence
  derived and/or modified sequence opt11 from anti-HIV_119-036592_VR-Chain
caauccguccucacccaaccccccuccgucuccgccgcccccggccaaaaagucaccaucucaugcuccggcuccaacuccaacaccggcaacaaagacgucuccugguaccaacaaguccccgccaccgcccccaaacuccucaucuacgaauccaacaaacgccccuccggcauccccgacagauucuccggcuccaaauccggcaccuccgccacccuagccaucaccggccuccaaaccggcgacgaagccgacuacuacugcgccaucugggacggccgcgucuccgucaucggcaccggcaccaaagucaccguccuc

SEQ ID NO: 55962 - RNA, 324 nt, Artificial Sequence
  derived and/or modified sequence opt11 from anti-HIV_119-036310_VR-Chain
caauccguccucacccaaccccccucagucuccgccgcccccggccaaaaagucaccaucuccugcuccggcuccaccuccaacaucggccaaaacuacgucuccugguaccaacaacuccccggcaccgcccccaaacuccucaucuacgaaaacaaccgccgacccuccggcucccccgaccgcuucuccggcuccaaauccggcaccuccgccacccucgccaucaccggccuccaaaccggcgacgaagccgacuacuacugcgaaaccugggacggcuccggcggcgucuucggcaccggcaccaaagucaccguccuc

SEQ ID NO: 55963 - RNA, 333 nt, Artificial Sequence
  derived and/or modified sequence opt11 from anti-HIV_119-035618_VR-Chain
caauccguccucacccaaccccccuccgucuccgccgcccccggccaaaaagucaccaucuccugcuccggcuccuccuucaccaucggcaacaaccacgucuccugguaccaacaacuccccggcaccgcccccaaacuccucaucuucgaaucccacaaacgccccuccggaguccccgaccgcuucuccggcuccaaaucaggcaccuccgccacccucgccaucaccggccuccaaaccggcgacgaagccgacuacuacugcaccgucuggggcguccgcaaaggcgucggcgccgucuucggcaccggcaccaaagucaccguccuc

SEQ ID NO: 55964 - RNA, 321 nt, Artificial Sequence
  derived and/or modified sequence opt11 from anti-HIV_119-035569_VR-Chain
caaucaguccucacccaaccccccuccgucuccggcgcccccggccaaaccgucaccaucuccugcaccggcuccuccuccaacaucggcggcuacgacguccacugguaccaacaacuccccggcaccgcccccaaacuccucaucuacgaaaacaaccgccgccccuccggcacccccgaccgcuucuccggcgccaaauccggcaccuccgccacccucgccaucaccggccuccaaaccggcgacgaaggcgacuacuacugcgccaccugguccggcucccucaacaucggcaccggcaccaaagucaccguccuc

SEQ ID NO: 55965 - RNA, 324 nt, Artificial Sequence
  derived and/or modified sequence opt11 from anti-HIV_119-035466_VR-Chain
caauccguccucacccaaccccccuccgucuccgccgccgccggccaaaacgucaacaucuccugcuccggcaaaaaauccaacaucggcaacaacuacgucuccugguaccaacaauuccccggcaccgcccccaaacuccucauauacggcaacaccaaccgccccuccggcauccccgaccgcuucuccggcuccaaaucaggcaccuccgccacccucgccaucaccggccuccaaaccggcgacgacgccgacuacuacugcgaaaccugggacggcuccggcggcgucuucggcaccggcaccaaagucaccguccuc

SEQ ID NO: 55966 - RNA, 333 nt, Artificial Sequence
  derived and/or modified sequence opt11 from anti-HIV_119-035157_VR-Chain
caauccguccucacccaaccccccuccgucuccgccgcccccggccaaaaagucaccaucuccugcuccggcuccuccuccaacaucggcaacaacuucgucuccugguaccaacaacgccccggcaccgcccccaaacuacucaucuacgaaaccaacaaacgccccucaggcauccccgaccgcuucuccggcuccaaauccggcacauccgccacccucgccaucaccggccuccaaaccggcgacgaagccgacuacuacugcgccaccugggccccccgccucaacuccgcccgcgucuucggcaacggcaccauggucaccguccuc

SEQ ID NO: 55967 - RNA, 333 nt, Artificial Sequence
  derived and/or modified sequence opt11 from anti-HIV_119-035121_VR-Chain
caauccguccucacccaaccccccuccgucuccgccgcccccggccaaaaagucaccaucuccugcuccggcuccaccuccuacaucggcaacaaauacgucuccugguaccaacaauuccccggcgccgcccccaaacuccucaucuacgaaaacaacaaacgccccuccggcauccccgaccgcuucuccgccuccaaauccgccaccuccgccacccuagccaucaccggccuccaaaccggcgacgaagccgacuacugcugcgccgucuggggcguccgccgcggcgccggcgccgucuucggcgccggcaccaaagucaccguccuc

SEQ ID NO: 55968 - RNA, 324 nt, Artificial Sequence
  derived and/or modified sequence opt11 from anti-HIV_119-035046_VR-Chain
caauccgcccucacccaacccgccuccgucuccggcucccccggccaauccaucaccaucuccugcaccggcaccuccuccgacgucggcuacgacuacgucuccugguaccgccaaguccccgccaccacccccaaacuccucaucuacgaaaacaacaaacgccccuccggcauccccgaccgcuucuccggcuccaaauccggcaccuccgccacccucgccaucaccggccuccaaaccggcgacgaagccgacuacuacugcgccaccugggacggccgcgucuccgucaucggcaccggcaccaaagucaccgucguc

SEQ ID NO: 55969 - RNA, 324 nt, Artificial Sequence
  derived and/or modified sequence opt11 from anti-HIV_119-034754_VR-Chain
caauccguccucacccaaccccccuccgucuccgccgcccccggcgaaaaagucaccaucuccugcuccggcuccuccuccaacaucggcaacaacuacgucuccugguaccaacaacuccccggcaccguccccaaacuccucaucuacgacaacaacaaacgccccuccggcacccccgaccgcuucucaggcuccaaauccggcaccuccgccacccucgccaucaccggccuccaaaccggcgacgaagccgacuacuacugcgaaaccugggacggcuccggcggcgucuucggcaccggcaccaaagucaccguccuc

SEQ ID NO: 55970 - RNA, 324 nt, Artificial Sequence
  derived and/or modified sequence opt11 from anti-HIV_119-034318_VR-Chain
cagagcgugcucacgcaaccgcccucggucucggccgcgcccgggcaaaagaucacgaucucgugcucgggcucgagcucgaacauaggcaauaacgaugucucgugguaucaacagcucccgggcacggccccgaaacugcucauauacgagaacgaucgcaggcccucgggcacgcccgaucgcuuuagcgggagcaagagcgggaccucggccacgcucgcgaucacgggcuugcaaacgggcgaugaagcggacuauuacugugaaacgugggauggcucgggcggggucuuuggcacaggcacgaaagugaccgugcuc

SEQ ID NO: 55971 - RNA, 333 nt, Artificial Sequence
  derived and/or modified sequence opt11 from anti-HIV_119-033780_VR-Chain
caauccguccucacccaaccccccuccgucuccgcagcccccggccaacgcgucaccaucuccugcuccggcaccuccuccaacaucggcgaaaacuacgucuccugguaccaacaaauccccggcaccgcccccaaacuccucaucuacgaaaacaacaaacgacccuccggcauccccgaccgauucuccggcucaaaauccggcaccuccgccacccuagucaucaccggccuccaaaccggcgacgaagccgacuucuacugcggcaccuggggcggcucccuccgcacaggcggaguccucggcaccggcacccgcgucaccguccuc

SEQ ID NO: 55972 - RNA, 333 nt, Artificial Sequence
  derived and/or modified sequence opt11 from anti-HIV_119-033632_VR-Chain
caaucggucuuaacccagcccccgagcgugagcgcggccccgggccagcgcgugaccauaagcuguagcgggggcucgagcaauaucgggagcaauuacgugagcugguaccagcaauugcccgggaccgcgcccaagcucuugaucuaucaaaauaacaagcgcccgagcgggaucccggacagauucucgggcucgaaaucgggcacgagcgcgaccuugggcauaaccgggcuccagaccggggacgaggccgauuacuauugcacggucuggggcgugcgcaagggcgugggcgcggucuuuggcacgggcacgaaagugaccgugcuc

SEQ ID NO: 55973 - RNA, 333 nt, Artificial Sequence
  derived and/or modified sequence opt11 from anti-HIV_119-033183_VR-Chain
caaucaguccugacccagcccccgagcguaagcgcggccccgggccagauggugaccauaagcugcagcggaggcgcaagcaaccucgggaaaaacagcguaagcugguaccaacaacugcccggaaccgcgcccaaacuccugaucuacgaagacaacagacgcccgagcgggaccccggacagguucucaggcucacgcucgggcacaagcgcaacccuggccauaaccggacuccagaccggagacgaggccgacuacuacugcacaaucuggggcguacgcaaaggcguaggcgcagucuucggcacaggcacaaaaguaaccgugcuc

SEQ ID NO: 55974 - RNA, 333 nt, Artificial Sequence
  derived and/or modified sequence opt11 from anti-HIV_119-030696_VR-Chain
caauccguccuaacccaaccacccuccgucuccggcgcccccggccaaaucgucacccucuccugcaccggcgccaugaccaacaucggcaacaacgacguccacugguaccaacaccuccccggcaccggccccaaacuccucaucuacgaaaacaacaaacgccccuccggcauccccgaccgauucuccggcucaaaauccggcacauccgccacccucgucaucacaggccuccaaaccggcgacgaagccgacuucuacugcggcaccugggacggcucccuccgcaccggcggcgucaucggcaccggcacccgcgucaccguccuc

SEQ ID NO: 55975 - RNA, 324 nt, Artificial Sequence
  derived and/or modified sequence opt11 from anti-HIV_119-030059_VR-Chain
caauccguccucacccaaccccccuccgucuccgccgcccccggccaaaaagucgucaucuccugcuccggcuccuccuccaucaucgaaaaaaacuccaucuccugguaccaacaaggccccggcgccgcccccaaacuccucaucuacgaaaacgacaaacgccccuccggcaucucagaccgcuucuccggcuccaaauccgccaccuccgccacccucgccaucaccggccuccacaccggcgacgaagccgacuacuacugcgaaaccugggacggcucaggcggcgucuucggcaccggcaccaaagucaccguccuc

SEQ ID NO: 55976 - RNA, 333 nt, Artificial Sequence
  derived and/or modified sequence opt11 from anti-HIV_119-029589_VR-Chain
caauccguccucacccaaccccccuccgucuccgccgcccccggccaaaaagucaccaucuccugcuccggcaccuccucaaacaucggcaacaacuucgucuccugguaccaacuccuccccggcaccgccccccgccuccucaucuacgacaacaacaaacgccccuccggcacccccgaccgcuucuccggcuccaaauccggcaccuccgccacccucggcaucaccggccuccaaaccggcgacgaagccgacuucuacugcggcaccugggacggcucccuccgcaccggcggcgucaucggcaccggcacccgcgucaccguccuc

SEQ ID NO: 55977 - RNA, 324 nt, Artificial Sequence
  derived and/or modified sequence opt11 from anti-HIV_119-029448_VR-Chain
caauccguccucacccaaccccccuccgucuccgccgcccccggccaaaaagucaccaucuccugcuccggcaacuccuccaacaucggcaaaaacuccgucuccugguaccaccaacuccccggcaccgcccccaaacuccucaucuacgaaaacgaccgccgccccuccggcacccccgaccgcuucuccggcucaaaauccggcaccuccgccacccucgccaucaccggccuccaaaccggcgacgaagccgacuacuacugcgaaaccugggacggcuccggcggcgucuucggcaccggcaccaaagucaccguccuc

SEQ ID NO: 55978 - RNA, 333 nt, Artificial Sequence
  derived and/or modified sequence opt11 from anti-HIV_119-029220_VR-Chain
caauccguccucacccaaccccccuccgucuccgccgcccccggccaaaaagucaccaucuccugcuccggcuccaccuccaacaucggccaaaacuacgucuccugguaccaacaacuccccggcaccgcccccaaacuccucaucuacgaaaacgaccgccgccccuccggcauccccgaccgcuucuccggcuccaaaucaggcaccuccgccacccucgccaucuccggccuccaaaccggcgacgaagccgacuacugcugcgccgucuggggcguccgccgcggcgccggagccgucuucggccccggcaccaaagucaccguccuc

SEQ ID NO: 55979 - RNA, 333 nt, Artificial Sequence
  derived and/or modified sequence opt11 from anti-HIV_119-028317_VR-Chain
caauccguccucacccaaccccccuccgucuccgccgcccccggccaaaaagucaccaucuccugcuccggcuccuccuccaacaucggcaacgacuacgucuccugguaccaacaacuccccggcaccgcccccaaacuccucaucuacgaaaacaacaaacgccccuccggcauccccgaccgauucuccggcuccaaauccggcaccuccgccacccucgccaucaccggccuccaaaccggcgacgaagccgacuacuacugcaccaucuggggcguccgcaaaggcgucggcgccgucuucggcaccggcaccaaagucaccguccuc

SEQ ID NO: 55980 - RNA, 324 nt, Artificial Sequence
  derived and/or modified sequence opt11 from anti-HIV_119-028165_VR-Chain
caauccguccucacccaaccccccuccgucuccgccgcccccggccaaaccgucaccaucuccugcuccggcaucaccuccaacaucggcaaaaacgacgucuccugguaccaacaacuccccggcaccgcccccaaacuccucaucuccgaaaacaaccgccgccccuccggcauccccgaccgcuucuccggcuccaaauccggcaccuccgccacccucgccaucaccggccuccaaaccggcgacgaagccgacuacuacugcgccaucugggacggccgcgucuccgucaucggcaccggcaccaaagucaccguccuc

SEQ ID NO: 55981 - RNA, 324 nt, Artificial Sequence
  derived and/or modified sequence opt11 from anti-HIV_119-027147_VR-Chain
caauccguccucacccaaccccccuccgucuccgccgcccccggccaaaccgucaccaucuccugcuccggcuccaccuccgacaucggcaaaaacgacgucuccugguaccaacaacuccccggcaucgcccccaaacuccucaucuccgaaaacaaccgccgacccuccggcacccccgaccgcuucuccggcuccaaauccggcaccuccgccacccucgccaucaccggccuccaaaccggcgacgaagccgacuacuacugcgaaaccugggacggcuccggcgccgucuucggcaccggcaccaaagucaccguccuc

SEQ ID NO: 55982 - RNA, 333 nt, Artificial Sequence
  derived and/or modified sequence opt11 from anti-HIV_119-026743_VR-Chain
caauccguccucacccaaccccccuccgucuccgccgcccccggccaaaacgucaccaucuccugcuccggcuccuccuccaacaucggcaacaacuucgucuccugguaccaacaacgccccggcaccggccccaaacuccucaucuacgaaaccaaccgccgccccuccggcauccccgaccgcuucuccggcuccaaauccggcaccuccgccacccucgccaucaccggccuccaaaccggcgacgaagccgacuacuacugcgccaccugggcccccucccucaacuccgcccgcgucuucggcaccggcaccaaagucaccguccuc

SEQ ID NO: 55983 - RNA, 333 nt, Artificial Sequence
  derived and/or modified sequence opt11 from anti-HIV_119-026508_VR-Chain
caauccguccucacccaaccacccuccgucuccgccgcccccggccaaaaagucaccaucuccugcuccggcuccuccuccaccaucggcaacaacuacaucuccugguaccaaguccuccccggcaccgcccccaaacucgucaucuucaaaaacaacgaacgccccucccgcguccccgaccgcuucuccggcuccaaauccggcaccuccgccacccucggcaucaccggccuccaacucggcgacgaaggcgacuacuacugcggcaccugggaaaccucccucuccggcggcggagucuucggcaccggcaccaaagucaccguccuc

SEQ ID NO: 55984 - RNA, 324 nt, Artificial Sequence
  derived and/or modified sequence opt11 from anti-HIV_119-025683_VR-Chain
caauccguccucacccaaccccccuccgucuccgccgcccccggccaaaaagucaccaucuccugcuccggcuccuccuccaacaucggcaacaacuacgucuccugguaccaacaacuccccggcaccgcccccaaacuccucaucuacgaaaacaacaaacgccccuccggcauccccgaccgcuucuccgacucccaauccggcaccuccgccacccucgccaucaccggccuccaaaccggagacgaagccgacuacuacugcgaaaccugggacggcuccggcggcgucuucggcaccggcaccaaagucaccguccuc

SEQ ID NO: 55985 - RNA, 333 nt, Artificial Sequence
  derived and/or modified sequence opt11 from anti-HIV_119-025614_VR-Chain
caaucgcucuugacccagcccccgagcgugagcgcggccccgggccagaacgugaucauaagcuguagcgggagcucgagcaauaucgggaaaaauuacguggccugguaccagcaagugcccgggaccgcgcccaagaucguggucuuugaaacgaccaaucgcccgagcgggaucccggacagguucucgggcucgaaaucgggcacgagcgcaaccuuggccauaaccgggcuccagaccggggacgaggccgauuacuauugcacggucuggggcgugcgaaagggcgugggcgcagucuuuggcacgggcacgaaagugaccgugcuc

SEQ ID NO: 55986 - RNA, 324 nt, Artificial Sequence
  derived and/or modified sequence opt11 from anti-HIV_119-025548_VR-Chain
caauccauccucacccaaccccccuccgucuccgccgcccccggccaaaaagucaccaucuccugcuccggcuccuccuccaacaucggcaacaacuacgucuccugguaccaacacguccccggcaccgcccccaaacuccucaucuacgaaaacaaccgccgccccuccggcacccccgaccgcuucuccggcuccaaauccggcaccuccgccacccucgccaucaccggccuccaauccggcgacgaagccgacuacuacugcggcaccugggacggcuccggcggcgucuucggcaccggcaccaaagucaccguccuc

SEQ ID NO: 55987 - RNA, 333 nt, Artificial Sequence
  derived and/or modified sequence opt11 from anti-HIV_119-025526_VR-Chain
caaucggucuugacccagcccccgagcgugagcgcggccccgggccagaaagugaccauaagcuguagcgggagcgcgagcaauaucgggaaaaauuucguaagcugguaccagcaauugcccgggaccgcgcccaagcuccuaaucuaugaaaauaacagacgcccgagcgggaccccggacagguucucgggcucgaaaucgggcacgagcgcgaccuuggccauaaccgggcuccagaccggggacgaggccgauuacuauugcacggucuggggcgugcgcaagggcgugggcgcagucuuuggcacaggcacgaaagugaccguacuc

SEQ ID NO: 55988 - RNA, 324 nt, Artificial Sequence
  derived and/or modified sequence opt11 from anti-HIV_119-023552_VR-Chain
caauccguccucacccaaccacccuccgucuccgccgcccccggccaaaccgucaccaucuccugcuccggcuccaccucaaacaucggcaaaaacgacgucuccugguaccaacaacuacccggcaccgcccccaaacuccucaucuccgaaaacaaccgccgccccuccggcacccccgaccgcuucuccgccuccaaauccggcaccuccgccacccucgccaucaccggccuccaaaccggcgacgaagccgacuacuacugcgaaaccuggcacggcuccggcggcgucuucggcaccggcaccaaagucaccguccuc

SEQ ID NO: 55989 - RNA, 321 nt, Artificial Sequence
  derived and/or modified sequence opt11 from anti-HIV_119-023092_VR-Chain
caauccguccucacccaaccccccuccgucuccgccgcccccggccaaaaagucaccaucuccugcuccggcuccaccuccgaccucggccaaacccgcgucucaugguaccaacaacucccccgcuccgcccccgaacuccucaucuucgaaaacaaccgccgccccucaggcauccccgaccgcuucuccggcgccaaaucaggcaccuccgccacccuagccaucaccggccuccaaaccggcgacgaagccgacuacuucugcuccaccugguccggcucccucaacuucggcaccggcacccgcgucaccguccuc

SEQ ID NO: 55990 - RNA, 324 nt, Artificial Sequence
  derived and/or modified sequence opt11 from anti-HIV_119-022793_VR-Chain
caaucaguccugacccagcccccaagcguaagcgcagccccaggccaaaaaguaaccauaagcugcagcggaggcacaagcaacaucggaaacaacuacguaagcugguacagacgccugcccggaaccgcgcccaaacuccugaucuacgaaaacaacaaacgcccgagcggaaucccggacagauucucaggcgcaaaaucaggcacaagcgcaacccuaggcauaaccggacuccagaccggagacgaagccgacuacuacugcgaaaccugggacgacagcggaggcguauucggaaccggaaccaaagucacaguccua

SEQ ID NO: 55991 - RNA, 324 nt, Artificial Sequence
  derived and/or modified sequence opt11 from anti-HIV_119-022395_VR-Chain
caauccguccucacccaaccccccuccgucuccgccgcccccggccaaaccgucaccaucuccugcuccggcucaaccuccaacaucggcaaaaacgacgucuccugguaccaacaacuccccggcaccgcccccaaacuccucaucuccgacaacaaccgccgccccuccuggacccccgaccgcuucuccggcuccaaauccggcaccuccgccacccucgccaucaccggccuccaaaccggcgacgaagccgacuacuacugcgaaaccugggacggcuccggcggcgucuucggccccggcacccgcgucaccguccuc

SEQ ID NO: 55992 - RNA, 333 nt, Artificial Sequence
  derived and/or modified sequence opt11 from anti-HIV_119-022334_VR-Chain
caauccguccucacccaaccccccuccgucuccgccgcccccggccaaaacgucaacaucuccugcuccggcggcucauccaacaucggcuccaacuacgucuccugguaccaacaauuccccggcaccgcccccaaacaccucaucuacgaaaacaacaaacgccccuccggcauccccgaccgcuucuccgacucccaauccggcaccuccgccacccucggcaucaccggccuccaaaccggcgacgaagccgacuacuacugcggcaccugggacggcucccuccgcaccggcggcgucaucggcaccggcacacgcgucaccguccuc

SEQ ID NO: 55993 - RNA, 321 nt, Artificial Sequence
  derived and/or modified sequence opt11 from anti-HIV_119-021866_VR-Chain
caauccguccucacccaaccccccuccgucuccgccgcccccggccaacgcgucaccaucuccugcuccggcuccgccuccaacaucggcaaaaacuucgucuccugguaccaacaacuccccggcaaagcccccaaacucaucaucuacgaagucaccaaacgccccuccggcguccccgcccgcuucuccggcuccaaauccggcaccuccgccacccucgccaucaccggccuccaaaccggcgacgaagccgacuacuucugcuccaccugguccggcucccucaacuucggcaccggcacccgcgucaccguccuc

SEQ ID NO: 55994 - RNA, 324 nt, Artificial Sequence
  derived and/or modified sequence opt11 from anti-HIV_119-021278_VR-Chain
caauccguccucacccaaccccccuccgucuccgccgcccccggccaaaaagucaccaucuccugcuccggcuccgccuccaacaucggcaaaaacuucgucuccugguaccaacaacuccccggcaccgcccccaaacuccucaucuacgaaaacaaccgccgacccuccggcacccccgaccgcuucuccggcucccgauccggcaccuccgccacccucggcaucaccggccuacaaaccggcgacgaagcccacuacuacugcgaaaccugggacgacuccggcggcgucuucggcaccggcaccaaagucaccguacuc

SEQ ID NO: 55995 - RNA, 333 nt, Artificial Sequence
  derived and/or modified sequence opt11 from anti-HIV_119-021183_VR-Chain
caauccguccucacccaaccccccuccgucuccgccgcacccggccaaaaagucaccaucuccugcuccggcaacuccuccaacaucggcaacaacuucgucuccugguaccaacaauuccccggcaccgcccccaaacuccucgucuucgaaacccaccgccgccccuccggcauccccgaccgcuucuccggcuccaaauccggcaccuccgccacccucgccaucaccggccuccaaaccggcgacgaagccgacuacuacugcgccgucuggggcguccgccgcggcgucggcgccgucuucggcgccggcaccaaagucaccguccuc

SEQ ID NO: 55996 - RNA, 333 nt, Artificial Sequence
  derived and/or modified sequence opt11 from anti-HIV_119-019376_VR-Chain
caaucggucuugacccagcccccgagcgugagcgcggccccgggccagaaagugaccauaagcuguagcgggagcucgagcaauaucgggaacaauuacgugagcugguaccagcaagugcccgggaccgcgcccaagcucuuggucuaugaaacguacaggcgcccgagcgggaucccggacagguucucgggcucgaaaucgggcacgagcgcgaccuuggccauaaccgggcuccagaccggggacgaggccgauuacuauugcacgaucuggggcgugcgcaagggcgugggcgcggucuuuggcacgggcacgaaagugaccgugcuc

SEQ ID NO: 55997 - RNA, 321 nt, Artificial Sequence
  derived and/or modified sequence opt11 from anti-HIV_119-019238_VR-Chain
caauccguccucacccaaccccccuccgucuccgccgcccccggccaaaaagucaccaucuccugcuccggcaccucauccaacaucggcaacaaccacgucuccugguaccaacaaguccccggcaccgcccccaaacuccucaucuacgaaaacaacaaacgccccuccggcauccccgcccgcuucuccgccgccaaauccggcaccuccgccacccucgccaucaccggacuccaaaccggcgacgaagccgacuacuucugcgccaccugguccggccgccucaacaucggcaccggcaccaaagucaccguccuc

SEQ ID NO: 55998 - RNA, 333 nt, Artificial Sequence
  derived and/or modified sequence opt11 from anti-HIV_119-018500_VR-Chain
caauccguccucacccaaccccccuccgucuccgccgcccccggccaaaaagucaacaucuccugcuccggcuccuccuccaacaucggcaacaacuucgucuccugguaccaacaaagacccggcaccgcccccaaacuacucaucuacgaaaccaaccgccgccccuccggcauccccgaccgcuucucaggcuccaaauccggcaccuccgccacccucgccaucaccggccuccaaaccggcgacgaagccgacuacuacugcgccaccugggccgccucccuaaccuccgcccgcgucuucggcaucggcaccaaagucaccguccuc

SEQ ID NO: 55999 - RNA, 324 nt, Artificial Sequence
  derived and/or modified sequence opt11 from anti-HIV_119-018318_VR-Chain
caauccguccuaacccaaccccccucagucucagccgcccccggccaaaccgucaucaucuccugcuccggcucaaccuccaacaucggcaaaaacgacgucuccugguaccaacaacuccccggcaccgcccccaaacuccucaucuccgaaaacaaccgccgccccuccggcacccccgaccgcuucuccggcuccaaauccggcaccuccgccacccucgccaucaccggccuccaaaccggcgacgacgccgacuacuacugcgaaaccugggacggcuccggcggcgucuucggcaccggcaccaaagucacccucguc

SEQ ID NO: 56000 - RNA, 333 nt, Artificial Sequence
  derived and/or modified sequence opt11 from anti-HIV_119-018218_VR-Chain
caaucaguccucacccaaccccccuccgucuccgccgcccccggccaaaaagucaccaucuccugcuccggcaacucauccaacaucggcaacaacuucgucuccugguaccaacaacuccccggcaccgcccccaaacuccucaucuacgaaaacaaccgccgccccuccggcauccccgaccgcuucuccggcuccaaauccggcaccuccgccacccucgccaucuccggccuccaaaccggcgacgaagccgacuacuggugcgccgucuggggcguccgccgcggcgccggcgccgucuucggcgccggcaccaaagucaccguccuc

SEQ ID NO: 56001 - RNA, 324 nt, Artificial Sequence
  derived and/or modified sequence opt11 from anti-HIV_119-017876_VR-Chain
caauccguccucacccaaccccccuccgucucagccgcccccggccaaaaagucaccaucuccugcuccggcuccaccuccaaaaucggccaaaacuccgucuccugguaccaacaacuccccggcaccgcccccaaacuccucaucuacgaaaacgaccgccgccccuccggcacccccgaccgcuucuccgccuccaaauccggcaccuccgccacccucgccaucaccggccuccaaaccggcgacgaagccgacuacuacugcgaaaccugggacgacuccggcggcgucuucggcaccggcaccaaagucaccguccuc

SEQ ID NO: 56002 - RNA, 324 nt, Artificial Sequence
  derived and/or modified sequence opt11 from anti-HIV_119-017740_VR-Chain
caauccguccucacccaaccccccuccgucuccgccgcacccggccaaaaagucaccaucuccugcuccggcuccaacuccaacaucggcaacaaagacgucuccugguaccgccaaguccccgccaccgcccccaaacuccccaucuacgaaaacaaaaacgaacccuccggcguccccgaccgcuucuccggcuccaaauccggcaccuccgccacccucgccauaaccggccuccaaaccggcgacgaagccgacuacuacugcgccaccugggacggccgcgucucagucaucggcaccggcaccaaagucacagucguc

SEQ ID NO: 56003 - RNA, 321 nt, Artificial Sequence
  derived and/or modified sequence opt11 from anti-HIV_119-017128_VR-Chain
caauccguccucacccaaccacccuccgucuccgccgcccccggccaaaaagucaccaucuccugcuccggcuccuccuccaacaucggcaacaacuacgucuccugguaccaacaacuccccggcaccgcccccaaacuccucaucuacgaaaacaacaaacgccccuccggcauccccgaccgcuucuccggcgccaaauccggcaccucagccacccucgccaucaccggccuccaaaccggcgacgaagccgacuacuucugcuccaccugguccggcucccucaacuucggcaccggcacccgcgucaccguccuc

SEQ ID NO: 56004 - RNA, 324 nt, Artificial Sequence
  derived and/or modified sequence opt11 from anti-HIV_119-017044_VR-Chain
caaucaguccucacccaaccccccuccgucuccgccgcccccggccaaaaagucaccaucuccugcuccggcuccaacuccaacaucggcaacaacuacgucuccugguaccaccaccuccccggcaccgccccccgacuccucaucuacgacaacaacaaacgccccuccggcauccccgaccgcuucuccggcuccaaauccggcaccuccgccacccucgccaucaccggccuccaaaccggcgacgaagccgacuacuacugcgccaccugggacggccgcgucuccgucaucggcaccggcacccaagucaccguccuc

SEQ ID NO: 56005 - RNA, 321 nt, Artificial Sequence
  derived and/or modified sequence opt11 from anti-HIV_119-016644_VR-Chain
caauccguccucacccaaccacccuccgucuccgccgcccccggccaaaaagucaccaucuccugcuccggcggcaccuccaacaucggcaacaacuacgucuccugguaccaacaacuccccggcaccgcccccaaacuccucaucuacgaaaacaacaaacgccccuccggcauccccgcccgcuucuccgccgccaaauccggcaccuccgccacccucgccaucaccggccuacaaaccgaagacgaagccgacuacuacugcgccaccugguccggcucccucaacaucggcaccggcaccaaagucaccguccuc

SEQ ID NO: 56006 - RNA, 333 nt, Artificial Sequence
  derived and/or modified sequence opt11 from anti-HIV_119-015878_VR-Chain
caauccgcccucacccaaccccccuccgccuccggcucccccggccaauccgucaccaucuccugcuccggcuccuccuccaacaucggcaacaacuucgucuccugguaccaacaacgccccggcaccgcccccaaacuccucaucuacgaaaccaacaaacgccccuccggcauccccgaccgcuucuccggcuccaaauccggcaccuccgccacccucgccaucaccggacuccaaaccggcgacgaagccgacuacuacugcgccaccugggccccccgccucaacuccgcccgcgucuucggcaacggcaccauggucaccguccuc

SEQ ID NO: 56007 - RNA, 321 nt, Artificial Sequence
  derived and/or modified sequence opt11 from anti-HIV_119-015538_VR-Chain
caaucaguccucacccaaccccccuccgucuccgccacccccggccaaaaagucaccaucuccugcuccggcuccuccuccaacaucggcaacaacuacgucuccugguaccgccgccuccccggcaccgcccccaaacaccucaucuacgaaaccaacaaccgccccuccggcguccccgcccgccucuccgccgccaaauccggcaccuccgccacccucgccaucaccggccuccaaaccgaagacgaagccgacuacuacugcgccaccugguccggcucccucaacaucggcaccggcaccaaagucaccguccuc

SEQ ID NO: 56008 - RNA, 321 nt, Artificial Sequence
  derived and/or modified sequence opt11 from anti-HIV_119-015455_VR-Chain
caauccguccuaacccaaccccccuccgucuccgccacccccggccaaaaagucaccaucuccugcuccggcuccaacuccaacaucggcaacaaagacgucuccugguaccaacacuuccccggcaccgcccccaaacuccucaucuacgaaaacaacaaacgccccuccggcauccccgaccgcuucuccggcuccaaauccgccaccuccgccacccucaccaucaccggccuccaaaccgaagacgaagccgacuacuacugcgccaccugguccggcucacucaacaucggcaccggcaccaaagucaccguccuc

SEQ ID NO: 56009 - RNA, 321 nt, Artificial Sequence
  derived and/or modified sequence opt11 from anti-HIV_119-014425_VR-Chain
caauccguccucacccaaccccccuccgucuccgccgcccccggccaaaaagucaccaucuccugcuccggcggcacauccaacaucggcaacaacuacgucuccugguaccaacaccuccccggcaccgcccccaaacuccucaucuacgaaaacaacaaacgccccuccggcauccccgaccgcuucuccggcgccaaauccggcaccuccgccacccucgccaucaccggccuccaaaccggcgacgaaggcgacuacuacugcgccaccugguccggcucccucaacaucggcaccggcaccaaagucaccguccuc

SEQ ID NO: 56010 - RNA, 324 nt, Artificial Sequence
  derived and/or modified sequence opt11 from anti-HIV_119-013582_VR-Chain
caauccauggucacccaaucccccucagucucagccgcccccggccaaaaagucaccaucuccugcuccggcaccuccuccaacaucggccaaaacuacgucuccugguaccaacaacuacccggcaccgcccccaaacuccucaucuccgaaaacaaccgacgccccuccggcacccccgaccgcuucuccggcuccaaauccggcaccuccgccacccucgccaucaccggccuccaaaccggcgacgaagccgacuacuacugcgaaaccugggacggcuccggcggcgucuucggcaccggcaccaaagucaccguccuc

SEQ ID NO: 56011 - RNA, 333 nt, Artificial Sequence
  derived and/or modified sequence opt11 from anti-HIV_119-013364_VR-Chain
caaucaguccuaacccagcccccaagcguaagcgcagccccgggccaaaaaguaaccauaagcugcagcggaagcucaagcaacaucggaaacaacuacguaagcugguaccaacaacugcccggaaccgcacccaaacuccuaaucuacgacaacaacaaacgcccaagcggaaucccagacagauucucaggcucaaaaucaggcacaagcgcaacccuggccauaaccggacuccacaccggagacgaagccgacuacuacugcacagucuggggcguacgcaaaggcguaggcgcagucuucggcacaggcacaaaaguaaccguacuc

SEQ ID NO: 56012 - RNA, 333 nt, Artificial Sequence
  derived and/or modified sequence opt11 from anti-HIV_119-012886_VR-Chain
caaucgaucuugacccagcccccgagcgugagcgcagccccgggccagaaagugaccauaagcuguagcgggagcucgagcacaaucgggaccaauuacgugagcugguaccagcaauuucccgggaccgcgcccaagcucuuggucuuugaaacgcacaggcgcccgagcgggaucccggacagguucucgggaucgaaaucgggcacgagcgcgaccuuggccauaaccggacuccagaccggagacgaggccgauuacuauugcgcggucuggggcgugcgcaggggcgugggcgcggucuuuggcgcgggcacgaaagugaccgugcuc

SEQ ID NO: 56013 - RNA, 333 nt, Artificial Sequence
  derived and/or modified sequence opt11 from anti-HIV_119-012249_VR-Chain
caauccguccucacccaaccccccucagucuccggcgcccccggccaaaaagucaccaucuccugcuccggcuccuccuccaacaucggccgcaacuacgucuccugguaccaacaacuccccggcaccgcccccaaacuccucaucuacgaaaacaacaaacgccccuccggcauccccgaccgcuucuccggcuccaaauccggcaccuccgccacccucgucaucaccggccuacaaaccggcgacgaagccgacuucuacugcggcaccugggacggcucccucuccggcggcggcgucaucggcaccggcacccgcgucaccguccuc

SEQ ID NO: 56014 - RNA, 324 nt, Artificial Sequence
  derived and/or modified sequence opt11 from anti-HIV_119-012161_VR-Chain
caauccuuccuaacccaaccccccuccgucuccgccgcccccggccaaaaagucaccaucuccugcuccggcuccaacuccaacaucggcaaaaacuacguauccugguaccaauaccuccccggcaccguccccaaacuccucaucuacgaaaacgacaaacgccccuccggcauccccggccgcuucuccgccuccaaauccggcaccuccgccacccucgccaucaccggccuccaaaccggcgacgaagccgacuacuacugcggcacaugggacggcuccggcggcgucuucggcaccggcaccaaagucaccguccuc

SEQ ID NO: 56015 - RNA, 324 nt, Artificial Sequence
  derived and/or modified sequence opt11 from anti-HIV_119-012110_VR-Chain
caauccguccucacccaaccccccuccgucuccgccgcccccggacaaaccgucaccaucuccugcuccggcuccaccuccaacaucggcaaaaacgacgucuccugguaccaacaacuccccggcaccgcccccaaacuccucaucuccgaaaacaaccgccgccccuccggcacccccgaccgcuucuccggcuccaaauccggcaccuccgccacccucgccaucuccggccuccaaaccggcgacgaagccgacuacuacugcggcaccugggacggcuccggcggcgucuucggcaccggcaccaaagucaccguccuc

SEQ ID NO: 56016 - RNA, 333 nt, Artificial Sequence
  derived and/or modified sequence opt11 from anti-HIV_119-012100_VR-Chain
caagccguccucacccaaccccccuccgucuccgccgcccccggccaaaaagucgccaucuccugcucaggcuccuccuccaacaucggcaacaacuacgucuccugguaccaacaacuccccggcaccguccccaaacuccucaucuacgacacagacaaacgccccuccggcauccccgaccgcuucuccggcuccaaauccggcaccuccgccacccucggcaucacccgccuccaaaccggcgacgaagccgacuacuacugcgccaccugggccccccgccucaacuccgcccgcgucuucggcaacggcaccauggucaccguccuc

SEQ ID NO: 56017 - RNA, 324 nt, Artificial Sequence
  derived and/or modified sequence opt11 from anti-HIV_119-011651_VR-Chain
caauccguccucacccaaccccccuccgucuccgccgcccccggccaaaaagucaccaucuccugcuccggcaacuccuccaacaucggcaacaacuacgucuccugguaccaacaacuccccggcaccgcccccaaacuccucaucuacgaaaacaacaaacgccccuccggcauccccgaccgauucuccggcuccaaauccggcaccuccgccacccuagccaucaccggacuccaaaccggcgacgaagccgacuacuacugcgccaccugggacggccgcgucuccgucuucggcaccggcaccaaagucgccguccuc

SEQ ID NO: 56018 - RNA, 333 nt, Artificial Sequence
  derived and/or modified sequence opt11 from anti-HIV_119-011479_VR-Chain
caauccguccucacccaaccccccuccgucucagccacccccggccaaaaagucaccaucuccugcuccggcuccaacuccaacaucggcaacaaauacgucuccugguaccaacacuuccccggcaccgcccccaaacuccucaucuacgaaaacaaccgccgccccuccggcauccccgaccgcuucuccggcuccaaauccggcaccuccgccacccucgccaucaccggccuccaaaccggcgacgaagccgacuacuacugcaccaucuggggcguccgcaaaggagucggcgccgucuucggcaccggcaccaaagucaccguccuc

SEQ ID NO: 56019 - RNA, 333 nt, Artificial Sequence
  derived and/or modified sequence opt11 from anti-HIV_119-011232_VR-Chain
caauccguccucacccaaccacccuccgucuccgccgcccccggccaaaacgucaacaucuccugcuccggcggcuccuccaacaucggauccaacuacgucuccugguaccaacaauuccccggcaccgcccccaaacuccucaucuacgacgacgacaaacgccccuccggcaucccccaccgcuucuccgccucaaaauccggcaccuccgccacccucgccaucuccggccuccaaaccggcgacgaagccgacuacugcugcgccgucuggggcguccgccgcggcgccggcgccgucuucggcgccggcaccaaagucaccguccuc

SEQ ID NO: 56020 - RNA, 333 nt, Artificial Sequence
  derived and/or modified sequence opt11 from anti-HIV_119-011175_VR-Chain
caauccguccucacccaaccacccuccgucuccgccgcccccggccaaaaagucaccaucuccugcuccggcuccaacuccuacaucggcaacaaauacgucuccugguaccaacaauuccccggaaccgcccccaaacuccucaucuacgaaaacaaccgacgccccuccggcauccccgaccgcuucuccggcuccaaauccggcaccuccgccacccucgccaucuccggccuccaaaccggcgacgaagccgacuacugcugcgccgucuggggcguccgccgcggcgccggcgccgucuucggccccggcaccaaagucaccguccuc

SEQ ID NO: 56021 - RNA, 321 nt, Artificial Sequence
  derived and/or modified sequence opt11 from anti-HIV_119-008396_VR-Chain
caauccguccucacccaaccccccuccgucuccgccgcccccggccaaaaagucaccaucuccugcuccggcuccuccuccaacaucggcaacaacuacgucuccugguaccaacaaguccccggcaccgcccccaaacuacucgucuacgaaaacacccgccgccccuccggcguccccgaccgcuucucaggcgccaaauccggcaccuccgccacccucgccaucaccggccuccaaaccggcgacgaaggcgacuacuacugcgccaccugguccggcucccucaacaucggcaccggcaccaaagucaccguccuc

SEQ ID NO: 56022 - RNA, 324 nt, Artificial Sequence
  derived and/or modified sequence opt11 from anti-HIV_119-007148_VR-Chain
caauccguccucacccaaccccccuccgucuccgccgcccccggccaaaaagucaccaucuccugcuccggcuccaccuccaacaucggcaaaaacuacgucuccugguaccaacaccuacccggcaccgcccccaaacuacuccucuacgaaaacgaccgccgccccucaggcacacccgaccgcuucuccggcuccaaauccggcaccuccgccacccucgccaucaccggccuccacaccggcgacgaagccgacuacuacugcgaaaccugggacggcuccggcggcgucuucggcaccggcaccaaagucaccguccuc

SEQ ID NO: 56023 - RNA, 333 nt, Artificial Sequence
  derived and/or modified sequence opt11 from anti-HIV_119-007029_VR-Chain
caauccguccucacccaaccccccuccguaucagccgcccccggacaaaaagucaccaucuccugcuccggcaacucauccaacaucggcaacaacuucgucuccugguaccaacaaguacccggcaccgcccccaaacuccuccucuacgaaaccuaccgccgccccuccggaaucuccgaccgcuucuccggcuccaaauccggcaccuccgccacccucgccaucaccggccuccaaaccggcgacgaagccgacuacuacugcaccgucuggggcguccgcaaaggcgucggcgccgucuucggcaccggcaccaaagucaccguccuc

SEQ ID NO: 56024 - RNA, 324 nt, Artificial Sequence
  derived and/or modified sequence opt11 from anti-HIV_119-004707_VR-Chain
cagagcgugcucacgcaaccgcccucggucucggccgcgcccgggcaaaaggucacgaucucgugcucgggcucgaccucgaacauaggcaagaacgaugucucgugguaucaacagcucccgggcacggccccgaaauugcucauaagcgagaacaaucgcaggcccucgggcacgcccgaucgcuuuagcgggagcaagagcgggaccucggccacacucgcgaucacgggcuugcaaacgggcgaugaagcagacuauuacugugaaacgugggauggcucgggcggggucuuuggcacgggcacgaaagugaccgugcua

SEQ ID NO: 56025 - RNA, 333 nt, Artificial Sequence
  derived and/or modified sequence opt11 from anti-HIV_119-003910_VR-Chain
caauccguccucacccaaccacccuccgucuccgccgcccccggccaaaaagucgccaucuccugcuccggcaacaccuccuccaucggcaacaacuucgucuccugguaccaacaaguccccggcaccgcccccaaacuccucgucuacgaaaccuaccgccgccccuccggcauccccgaccgcuucuccggcuccaaauccggcaccuccgccacccucgccaucaccggccuccaaaccggcgacgaagccgacuacuacugcaccgucuggggcguccgcaaaggcgucggcgccgucuucggcaccggcaccaaagucaccguccuc

SEQ ID NO: 56026 - RNA, 321 nt, Artificial Sequence
  derived and/or modified sequence opt11 from anti-HIV_119-002450_VR-Chain
caauccguccucacccaaccccccuccgucuccggcgcccccggccaacgcgucaccaucuccugcaccggcuccuccuccaacaucggcaacaacuacgucuccugguaccaaggccuccccggcaccgcccccaaacuccucaucuacgaaaacaacaaacgccccuccggcauccccgaccgcuucuccggcgccaaauccggcaccgccgccacccucgccaucaccggccuccaaaccggcgacgaagccgacuacuacugcgccaccugguccggcucccucaacuucggcaccggaaccaaagucaccguccuc

SEQ ID NO: 56027 - RNA, 321 nt, Artificial Sequence
  derived and/or modified sequence opt11 from anti-HIV_119-001552_VR-Chain
caauccguccucacccaaccccccuccgucuccgccgcccccggccaaaaagucaccaucuccugcuccggcuccaacuccuaccucggcaacaaauacgucuccugguaccaacaauuccccggcaccgcccccaaacuacucaucuacgaaaacaacaaacgccccuccggcauccccgaccgcuucuccgccuccaaauccgccgccuccgccacccucgccaucaccggccuccaaaccggcgacgaaggcgacuacuacugcgccaccuggaccggcucccucaacaucggcaccggcaccaaagucaccguccua

SEQ ID NO: 56028 - RNA, 333 nt, Artificial Sequence
  derived and/or modified sequence opt11 from anti-HIV_059-188169_VR-Chain
caauccguccucacccaaccccccuccgucuccgccgcccccggccaaaaagucaccaucuccugcuccggcuccaccuccaacaucggcgacaacuacgucuccugguaccaacaaguccccggcaccgcccccaaacuccucaucuacgaaaacaaccgccgccccuccggcacccccgaccgcuucuccggcuccaaauccggcaccuccgccacccucgccaucaccggccuccaaaccggcgacgaagccgacuacuacugcggcaccugggacaccucccucuccaccggcggcgucuucggcaccggcaccaaagucaccguccuc

SEQ ID NO: 56029 - RNA, 333 nt, Artificial Sequence
  derived and/or modified sequence opt11 from anti-HIV_059-183739_VR-Chain
caauccguccucacccaaccccccuccgucuccgccgcccccggccaaaaagucaccaucuccugcuccggauccaccuccaacaucggcaaaaacuacgucuccugguaccaacaacuccccggcaccgcccccaaacuccucaucuacgaaaacaaccgccgccccuccggcacccccgaccgcuucuccggcuccaaauccggcaccuccgccacccucggcaucuccggccuccaaaccggcgacgaagccgacuacuacugcggcaccugggacaccucccucuccggcggcggcgucuucggcaccggcaccaaagucaccguccuc

SEQ ID NO: 56030 - RNA, 333 nt, Artificial Sequence
  derived and/or modified sequence opt11 from anti-HIV_059-182376_VR-Chain
caauccguccucucccaaccccccuccgucuccgccgcccccggccaaaaagucaccaucuccugcuccggcuccuccuccaacaucggcaacuacuacgucuccugguaccaacaauuccccggcaccgcccccaaacuccucaucuacaaaaacgacaaccgccccuccggcauccccgaccgcuucucaggcuccaaauccggcaccuccgccacccucggcaucuccggccuccaaaccggcgacgaagccgacuacuacugcggcaccuggggcaccucccucuccggcggcggcgucuucggcaccggcaccaaagucaccguccuc

SEQ ID NO: 56031 - RNA, 333 nt, Artificial Sequence
  derived and/or modified sequence opt11 from anti-HIV_059-182199_VR-Chain
caaucaguccuaacccaacccccaagcguaagcgccgccccaggccaaaacauaaccaucagcugcagcggcagcucaagcaacaucggaagccacagcauaagcugguaccaacaccuacccggaaccgcccccaaaaucguaaucuacgacaacgacaaacgcccacucggaaucccagacagauucucaggcucaaaaucaggcacaagcgcaacccuaggcauaaccggacuccaaaccggagacgaagccgacuacuacugcggcaccugggacacaagccuaagcggcggcggagucuucggcccaggcacaaaaguaaccguacuc

SEQ ID NO: 56032 - RNA, 324 nt, Artificial Sequence
  derived and/or modified sequence opt11 from anti-HIV_059-169202_VR-Chain
cacuccguccuaacccaaccccccuccguauccgccgcccccggccaaaaagucaccaucuccugcuccggcuccuccuccaaaaucggcaacaacuucgucuccugguaccaacaacuccccggcaccgcccccaaacuccucaucuacgaaaacaacaaacgccccuccggcauccccgaccgauucuccggcuccaaauccggcaccuccgccacccucgccaucaccggccuccaaaccggcgacgaagccgacuacuacugcggcaccugggacggccgcgucuccgucaucggcuccggcaccaaacucaccguccuc

SEQ ID NO: 56033 - RNA, 324 nt, Artificial Sequence
  derived and/or modified sequence opt11 from anti-HIV_059-155645_VR-Chain
caauccgcccucacccaacccgccuccgucuccggcucacccggccaauccaucaccaucuccugcaccggcaccuccuccgacgucggcuacaacuacgucuccugguaccaacaacuccccggcaccgcccccaaacuccucaucuacgaaaacaacaaacgccccuccggcauccccgaccgcuucuccggcuccaaauccggcaccuccgccacccucgccaucaccggccuccaaaccggcgacgaagccgacuacuacugcggcaccugggacggccgccucucagucaucggcaccggcaccaaagucaccguccuc

SEQ ID NO: 56034 - RNA, 333 nt, Artificial Sequence
  derived and/or modified sequence opt11 from anti-HIV_059-151619_VR-Chain
caaucaguccugacccagcccccaagcguaagcgcagccccaggccaaaaaguaaccauaagcugcagcggaagcucaagcaacaucggaaacaacuucguaagcugguaccaacuccugcccggaaccccgcccaaacuccugaucuucaaaaacaacgaacgcccaagcggaaucccagacagauucucaggcucaaaaucaggcacaagcgcaacccuaggcauaaccggacuccagaccggggacgaaggcgacuacuacugcggaaccugggacacaagccuaagcggaggcggagucuucggcacaggcacacgcguaaccguacuc

SEQ ID NO: 56035 - RNA, 333 nt, Artificial Sequence
  derived and/or modified sequence opt11 from anti-HIV_059-146503_VR-Chain
caauccguccucacccaaccccccuccgucuccgccacccccggccaaaaagucaccaucuccugcuccggcuccgccuccaacaucggcaacaacuacgucuccugguaccaacaauuucccggcaccgcccccaaacuccucaucuacgacaccaacaaacgccccuccggcauccccgaccgcuucuccggcuccaaauccggcaccuccgccauccucggcaucaccggccuccaaaucggcgacgaagccgacuacuacugcggcaccugggacaccucccucuccggcggcggagucuucggcaccggcaccaaagucaccguccuc

SEQ ID NO: 56036 - RNA, 324 nt, Artificial Sequence
  derived and/or modified sequence opt11 from anti-HIV_059-136098_VR-Chain
caauccguccucacccaaccacccuccgucuccgccgcccccggccaacgagucaccaucuccugcuccggcuccuccuccaacaucggcaacaacuacgucuccugguaccaacaacuccccggcaccgcccccaaacuccucaucuacgaaaacaaccgccgccccuccggcauccccgaccgauucuccggcuccaaauccggcaccuccgccacccucgccaucaccggccuccaaaccggcgacgaaggcgacuacuacugcgcccgcugggacggccgccucuccgucaucggcuccggcaccaaagucaccguccuc

SEQ ID NO: 56037 - RNA, 333 nt, Artificial Sequence
  derived and/or modified sequence opt11 from anti-HIV_059-105516_VR-Chain
caauccgcccucacccaaccccccuccgucuccgcagcccccggccaaaaagucaccaucuccugcuccggcuccuccuccaacaucggcaacaacuacgucuccugguaccaacaacuccccggcaccgcccccaaacuccucaucuacgacaacaacaaacgccccuccggcauccccgaccgauucuccggcuccaaauccggcaccuccgccacccucgccaucgccggccuccaaaccggcgacgaagccaacuacuacugcggcaccugggacggcucccuccgcaccggcggcgucuucggcaccggcaccaaagucaccguccuc

SEQ ID NO: 56038 - RNA, 333 nt, Artificial Sequence
  derived and/or modified sequence opt11 from anti-HIV_059-095709_VR-Chain
caauccguccucacccaacccccauccgucuccgccgcccccggccaaaaagucaccaucuccugcuccggccgcuccuccaacaucggcaacaacuucgucuccugguaccaacuccuccccggcaccgcccccaaacuccucaucuacaaaaacaacgaacgccccuccggcauccccgaccgcuucucagccuccaaauccggcaccuccgccacccuaggcaucaccggccuccaaaccggcgacgaagccgacuacuacugcggcaccugggacaccucccucuccggcggcggcgucuucggcaccggcaccaaagucaccguccuc

SEQ ID NO: 56039 - RNA, 333 nt, Artificial Sequence
  derived and/or modified sequence opt11 from anti-HIV_059-069468_VR-Chain
caauccguccucacccaaccccccuccgucuccggcgccccccgccaauccgucaucaucuccugcaccggcucauccuccaacaucggcggcuucgacguccacugguaccaacaacuccccggcaccgcccccaaacuccucaucuacgaaaacaaccgccgccccuccggcacccccgaccgcuucucaggcuccaaauccggcaccuccgccacccucgccaucaccggccuccaaaccggcgacgaagccgacuacuacugcggcaccugggacggcucccucuccaccggcggcgucaucggcaccggcaccaaagucaccguccuc

SEQ ID NO: 56040 - RNA, 333 nt, Artificial Sequence
  derived and/or modified sequence opt11 from anti-HIV_059-060026_VR-Chain
caauccguccucacccaaccccccuccgucuccgccgcccccggccaaaaagucaccaucuccugcuccggcuccucauccaacaucggcaacaacuacgucuccugguaccaacaacuccccggcaccguccccaaacuccucaucuacaaaaacgacaaacgccccuccggcauccccgaccgcuucucaggcuccaaauccgccaccuccgccacccucggcaucaccggccuccaaaccggcgacgaagccgacuacuacugcggcaucugggacaccucccucuccgccggcggcgucuucggcaccggcacccgcgucaccguccuc

SEQ ID NO: 56041 - RNA, 333 nt, Artificial Sequence
  derived and/or modified sequence opt11 from anti-HIV_059-053668_VR-Chain
caauccguccuaacccaaccccccuccgucuccgccgcccccggccaaaaagucaccaucuccugcuccggcuccuccuccaacaucggcaacaacuacgucuccugguaccaacaacuccccggcaccgcccccaaacuccucaucuacgaaaacaacaaacgcuccuccggcauccccgaccgcuucuccggcuccaaauccggcaccuccgccacccucgccaucaccggccuccaaaccggcgacgaagccgacuacuacugcggcacccgcgacuccucccucuccggcggcggcgucaucggcaccggcacaaaagucaccguccuc

SEQ ID NO: 56042 - RNA, 333 nt, Artificial Sequence
  derived and/or modified sequence opt11 from anti-HIV_059-052864_VR-Chain
caauccguccucacccaaccccccucccucuccgccgcccccggccaacgcgucaccauauccugcucaggcuccuccuccaacaucggcaacaacuacgucuccugguaccaacaacuccccggcaccgcacccaaacuccucaucuacgaauccaacaaacgccccuccggcacacccgaccgcuucuccggcucaaaauccggcaccuccgccacccucgccaucaccggccuccaaaccggcgacgaagccgacuacuacugcggcaccugggacgccucccuauccuccggcggcgucaugggcaccggcaccaaagucaccguccuc

SEQ ID NO: 56043 - RNA, 333 nt, Artificial Sequence
  derived and/or modified sequence opt11 from anti-HIV_059-050968_VR-Chain
caauccguccucacccaagccccauccgucuccgccgcccccggcgaaaaagucaccaucuccugcuccggcaccuccuccaacaucggcuacuacuacgucuccugguaccaacaauuccccggcaccgcccccaaagucguaaucuacgaaaacaaccgccgccccuccggaacccccgaccgcuucuccggcuccaaauccggcaccuccgccacccucgccaucaccggccuccaaaccggcgacgaagccgacuacuacugcggcaccuggggcggcucccucuccaccggcggcgucauaggcaccggcaccaaagucaccguccuc

SEQ ID NO: 56044 - RNA, 333 nt, Artificial Sequence
  derived and/or modified sequence opt11 from anti-HIV_059-046422_VR-Chain
caauccguccucacccaaccccccuccgucuccgccgcccccggccaaaaagucaccaucuccugcuccggcuccuccuccaccaucggcaacaacuacaucuccugguaccaacuccuccccggcaccccccccaacuaccucaucuucaaaaucuccgaacgccccuccggcguccccgaccgcuucuccggcuccaaauccggcaccuccgccacccuccacaucaccggccuacaaaccggcgacgaaggcgacuacuacugcggcaccugggacaccucccucuccggcggcggcgucuucggcaccggcaccaaagucaccguccuc

SEQ ID NO: 56045 - RNA, 333 nt, Artificial Sequence
  derived and/or modified sequence opt11 from anti-HIV_059-045120_VR-Chain
caauccguccucacccaaccccccuccgucuccgccgcccccggccaaaaagucgccaucuccugcuccggcuccuccuccaccaucggcaacaacuacgucuccugguaccaacuccuccccggcaccccccccaaacuccucaucuucaaaucccacgaacgccccuccggcauccccgaccgcuucuccggcuccaaauccggcaccuccgccacccucggcaucaccggccuccaaaccggcgacgaaggcgacuacuacugcggcaccugggacuccucccucuccgucggcggcgucuucggcaccggcaccaaagucaccguccuc

SEQ ID NO: 56046 - RNA, 333 nt, Artificial Sequence
  derived and/or modified sequence opt11 from anti-HIV_059-039932_VR-Chain
caauccguccucacccaaccccccucagucucagccgcccccggccaaaaagucaccaucuccugcuccggcuccucauccaucaucggcaaaaacuacgucuccugguaccaacaccuccccggcaccgcccccaaacuccucaucuacgaaaacaacaaacgccccucaggcauccccgaccgcuucuccggcuccaaauccggcaccuccgccacccuagccaucgccggccuccaaaccggcgacgaagccaacuacuacugcggcaccuggggcggcucccuauccaccggcggcgucuucggcaccggcaccaaagucaccguccuc

SEQ ID NO: 56047 - RNA, 333 nt, Artificial Sequence
  derived and/or modified sequence opt11 from anti-HIV_059-038595_VR-Chain
caauccguccucacccaaccccccucagucuccgccgcccccggccaaaaagucaccaucuccugcuccggccgcuccuccaacaucggcaacaacuucgucuccugguaccaacaacuccccggcaccgcccccaaacuccucaucuacgaaaacaacaaacgccccuccggaauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaucguccuc

SEQ ID NO: 56048 - RNA, 333 nt, Artificial Sequence
  derived and/or modified sequence opt11 from anti-HIV_059-035082_VR-Chain
caauccguccucacccaaccccccuccgucuccgcagcccccggccaaaaagucaccaucuccugcuccggcuccaccuccaacaucggcaaauccuucgucucaugguaccaacaacuccccggcaccgcccccaaacuccucaucuacgacaacaaccgccgccccuccggcacccccgaccgauucuccggcuccaaauccggcacauccgccacccucgccaucaccggccuccaaaccggcgacgaagccgacuacuacugcggcaccuggggcggcucccucuccaccggcggcgucaucggcaccggcaccaaagucaccguccuc

SEQ ID NO: 56049 - RNA, 333 nt, Artificial Sequence
  derived and/or modified sequence opt11 from anti-HIV_059-029204_VR-Chain
caauccguccucacccaaccccccucagucuccgccgcccccggacaaaaagucaccaucuccugcuccggcucaaccuccaacaucggcaaaauccucgucuccugguaccaacaacuccccggcaccgcccccaaacccuccaucuacgacaacaaccgccgccccuccggcacccccgaccgcuucuccggcuccaaauccggcaccuccgccacccucgccaucaccggccuccaaaccggcgacgaagccgacuacuacugcggcaccugggacggcucccucuccaccggcggcgucaucggcaccggcaccaaagucaccgucccc

SEQ ID NO: 56050 - RNA, 324 nt, Artificial Sequence
  derived and/or modified sequence opt11 from anti-HIV_059-025235_VR-Chain
caauccguccucacccaaccccccuccgucuccggcgcccccggccaaaaaaucaccaucuccugcuccggcuccaccuccaacaucggcaaauccuacgucuccugguaccaacaacuccccggcaccgcccccaaacuccucaucuacgaaaacaaccgccgccccucaggcacccccgaccgcuucuccggcuccaaauccggcaccucagccacccucgccaucaccggccuacaaaccggcgacgaagccgacuacuacugcggcaccugggacggcuccggcggcgucaucggcaccggcaccaaagucaccguccuc

SEQ ID NO: 56051 - RNA, 333 nt, Artificial Sequence
  derived and/or modified sequence opt11 from anti-HIV_059-015192_VR-Chain
caauccguccucacccaaccccccuccgucuccgccgcccccggccaaaaagucaccaucuccugcuccggcuccuccuccaccaucggcgacaaauacgucucaugguaccaacuccuccccggcaccgcccccaaacuccucaucuacaaaaacaacaaacgccccuccggcauccccgaccgcuucuccggcuccaaauccggcaccuccgccacccucggcaucaccggccuccaaaccggcgacgaagccgacuacuacugcggcaccugggacaccucccucuccgucggcggagucuucggcaccggcaccaaagucaccguccuc

SEQ ID NO: 56052 - RNA, 333 nt, Artificial Sequence
  derived and/or modified sequence opt11 from anti-HIV_059-007060_VR-Chain
caauccguccucacccaaccccccuccgucuccgccgcccccggccaaaaagucaccaucuccugcuccggcuccuccuccaacaucggcaacaaauacgucuccugguaccaacaacuccccggcaccgcccccaaacuccucaucuacgaaaacaaaaaacgccccuccggcauccccgaccgcuucuccggcuccaaauccggcaccuccgccacccucggcaucaccggacuccaaaccggcgacgaagccgacuacuucugcggcaccugggacaccucccucucaggcggcggcguauucggcuccggcaccaaagucaccguccuc

SEQ ID NO: 56053 - RNA, 324 nt, Artificial Sequence
  derived and/or modified sequence opt11 from anti-HIV_059-006953_VR-Chain
cagagcgugcucacgcaaccgcccucggucucggccgcgcccgggcaaaaggucacgauaucgugcucgggcucgagcucgaacauaggcgugagcugguaccagcaagugcccgggaccgcgcccaagcucuugaucuaugacaaugacaagcgcccgaccgggaucccggacagguucucgggcucgaaaucgggcacgagcgcgaucuuggccauaaccgggcuccagaccggggacgagggcgauuacuauugcgggaccugggaaacgagccugagcgggggcggggucuuuggcacgggcacgaaagugaccgugcuc

SEQ ID NO: 56054 - RNA, 333 nt, Artificial Sequence
  derived and/or modified sequence opt11 from anti-HIV_059-005953_VR-Chain
cacuccguccucacccaaccccccuccgucuccgccgcccccggccaaaaagucaccaucuccugcuccggcaccuccucaaacaucggcaaaaacuacgucuccugguaccaacaacuccccggcaccgcccccaaacuccucaucuacgaaaacaaccgccgccccuccggcacccccgaccgcuucuccggcuccaaauccggcaccuccgccacccucgccaucaccggccuccaaaccggcgacgaagccgacuacuacugcggcaccugggacaccucccucuccaccggcggcgucuucggcaccggcaccaaagucaccguccuc

SEQ ID NO: 56055 - RNA, 324 nt, Artificial Sequence
  derived and/or modified sequence opt11 from anti-HIV_059-003725_VR-Chain
caauccguccucacccaacccccauccgucuccgccgcccccggccaaaaacucaccaucuccugcuccggcuccaccuccaaaaucggcaacaacuacgucuccugguaccaacaccuccccggcaccgcccccaaacuccucgucuacgaaaacaacaaacgccccuccggcauccccgaccgcuucuccggcuccaaauccggcaccuccgccacccucgccaucaccggccuccaaaccggcgacgaagccgacuacuacugcggcaccugggacggccgccucuccgucaucggcaccggcaccaaagucaccguccua

SEQ ID NO: 56056 - RNA, 333 nt, Artificial Sequence
  derived and/or modified sequence opt11 from anti-HIV_059-002618_VR-Chain
caacuaguccucacccaaccccccuccgucuccgccgcccccggccaaaaagucaccaucuccugcuccggcuccuccuccaacaucggcaacaacuucgucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacacccgccucuccgccggcggcgucuucggcaccggcaccaaagucaccguccuc

SEQ ID NO: 56057 - RNA, 324 nt, Artificial Sequence
  derived and/or modified sequence opt11 from anti-HIV_059-001522_VR-Chain
caauccguccucacccaaccccccuccgucuccgccgcccccggccaaaaagucaccaucuccugcuccggcuccaacuccaacaucggcaacaacuacgucucaugguaccaacaacuccccggcacagcccccaaacuccucaucuacgaaaacaacaaacgccccuccggcauccccgaccgcuucuccggcuccaaauccggcaccuccgccacccucgccaucaccggccuccaaaccggcgacgaagccgacuacuacugcggcaccugggacggccgccucuccgucaucggcgccggcaccaaagucaucgucguc

SEQ ID NO: 56058 - RNA, 333 nt, Artificial Sequence
  derived and/or modified sequence opt11 from anti-HIV_059-000731_VR-Chain
caauccguccucacccaaccccccuccgucuccgccgcccccggccaaaaagucaccaucuccugcuccggcuccaccuccaacaucggcaacaaauacgucuccugguaccaacaaguccccggcaccgcccccaaacuccucaucuacgaaaacaaccgccgccccuccggcauccccgaccgcuucuccggcuccaaauccggcaccuccgccacccucgccaucaccggccuccaaaccggcgacgaagccgacuacuacugcggcaccugggacgccucccuccgcaccggcggcgucaucggcaccggcaccaaagucaccguccuc

SEQ ID NO: 56059 - RNA, 333 nt, Artificial Sequence
  derived and/or modified sequence opt11 from anti-HIV_059-000634_VR-Chain
caauccguccucacccaaccccccuccgucuccgccgcccccggccaaaaagucaccaucuccugcuccggcuccuccucaaccaucggcaacaacuacgucuccugguaccaagucguccccggcaccgcccccaaacuccucaucuacaaaaucaacgaacgccccuccggcauccccgaccgcuucuccggcucaaaauccggcaccuccgccacccucggcaucaccggccuccaaaccggcgacgaagccgacuacuacugcggcaccugggacaccucccuauccggcggcggcgucuucggacccggcaccaaagucaccguccuc

SEQ ID NO: 56060 - RNA, 333 nt, Artificial Sequence
  derived and/or modified sequence opt11 from anti-HIV_048-250757_VR-Chain
caauccguccucacccaaccccccuccgucuccggcgcccccggccaacgcgucaccaucuccugcaccggcaccaccuccaacaucggcuccaacuacgucgccugguaccaacaacuccccggcaccgcccccaaacuccucaucuacgacaacgacaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56061 - RNA, 333 nt, Artificial Sequence
  derived and/or modified sequence opt11 from anti-HIV_048-250716_VR-Chain
caauccguccucacccaaccccccuccgucuccgccgcccccggccaaaaagucaccaucuccugcuccggcuccuccuccaacaucggcaacaaauacgucuccugguaccaacaacuccccggcaccgcccccaaacuccucaucuacgaaaacuccaaacgccccuccggcauccccgaccgcuucuccggcuccaaauccggcacauccgccacccucggcaucaccggccuccaaaccggcggccaagccgacuacuacugcggcaccugggacaccucccucuccgccggcggcgucuucggcuccggcaccaaagucaccguccuc

SEQ ID NO: 56062 - RNA, 333 nt, Artificial Sequence
  derived and/or modified sequence opt11 from anti-HIV_048-250463_VR-Chain
caauccguccucacccaaccccccuccgucuccgccgcccccggccaaaaagucaccaucuccugcuccggcucccgcuccaacaacggcaacaacuacgucuccugguaccaacaacuccccggcaccgcccccaaacuccucaucuacgaaaacaacaaacgccccuccggcauccccgaccgcuucuccggcuccaaauccggcaccuccgccacccucgccaucaccggccuccaaaccggcgacgaagccgacuacuacugcggcaccugggacuccucccucuccggcggcggcgucaucggcaccggcaccaaacucaccguccuc

SEQ ID NO: 56063 - RNA, 333 nt, Artificial Sequence
  derived and/or modified sequence opt11 from anti-HIV_048-248153_VR-Chain
caaucagcccuaacccaacccgcaagcguaagcgccagcuucggccaaagcauaaccauaagcugcaccggagcagcaagcgacgucggauacaacuacguaagcugguaccaacaacuacccggaaccacacccaaacuccuaaucuaccgcaacaaccaacgcccaagcggaaucccagacagauucucaggcucaaaaucgggcacaagcgcaacccuaggcauaaccggacuccaaaccggagacgaagccgacuacuacugcggaaccugggacacaagccuaagcgcaggcggagucuucggcacaggcacaaaaguaaccguacuc

SEQ ID NO: 56064 - RNA, 333 nt, Artificial Sequence
  derived and/or modified sequence opt11 from anti-HIV_048-247532_VR-Chain
caauccguccucacccaaccccccuccgucuccgccgcccccggccaacaagucaccaucucaugcuccggcaccaccuccaacaucggcaccaacuacgucuccugguaccaacaaaugccccccgccgcccccaaacuccucaucuacgacaacaaaaaacgccccuccgacauccccgaccgcuucuccggcuccaaauccggcaccuccgccacccucggcaucaccggccuccaaaccggcgacgaagccgacuacuacugcggcaccugggacaccucccucucagccggcggcgucuucggcaccggcaccaaagucaccguccuc

SEQ ID NO: 56065 - RNA, 333 nt, Artificial Sequence
  derived and/or modified sequence opt11 from anti-HIV_048-245846_VR-Chain
caauccguccucacccaaccccccucagucuccgccacccccggccaacgcgucaccaucuccugcaccggcucauccuccaacaucggcggcuacgacgucuccugguaccaaguccuccccggcaccgcccccaaacuccucaucuacgacuccgacaaacgccccuccggcauccccgaccgcuucucaggcucccaauccggcaccuccgccacacucggcaucaccggccuccaaaccggcgacgaagccgacuacuacugcggcaccugggacaccucccucuccggcggcggcgucuucggcaccggcaccaaagucaccguccuc

SEQ ID NO: 56066 - RNA, 333 nt, Artificial Sequence
  derived and/or modified sequence opt11 from anti-HIV_048-244016_VR-Chain
caauccguccucacccaaccccccuccgucuccggcgcccccggccaacgcgucaccaucuccugcaccggcuccuccuccaacaucggcggcuacgacguccacugguaccaacaacuccccggcaccgcccccaaacuccucaucuacaaaaacgacaaacgccccuccggcauccccgaccgcuucuccggcuccaaauccggaaccuccgccauccucggcaucaccggccuccaaaccggcgacgaagccgacuacuacugcggcgccugggacaccucccucucagccggcggcgucuucggcaccggcaccaaagucaccguccuc

SEQ ID NO: 56067 - RNA, 333 nt, Artificial Sequence
  derived and/or modified sequence opt11 from anti-HIV_048-243682_VR-Chain
caaucccuccucacccaaccacccuccgucuccgccgcccccggccaaaaagucaccaucuccugcaccggcuccuccuccaacaucggcggcuacgacguccacugguaccaacaacuccccggcaccgcccccaaacuccucaucuacgaaaacaacaaacgccccuccggcauccccgaccgcuucuccggcuccaaauccggcaccuccgccacccucggcauaaccggccuccaaaccggcgacgaagccgacuacuacugcggcaccugggacuccucccuauccgccggcggcgucuucggcaccggcaccaaagucaccguccuc

SEQ ID NO: 56068 - RNA, 333 nt, Artificial Sequence
  derived and/or modified sequence opt11 from anti-HIV_048-243588_VR-Chain
caaucccuccucacccaaccccccuccgucuccgccccccccggccaaauggucuccaucuccugcuccggcuccucccacaacaucggcgacaacuacgucuccugguaccaacaccuccccggcaccgcccccaaacuccucaucuacgacaacaacucccgccccuccggcauccccgaccgcuucucaggcuccaaauccggcaccuccgccacccucggcaucaccggccuccaaaccggcgacgaagccgacuacuacugcggcaccugggacaccucccucuccggcggcggcgucuucggcaccggcaccaaagucaccguccuc

SEQ ID NO: 56069 - RNA, 333 nt, Artificial Sequence
  derived and/or modified sequence opt11 from anti-HIV_048-241775_VR-Chain
caauccguccucgcccaaccacccuccgucuccggcgcccccggccaacgcgucacaaucuccugcaccggcuccuccuccaacaucggcgaauacgacguccacugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucacaguccuc

SEQ ID NO: 56070 - RNA, 333 nt, Artificial Sequence
  derived and/or modified sequence opt11 from anti-HIV_048-237996_VR-Chain
caauccguccucacccaaccccccucagucuccggcgcccccggccaacgcgucaccaucuccugcaccggcuccucauccaacaucggcggcuacgacguccacugguaccgccaacuccccggcaccgcccccaaacuccuaaucuacgacaccgucaaacgccccuccggcauccccgaccgcuucuccggcucaaaauccggcaccuccgccacccucggcaucaccggccuccaaaccggcgacgaagccgacuacuacugcggcaccugggacacaucccucuccgccggcggagucuucggcaccggcaccaaagucaccguccuc

SEQ ID NO: 56071 - RNA, 330 nt, Artificial Sequence
  derived and/or modified sequence opt11 from anti-HIV_048-237730_VR-Chain
uccguccucacccaaccccccuccgucuccggcgcccccggccaacgcgucaccaucuccugcaccggcaccaacuccaacuucggcuccaacuacgcccacugguaccaacaaguccccggcaccgcccccaaacuccucaucuacuccaacaacgcccgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56072 - RNA, 333 nt, Artificial Sequence
  derived and/or modified sequence opt11 from anti-HIV_048-237253_VR-Chain
caauccguccucacccaaccccccuccgucuccgccgcccccggccaaaaagucaccgucuccugcuccggcuccuccuccaacaucggcuccaacgacgucuccugguaccaacaauuccccggcgccgcccccaaacuccucaucuacaaaaacaacgaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56073 - RNA, 333 nt, Artificial Sequence
  derived and/or modified sequence opt11 from anti-HIV_048-234100_VR-Chain
caauccaugcucacccaaccccccuccgucuccgccgcccccggcgaaaaagucaccaucuccugcuccggcuccuccuccaacaucggcaaaaccuucgucuccugguaccaacaaguccccggcaccgcccccaaacuccucaucuacaaaaacgacaaccgccccuccggcauccccgaccgcuucuccggcuccaaauccggcaccuccgcaacccucggcaucuccggccuccaaaccggcgacgaagccgacuacuacugcggcaccugggacaccucccucuccggcggcggcgucuucggcaccggcaccaaagucaccguccuc

SEQ ID NO: 56074 - RNA, 333 nt, Artificial Sequence
  derived and/or modified sequence opt11 from anti-HIV_048-230882_VR-Chain
caauccguccucacccaaccccccuccgucuccgccgcccccggccaaaaagucaccaucuccugcuccggcaacuccuccaacaucggcuccaacuucguauccugguaccaacaacuccccggcaccgcccccaaacuccucaucuacgaaaacaacaaacgccccuccggcauccccgaccgcuucucaggcuccaaauccggcaccuccgccacccucggcaucaccggccuccaaaccggcgacgaagccgacuacuacugcggcaccugggacaccucccucucccccggcggcgucuucggcaccggcaccaaagucaccguccuc

SEQ ID NO: 56075 - RNA, 333 nt, Artificial Sequence
  derived and/or modified sequence opt11 from anti-HIV_048-229473_VR-Chain
caauccguccucacccaaccccccuccgucuccgccgcccccggccaaaaagucaccaucuccugcuccggcuccuccuccaacaucggcaacaacuacgucuccugguaccaacaauuccccggcaccgcccccaaacuccucaucuacgaaaacaacaaacgccccucaggcauccccgaccgcuucucaggcuccaaaucaggcaccaccgccacccucgccaucacccgccuccaaaccggcgacgaagccgacuacuacugcggcaccuggggcggcucccucuccgccggcggcgucuucggcaccggcaccaaagucaccguccuc

SEQ ID NO: 56076 - RNA, 333 nt, Artificial Sequence
  derived and/or modified sequence opt11 from anti-HIV_048-228238_VR-Chain
caauccguccucacccaaccacccuccgucuccgccgcccccggccaaaaagucaccaucuccugcuccggcuccuccuccaacaucggcaucaacuacgucuccugguaccaacaacuccccggcaccgcccccaaacuccucaucuacgacaacaccaaacgcccccaaggcauccccgaccgcuucuccggcuccaaauccggcaccuccgccacccucgccaucaccggccuacaaaccggcgacgaagccgacuacuacugcggcaccugggacggcucccucuccaccggcggcgucaucggcaccggcaccaaagucaccguccua

SEQ ID NO: 56077 - RNA, 333 nt, Artificial Sequence
  derived and/or modified sequence opt11 from anti-HIV_048-228027_VR-Chain
caaucccuccuaacccaaucacccuccgccuccggcccccccggccaacgcgucaccaucuccugcucaggcuccaacuccaacaucggcuccaacaccgucaacugguaccaccaccuccccggcgccgcccccaaacuccucaucuacgaaaacuccaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56078 - RNA, 333 nt, Artificial Sequence
  derived and/or modified sequence opt11 from anti-HIV_048-227795_VR-Chain
caaucgguccugacccagcccccgagcgugagcgcggccccgggccagaaagugaccauaagcuguagcgggagcucaagcaauaucgagagcaggagcgugcacugguaccagcaaaagcccgggcaagcgcccgugcucgugaucuauuacgauagcgaucgcccgagcgggaucccggacagguucucgggcucaaaaucgggcacggccgcgaccuugggcauaaccgggcuccagaccggggacgaggccgauuacuauugcgggaccugggacacgagcuugagcgcgggcggggucuuuggcacgggcacgaaagugaccgugcuc

SEQ ID NO: 56079 - RNA, 333 nt, Artificial Sequence
  derived and/or modified sequence opt11 from anti-HIV_048-227770_VR-Chain
caauccguccucacccaaccccccuccgucuccggcgcccccggccaacgcgucaccaucuccugcaccggcuccuccuccaacaucggcccccgcgacguccacugguaccaacaacuccccggcaccguccccaaacuccucaucuacgacaccuacacccgccccucaggcauccccgaccgcuucuccggcuccaaauccggcgccuccgccacccucgacaucacaggccuccaaaccggcgacgaagccgacuacuacugcggcaucugggacaccucccucuccgccggcggcgucuucggcaccggcaccaaagucaccguccuc

SEQ ID NO: 56080 - RNA, 333 nt, Artificial Sequence
  derived and/or modified sequence opt11 from anti-HIV_048-225298_VR-Chain
caauccgcccucacccaaccccgcuccgucuccggcucccccggccaauccgucaccaucucaugcaccggcaccuccaacgacgucggauacgacuacgucuccugguaccaacaacuacccggcaccgcccccaaacuccucaucuacgacaucaacaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56081 - RNA, 327 nt, Artificial Sequence
  derived and/or modified sequence opt11 from anti-HIV_048-225090_VR-Chain
gaacucacccaaccccccuccgucuccggcgcccccggccaacgcguaaccaucuccugcaccggcuccuccuccaacaucggcggcuacgacguccacugguaccaacaacuccccggcaccgcccccaaacuccucaucuacgacaacaacaaacgccccuccggcauccccgaccgcuucuccggcuccaaauccggcaccuccgccacccucggcaucaccggccuccaaaccggcgacgaagccgacuacuacugcggcaccugggacacaucccucuccaccggcggcgucuucggcaccggcaccaaagucaccguccuc

SEQ ID NO: 56082 - RNA, 333 nt, Artificial Sequence
  derived and/or modified sequence opt11 from anti-HIV_048-224187_VR-Chain
caauccguccucacccaaccccccuccgccuccggcacccccggccaacgcgucaccaucuccugcuccggcuccuccgccaacaucggcaccaacuacgucuucugguaccaacaccuccccggcaccaccccccgccuccucaucuuccgcaacaacgaacgccccuccggcauccccgaccgauucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56083 - RNA, 333 nt, Artificial Sequence
  derived and/or modified sequence opt11 from anti-HIV_048-223055_VR-Chain
caauccguccucacccaaccccccuccgucuccgccgcccccggccaaaaagucaccaucuccugcuccggcuccuccuccaacaucggcaacaacuacgucuccugguaccaacaauuccccggcaccgcccccaaaguccucaucuacggcaacuccaaacgccccuccggcauccccgaccgcuucuccggcuccaaaucaggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56084 - RNA, 333 nt, Artificial Sequence
  derived and/or modified sequence opt11 from anti-HIV_048-222711_VR-Chain
caacccguccucacccaaccccccuccgucuccggcgcccccggccaacgcgucaccaucuccugcaccggcuccucauccaacaucggcggcuacgacguccacugguaccaacaaguccccggcaccgcccccaaacuccucaucuucgaaaacaaccgccgccccuccggcauccccgaccgcuucuccggcuccaaaucaggcaccuccgccacccucgccaucaccggccuccaaaccggcgacgaagccgacuacuacugcggcaccugggacggcucccucuccaccggcggcgucaucggcaccggcaccaaagucaccguccuc

SEQ ID NO: 56085 - RNA, 333 nt, Artificial Sequence
  derived and/or modified sequence opt11 from anti-HIV_048-221209_VR-Chain
caaucaguccuaacccaacccccauccgucuccggcgcccccggccaacgcgucaccaucuccugcaccggcaacuccuccaacaucggcgacuacgacguccacugguaccaacaagucgccggcaccgcccccaaacuccucaucuucaaaaacaacgaacgccccuccggcauccccgaccgcuucuccggcuccaaauccggcaccuccgccacacucggcaucaccggccuccaaaccggcgacgaagccgacuacuacugcggcaccugggacaccucccucuccgccggcggcgucuucggcuccggcaccaaagucaccguccuc

SEQ ID NO: 56086 - RNA, 333 nt, Artificial Sequence
  derived and/or modified sequence opt11 from anti-HIV_048-220629_VR-Chain
caaucagcccucacccaacccgccuccgucuccggcucccucggccaauccaucaccaucuccugcaccggcaccucccgcgacgucggcuacuccuacgucuccugguaccaacaccuccccggcaccgcccccaaacuccucaucuacgaaaacaacaaacgccccuccggcauccccgaccgauucuccggcucaaaaucaggcaccuccgccacccucggcaucaccggacuccaaaccggcgacgaagccgacuacuacugcggcaccugggacuccucccucuccgccggcggcgucuucggcaccggcaccaaagucaccguccua

SEQ ID NO: 56087 - RNA, 333 nt, Artificial Sequence
  derived and/or modified sequence opt11 from anti-HIV_048-219430_VR-Chain
caauccguccucacccaaccccccuccgucuccgccgcccccggccaaauggucaccaucuccugcuccggcuccacauccaacaucggcaucaacuacguauccugguaccaacacguccccggcaccgcccccaaacuccucaucuacgacaacaacaaacgccccuccggcauccccgaccgcuucuccggcuccaaauccggcaccuccgccacccucggcaucaccggccuccacaccggcgacgaagccgacuacuacugcggcaccugggacaccucccuauccgccggcggcgucuucggcacaggcaccaaagucaccguccuc

SEQ ID NO: 56088 - RNA, 333 nt, Artificial Sequence
  derived and/or modified sequence opt11 from anti-HIV_048-216250_VR-Chain
caaucaguccuaacccagcccccaagcguaagcgcagccccaggccaaaaagugaccauaagcugcaccgggacaacaagcgacuucggguacaacugcguaagcugguaccagcaacaccccggacgcgcacccaaggucauaaucucaggcguaaacaagcgaccaagcggaaucccggacagguucucgggcucgaaaucaggcacaagcgcgacccugggcauaaccggacuccagaccggggacgaggccgacuacuacugcggaaccugggacucaagccuaagcgcaggcggggucuucggcacaggcacaaaagugaccguacuc

SEQ ID NO: 56089 - RNA, 321 nt, Artificial Sequence
  derived and/or modified sequence opt11 from anti-HIV_048-216133_VR-Chain
acccaaccccccucccucuccgccacccccggccaacgcgucuccaucuccugcuccggcggcggcuccaacaucggcaacaacgacgucuucugguuccaacaauuccccggcgccggcccccgccuccucaucuacgacaaccacaaacgccacuacggcacccccgaccgcuucuccggcuccaaauccggcaccuccgccacccucgccaucaccggccuccaaaccggcgacgaagccgccuacuacugcggcaccugggacggcucccuaucaaccggcggcgucaucggcaccggcaccaaagucaccguccuc

SEQ ID NO: 56090 - RNA, 333 nt, Artificial Sequence
  derived and/or modified sequence opt11 from anti-HIV_048-214886_VR-Chain
caauccgcccucacccaaccacgcucagucuccggcucccccggccaauccgucaccaucuccugcaccggcaccuccuccgacgucggcuacaacuacgucuccugguaccaacaccaccccggcaccgcccccaaacuccucaucuacaaaaacaacaaccgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56091 - RNA, 333 nt, Artificial Sequence
  derived and/or modified sequence opt11 from anti-HIV_048-214709_VR-Chain
caauccguccucacccaaccacccuccgucuccgccgcccccggccaaaaagucaccaucuccugcuccggcuccuccuccaacaucggcaacaacuacgucuccugguaccaacaacuccccggcaccgcccccaaacuccucaucuacgaaaacgaccgccgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56092 - RNA, 333 nt, Artificial Sequence
  derived and/or modified sequence opt11 from anti-HIV_048-214001_VR-Chain
caaucaguccuaacccaacccccaagcguaagcggagccccaggccaaaccguaaccauaagcugcagcggaagcaacagcaacaucggaaaccacgacguacacugguaccaacacguacccggaaccgcacccaaacuccuaaucuacgacaacaacaaacgcccaagcggaaucccagacagauucucaggcucaaaaucaggcacaagcgcaacccuaggcauaaccggacuccaaaccggagacgaagccgaauacuacugcgcaaccugggacgcaagccugagcggaggcggagucuuccgcacaggcacaaaaguaaccguacuc

SEQ ID NO: 56093 - RNA, 333 nt, Artificial Sequence
  derived and/or modified sequence opt11 from anti-HIV_048-213230_VR-Chain
caauccguccucacccaaccccccuccauguccgccgcccccggccaaaaagucaccaucuccugcuccggcuccuccaacaacaucggcaaaaacgucgucuccugguaccaacaacuccccggcaccgcccccaaaguccucaucuacgaaaacaacaaacgccucuccggcauccccgaccgcuucuccggcuccaaauccggcaccuccgccacccucgucaucaccggccuccaaaccggcgacgaagccgacuacuacugcggcaccugggacuccucccucuccgccggcggcgucuucggcaccggcaccaaagucaccguccuc

SEQ ID NO: 56094 - RNA, 333 nt, Artificial Sequence
  derived and/or modified sequence opt11 from anti-HIV_048-212574_VR-Chain
caauccguccucacccaaccccccuccgucuccgccgcccccggccaacgcguaaccgucuccugcuccggcuccaccuccaacaucgaauccaacuacgucuccugguaccaacaaguccccggaaccgcccccaaacuccucaucuacgaaaacaacaaacgccccuccggcauccccgaccgcuucuccggcuccaaauccggcaccuccgccacccucgccaucaccggccuccaaaccggcgacgaagccgccuacuacugcggcaccugggacggcucacucuccaccggcggcgucaucggcaccggcaccaaagucaccguccuc

SEQ ID NO: 56095 - RNA, 333 nt, Artificial Sequence
  derived and/or modified sequence opt11 from anti-HIV_048-212207_VR-Chain
caauccguccucacccaaccccccucccucuccgccgcccccggccaaaaagucaccaucuccugcuccggcggcuccuccaacaucggcaacaacuacgucuccugguaccaacaccuccccggcaccgcccccaaacuccucaucuacgacaacuacaaacgccccuccggcauccccgaccgauucuccggcuccaaauccggcaccuccgccacccucgacaucaccggccuccaaaccggcgacgaagccgacuacuacugcggcaccugggacaccucacucuccgccggcggcgucuucggcaccggcaccaaagucaccguccuc

SEQ ID NO: 56096 - RNA, 333 nt, Artificial Sequence
  derived and/or modified sequence opt11 from anti-HIV_048-209146_VR-Chain
caauccguccucacccaaccccccuccgucuccggcgcccccggccaaaaaaucaccgucuccugcaccggcaccaccuccaacaucggcccccacgacguccacugguaccaacucguccccggacgcccccccaaacuccucaucuuccacaacaacauccgcccauccggcauccccgaccgcuucuccggcuccaaauccggcauguccgccacccuaggcaucaccggccuccaaaccggcgacgaagccgacuacuacugcggcaccugggacuccucccucuccgccggcggcgucuucggcaccggcaccaaagucaccguccuc

SEQ ID NO: 56097 - RNA, 333 nt, Artificial Sequence
  derived and/or modified sequence opt11 from anti-HIV_048-208206_VR-Chain
caauccguccucacccaaccccccuccgucuccgccgcccccggccaaaaagucaccaucuccugcuccggcuccuccuccaacaucggcuccaacuacgucuccugguaccaacaauuccccggcaccgccccccgccuccucaucuacgaaaacgacaaacgccccuccgccauccccgaccgcuucuccggcuccaaauccggcaccuccgccacccucggcaucaccggccuccacaccggcgacgaagccgacuacuacugcggcaccugggacggcucacucuccaccggcggcgucaucggcaccggcaccaaagucaccguccuc

SEQ ID NO: 56098 - RNA, 333 nt, Artificial Sequence
  derived and/or modified sequence opt11 from anti-HIV_048-208194_VR-Chain
caauccgcccucacccaaccccccuccgccuccggcucacccggccaauccgucaccaucuccugcaccggcaccuccuccgacaucggcuacaaauacgucuccugguaccaacuccuccccggcaccccccccaaacuccucaucuucaaaaacaacgaacgccccuccggcauccccgaccgcuucuccggcuccaaauccggcaccuccgccacccucggcaucaccggccuccaaaccggcgacgaagccgacuacuacugcggcgccugggacaccucccucuccgccggcggcgucuucggcaccggcaccaaagucaccguccuc

SEQ ID NO: 56099 - RNA, 333 nt, Artificial Sequence
  derived and/or modified sequence opt11 from anti-HIV_048-207744_VR-Chain
caauccgcccucacccaacccgccuccgucuccgccuccuucggccaauccaucaccaucuccugcaccggcgccgccuccacaaucggcaacaaccucgucuccugguaccgccuccuccccggcacagcccccaaacuccucaucuacaaaaacgacaaccgccccuccggcauccccgaccgcuucuccggcuccaaauccggcaccuccgccacccucggcaucuccggccuccaaaccggcgacgaagccgacuacuacugcggcaccugggacaccucccucuccggcggcggcgucuucggcaccggcaccaaagucaccguccuc

SEQ ID NO: 56100 - RNA, 333 nt, Artificial Sequence
  derived and/or modified sequence opt11 from anti-HIV_048-206501_VR-Chain
caauccguccucacccaaccccccuccguuuccggcgcccccggccaacgcgucaccaucuccugcuccggcuccuccuccaacaucggcaacaacgccgucaacugguaccaacaacuccccggcaaagcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56101 - RNA, 333 nt, Artificial Sequence
  derived and/or modified sequence opt11 from anti-HIV_048-204221_VR-Chain
caauccguccucacccaaccacccuccgccuccggcacccccggccaacgcgucaccaucuccugcuucggcuccuccuccaacaucgccuccuccgccgucaacugguaccaacaacuccccggcaccgcccccaaacuccucaucuacaaaaacgacaaacgccccuccggcauccccgaccgcuucuccggcuccaaauccggcaccuccgccacccucggcaucaccggccuccaaaccggagacgaagccgacuacuacugcggcaccugggacaccucccucuccgccggcggcgucuucggcaccggcaccaaagucaccguccuc

SEQ ID NO: 56102 - RNA, 333 nt, Artificial Sequence
  derived and/or modified sequence opt11 from anti-HIV_048-204015_VR-Chain
caauccguccucacccaaccccccuccgccuccggcacccccggccaacgcgucaccaucuccugcuccggcuccuccuccaacaucggcuccaaauacgucuacugguaccaacaacuccccggcaccgcccccaaacuccucaucuacaaaaacgacaaccgccccuccggcauccccgaccgauucucaggcuccaaauccggcaccuccgccacccucggcaucuccggccuccaaaccggcgacgaagccgacuacuacugcggcaccugggacaccucccucuccggcggcggcgucuucggcaccggcaccaaagucaccguccuc

SEQ ID NO: 56103 - RNA, 333 nt, Artificial Sequence
  derived and/or modified sequence opt11 from anti-HIV_048-201240_VR-Chain
caauccguccucacccaaccccccuccgucuccgccgcccccggccaaaaagucaccaucuccugcuccggcuccuccuccaacaucggcaacaacuacgucgccugguaccaacaacuccccggcaccgcccccaaacuccucaucaaagaaaacucccaacgccccucaggcauccccgaccgcuucuccggcuccaaauccggcaccuccgccacccucgccaucaccggccuccaaaccggcgacgaagccgacuacuacugcggcaccugggacaccucccucuccaccggcggcgucuucggcaccggcaccaaagucaccguccuc

SEQ ID NO: 56104 - RNA, 333 nt, Artificial Sequence
  derived and/or modified sequence opt11 from anti-HIV_048-200455_VR-Chain
caauccgcccucacccaacccgccuccgucuccggcucccccggccaauccaucaccaucuccugcaccggcaccuccuccgacgucggcuacaacuacgucuccugguaccaaguccuccccggcaccgcccccaaacuccucaucuacaaaaacaccgaacgccccuccggcauccccgaccgcuucuccggcuccaaauccggcaccucagccacccucgacaucaccggccuccaaaccggcgacgaagccgacuacuacugcggcaccugggacaccucccucuccgccggcggcgucuucggcaccggcaccaaagucacaguccuc

SEQ ID NO: 56105 - RNA, 333 nt, Artificial Sequence
  derived and/or modified sequence opt11 from anti-HIV_048-200319_VR-Chain
caauccgucgucacccaaccccccuccgccuccggcacccccggccaacgagucaccaucuccugcuccggcuccuccuccaacaucggcuccaaauacgucuacugguaccaccaacaccccggcaccgcccccaaacuccucaucuacgacaacaacaaccgccccuccggcauccccgaccgcuucuccggcuccaaauccggcaccuccgccacccucggcaucaccggccuccaaaccggcgacgaagccgacuacuacugcggcaccugggacaccucccucucccgcggcggcgucuucggcaccggcaccaaagucaccguccuc

SEQ ID NO: 56106 - RNA, 333 nt, Artificial Sequence
  derived and/or modified sequence opt11 from anti-HIV_048-197896_VR-Chain
caauccguccucacccaaccccccuccgucuccgcagcccccggccaaaaagucaccaucuccugcuccggcgccuccuacaacaucggcaaaaacuccgucuccugguaccaacaacuacccggcaccccccccaaacuccucaucuucaaaaacaacgaacgccccucaggcauccccgaccgcuucuccggcuccaaauccggcaccuccgccacccucggcaucaccggccuccaaaccggcgacgaagccgacuacuacugcgccaccugggacaccucccucuccgccggcggcgucuucggcaccggcaccaaagucaccguccuc

SEQ ID NO: 56107 - RNA, 333 nt, Artificial Sequence
  derived and/or modified sequence opt11 from anti-HIV_048-193813_VR-Chain
caauccguccuaacccaaucccccuccgucuccgccgcccccggccaaaaagucaccaucuccugcuccggcuccaacuccaacgucggcaacuacuacgucuccugguaccaacaccuccccggcaccgcccccaaaguccucaucuacgaaggcaacaaacgccccuccggcguccccgaccgcuucuccggcuccaaauccggcaccuccgccucacucgccaucaccggccuccaaaccggcgacgaagccgacuacuacugcggcaccugggacaccucccucuccgccggcggcgucuucggcuccggcaccaaagucaccguccuc

SEQ ID NO: 56108 - RNA, 333 nt, Artificial Sequence
  derived and/or modified sequence opt11 from anti-HIV_048-192098_VR-Chain
caauccguccucacccaaccccccuccgccuccggcacccccggccaacgcgucaccaucuccugcuccggcuccaccuccaacaucggcuccaacuacgucuacugguaccaacaacuccccggcaccacccccaaacuacucaucuacgaaaacaacaaacgccccucaggcaucaccgaccgcuucuucggcuccaaauccggccccuccgccacccucgacaucaccggccuccaaaccggcgacgaagccgacuacuacugcggcaccugggacgccucccucuccgccggcggcgucuucggcaccggcaccaaagucaccguccuc

SEQ ID NO: 56109 - RNA, 333 nt, Artificial Sequence
  derived and/or modified sequence opt11 from anti-HIV_048-191786_VR-Chain
caauccguccuaacccaaccacccuccgucuccgccgcccccggccaaaacgucaacaucuccugcuccggcuccuccuccaacaucgaaaacaacuucgucuccugguaccaaaaacuccccggcaccgcccccaaacuccuaaucuacgacaacaacaaacgccccuccggcauccgcgaccgcuucucaggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56110 - RNA, 333 nt, Artificial Sequence
  derived and/or modified sequence opt11 from anti-HIV_048-188746_VR-Chain
caauccguccucacccaaccccccuccgccuccggcacccccggccaaaaagucaccaucuccugcuccggcuccaacuccaacaucggcuccaacuucgucuccugguaccaacuccuccccggcaccacccccaaacuccucaucuaccgcaacaaccaacgccccuccggcguccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaaguaaccguccuc

SEQ ID NO: 56111 - RNA, 333 nt, Artificial Sequence
  derived and/or modified sequence opt11 from anti-HIV_048-185937_VR-Chain
caauccguccucacccaaccccccuccgucuccgccgcccccggccaaaaagucaccaucuccugcuccggcuccuccuccaacaucggaaacaacuacgucuccugguaccaacaacuccccggcaccgcccccaaacuccucaucuacgaaaacaacaaacgccccuccggcauccccuaccccaucuccggcucaaaaucaggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56112 - RNA, 333 nt, Artificial Sequence
  derived and/or modified sequence opt11 from anti-HIV_048-184849_VR-Chain
caauccguccucacccaagcccccuccgccuccggcacccccggccaaaccgucacaaucuccugcuccggcuccuccuccaacaucggcaccaaauacgucuacugguaccaacaacuccccggcaccgcccccaaacuccucaucuacaaaaacaacgaacgccccuccggcauccccgaccgcuucuccggcuccaaauccggcaccucagccacccucggcaucaccggccuccaaaccggcgacgaagccgacuacuacugcggcaccugggacaccucccucucccccggcggcgucuucggcaccggcaccaaagucaccguccuc

SEQ ID NO: 56113 - RNA, 333 nt, Artificial Sequence
  derived and/or modified sequence opt11 from anti-HIV_048-183089_VR-Chain
caauccguccucacccaaccccccuccgccuccggcaccccaggccaacgcgucaccaucuccugcuccggcuccuccuccaacaucggcuccuccuacgucuacugguaccaacuccuccccggcaccccccccaaacuccucaucuucaaaaacaacgaacgacccuccggcauccccgaccgauucuccggcuccaaauccggcaccuccgccacccucggcaucaccggccuccaaaccggcgacgaagccgacuacuacugcggcaccugggacaccucccuuuccgccggcggcgucuucggcaccggcaccaaagucaccguccuc

SEQ ID NO: 56114 - RNA, 333 nt, Artificial Sequence
  derived and/or modified sequence opt11 from anti-HIV_048-181509_VR-Chain
caauccguccucacccaaccccccuccgucuccggcgcccccggccaacgcgucaccaucuccugcaccggcuccuccuccaacaucggcggcuacgacguacacugguaccaccaacuccccggcgccgcccccaaacuccucaucuacaaaaacgacaaccgccccuccggcauccccgaccgauucuccggcuccaaauccggcaccuccgccacccucggcaucuccggccuccaaaccggcgacgaagccgacuacuacugcggaaccugggacaccucccucuccggcggcggcgucuucggcaccggcaccaaagucaccguccuc

SEQ ID NO: 56115 - RNA, 333 nt, Artificial Sequence
  derived and/or modified sequence opt11 from anti-HIV_048-180990_VR-Chain
caauccguccucacccaaccccccuccgucuccgccgcccccggccaacgagucaccaucuccugcuccggcuccaccuccaacaucggcaacaacuacgucuccugguaccaacacuuccccggcaaaguccccaaagucgucaucucagaaaccaccaaacgccccuccggcauccccgaccgcuucuccggcuccaaauccggcaccuccgccacccuaggcaucaccggccuccaaaccggcgacgaagccgacuacuacugcggcaccugggacuccucccucuccgccggcggcgucuucggcaccggcaccaaaguaaccguccuc

SEQ ID NO: 56116 - RNA, 333 nt, Artificial Sequence
  derived and/or modified sequence opt11 from anti-HIV_048-177532_VR-Chain
caauccgcccucacccaaccccccuccgccuccggcucccucggccaauccgucaccaucuccugcaccggcaccuccuccgacgucggcaacaacuucgucuccugguaccaaaaaaaacccggcaaagcccccaaacucaucgucuacgaagucaacaaacgccccuccggaauccccgaccgcuucuccggcucaaaaucaggcaccuccgccacccucggcaucaccggccuccaaaccggcgacgaagccgacuacuacugcggcaccugggacaccucccucucaaccggcggcgucuucggcaccggcaccaaagucaccguccuc

SEQ ID NO: 56117 - RNA, 324 nt, Artificial Sequence
  derived and/or modified sequence opt11 from anti-HIV_048-177426_VR-Chain
cucacccaaccccacuccgucuccgaaucccccggcaaaaccgucaccaucuccugcaccggcaccuccuccgacgucggcuacaacuacgucuccugguaccaacaccaccccggcaaagcccccaaacuccucaucuacgaagucaccaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56118 - RNA, 333 nt, Artificial Sequence
  derived and/or modified sequence opt11 from anti-HIV_048-177389_VR-Chain
caauccguccucacccaaccccccuccauguccgccgcccccggcgaacgcgucaccaucuccugcuccggcuccuccuccaacaucggcaaccaccacgucuccugguaccaacaacgccccggcaccgcccccaaacuccucaucuacgaaaacaacgaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56119 - RNA, 333 nt, Artificial Sequence
  derived and/or modified sequence opt11 from anti-HIV_048-174266_VR-Chain
caauccguccucacccaaccccccuccgucuccggcgcccccggccaacgcgucaccaucuccugcuccggcuccuccuccaacaucggcucccacuacgucuccugguaccaacaaguccccggcaccgccccccgacucgucaucuacgacaccaucaaacgccacuccggcauccccgaccgcuucuccggcuccaaauccggcaccuccgcaacccucggcaucaccggccuccaaaccggcgacgaagccgacuacuacugcggcaccugggacaccucccucuccgccggcggcgucuucggcaccggcaccaaaguaaccguccuc

SEQ ID NO: 56120 - RNA, 333 nt, Artificial Sequence
  derived and/or modified sequence opt11 from anti-HIV_048-172847_VR-Chain
caaucggucuugacccagcccccgagcguaagcgcggccccgggccagcgagugaccgugagcuguagcgggagcacgagcaauaucgagagcaauuacgugagcugguaccagcaagugcccgggaccgcgcccaagcucuugaucuaugaaaauaacaagcgcccgagcgggaucccggacagguucucgggcucgaaaucgggcacgagcgcgaccuugggcauaaccgggcuccagaccggggacgaggccgauuacuauugcgggaccugggacacgagcuugagcgcgggcggggucuuuggcacgggaacgaaagugaccgugcuc

SEQ ID NO: 56121 - RNA, 333 nt, Artificial Sequence
  derived and/or modified sequence opt11 from anti-HIV_048-172845_VR-Chain
caauccgcccucacccaaccccccuccgccuccggcucccccggccaauccguaaccaucucaugcaccggcaccuccuccgacgucggcuacaacuacgucucaugguaccaacaacuccccggcaccgcccccaaacuccucaucuaccgcaacaaccaacgccccuccggcguccccgaccgcuucuccggcuccaaauccggcaccuccgccacccucggcaucaccggccuccaaaccggcgacgaagccgacuacuacugcgccaccugggacaccucccuauccgccggcggcgucuucggcaccggcaccaaagucaccguccuc

SEQ ID NO: 56122 - RNA, 333 nt, Artificial Sequence
  derived and/or modified sequence opt11 from anti-HIV_048-172363_VR-Chain
caauccguccucacccaaccccccuccgucuccgccgcccccggccaaaaagucaccaucuccugcuccggcuccggcuccaacaucggcaacaccuacgucuccugguaccaacaacuccccggcaccgcccccaaacuccucaucuucgaagacaacaaacgccccuccggcauccccgaccgcuucuccggcuccaaaucaggcaccuccgccacccucgccaucaccggccuccaaaccggcgacgaagccgacuacuacugcggcaccugggacuccucccucuccggcggcggcgucaucggcaccggcaccaaacucaccguacuc

SEQ ID NO: 56123 - RNA, 333 nt, Artificial Sequence
  derived and/or modified sequence opt11 from anti-HIV_048-171609_VR-Chain
caauccguccuaacccaaccccccuccgucuccgccgcccccggccaagaagucaccaucuccugcuccgcauccuccuccuccaucggcaacgacuucgucuccugguaccaacaacuccccggcaccgcccccaaacuccucaucuacggcaacuccaaccgccccuccggcauccccgaccgcuucucaggcuccaaauccggcaccuccgccacccucggcaucaccggccuccaaaccggcgacgaagccgacuacuacugcggcaccugggacaccucccucuccaccggcggcgucuucggcaccggcaccaaagucaccguccuc

SEQ ID NO: 56124 - RNA, 333 nt, Artificial Sequence
  derived and/or modified sequence opt11 from anti-HIV_048-170705_VR-Chain
caaucaguccucacccaaccccccuccgucuccgccgcccccggccaaauggucaccaucuccugcucaggcuccaccuccaacaucggcaucaacuacgucuccugguaccaacacguccccggcaccgcccccaaacuccucaucuacgaaaacgucgaacgccgcuccggcauccccgaccgcuucuccgccuccaaaucagccaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56125 - RNA, 333 nt, Artificial Sequence
  derived and/or modified sequence opt11 from anti-HIV_048-168381_VR-Chain
caauccgcccucacccaacccgccuccgucuccggaucccccggccaauccaucaccaucuccugcaccggcaccuccuccaacaucggcuccaacuacgucuccugguaccaacaacuccccggcaccgcccccaaacuccucaucuacgaaaacaaccaacgccccuccggcauccccgaccgcuucucaggcuccaaauccggcaccuccgccacccucggcaucaccggccuccaaaccggagacgaagccgacuacuacugcggcaccugggacaccucccucuccgccggcggcgucuucggcuccggcaccaaagucaccguccuc

SEQ ID NO: 56126 - RNA, 333 nt, Artificial Sequence
  derived and/or modified sequence opt11 from anti-HIV_048-166619_VR-Chain
caauccguccuaacccaaccccccuccgucuccggcgcccccggccaacgcgucaccaucuccugcaccggcuccuccuccaacaucggcggcuaccacacccacugguaccaacaacuccccggcaccgcccccaaacuccucaucuacgaaaacuccaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56127 - RNA, 333 nt, Artificial Sequence
  derived and/or modified sequence opt11 from anti-HIV_048-162036_VR-Chain
caauccguccucgcccaaccccccucagucuccggcgcccccggccaaaccgucaccaucuccugcaccggaucauccuccaacaucggcggcuacgacguccacugguaccaacaacuccccggcaccgcccccaaacuacuaaucuacaaagacgacaaacgccccuccggcauccccgaccgcuucuccggcuccaaauccggcaccuccgccacccucggcaucaccggccuccaaaccggcgacgaagccgacuacuacugcggcaccugggacaccucccucaaccgcggcggcgucuucggcaccggcaccaaagucaccguccuc

SEQ ID NO: 56128 - RNA, 333 nt, Artificial Sequence
  derived and/or modified sequence opt11 from anti-HIV_048-160042_VR-Chain
caauccguccucacccaacccccauccgucuccgccgccccaggccaaaaagucaccaucuccugcuccggcuccuccuccaacaucggcaucaacuacaucuccugguaccaacaacuccccggcaccgcccccaaaauccucaucuacgacaacgacaaacgcccccucggcauccccgaccgcuucuccggcuccaaauccggcaccuccgccacccucggcaucaccggccuccaaaccggcgacgaagccgacuacuacugcggcaccugggacgccucccucuccgccggcggcgucuucggcaccggcaccaaagucaccguccuc

SEQ ID NO: 56129 - RNA, 333 nt, Artificial Sequence
  derived and/or modified sequence opt11 from anti-HIV_048-159676_VR-Chain
caaucgguccugacccagcccccgagcgugagcgcgagcccgggccagaaagugaccauaagcuguagcgggagcucgagcgauaucgggagcaauuacgugagcugguacgugcaauugcccgggaccgcgcccaagcucuugaucuauaaaaauaacgagcgcccgagcgggaucccggacagguucucgggcucaaaaucgggcacgagcgcgacccugggcauaaccgggcuccagaccggagacgaggccgauuacuauugcgggaccugggacacgagcuugagcgcgggcggggucuuuggcacgggcacgaaagugaccgugcuc

SEQ ID NO: 56130 - RNA, 333 nt, Artificial Sequence
  derived and/or modified sequence opt11 from anti-HIV_048-159500_VR-Chain
caauccguccucacccaaccccccuccguauccgccgcccccggccaaaacgucaccaucuccugcuccggcuccugguccaacaucggcgccaacuacgucuccugguaccaacaacuccccggcaccgcccccaaacuccucaucuacgaaaacaacaaacgacccuccggcauccccgaccgcuucuccggcuccaaauccggcaccuccgccacccucggcuucacaggccuccaaaccggcgacgaagccgacuacuacugcggcaccugggacaccucccucuccgccggcggcgucuucggcaccggcaccaaagucaccguccuc

SEQ ID NO: 56131 - RNA, 333 nt, Artificial Sequence
  derived and/or modified sequence opt11 from anti-HIV_048-159421_VR-Chain
caaucccuccuaacccaagcccccuccgucuccgccgcccccggccaaaccgucaccaucuccugcuccggcuccaacgccgacaucggcaaaaacuucgucuccugguaccaacaaucccccggcgccgcccccaaacuccucaucuacgaaaacgaccgccgccccuccggcauccccgaccgcuucuccggcuccaaauccggcaccuccgccacccucggcaucaccggccuccaaaccggcgacgaagccgaauacuacugcgccaccugggacgccucccucuccggcggcggcgucuucggcaccggcaccaaagucaccguccuc

SEQ ID NO: 56132 - RNA, 333 nt, Artificial Sequence
  derived and/or modified sequence opt11 from anti-HIV_048-159333_VR-Chain
caaucggucuuaacccagcccccgagcgcgagcgggaccccgggccagcgcgugaccauaagcuguagcgggagcaauagcaauaucgggagcgauagcguguacugguaccagcaauugcccgggcgcucgcccaagcucuugaucuaucgcaauaacgagcgcccgagcgggaucccggacagguucucgggcucgaaaucgggcacgagcgcgaccuugggcauaaccgggcuccagaccggggacgaggccgauuacuauugcgggaccugggacacgagcuugagcgcgggcggggucuuuggcacgggcacaaaagugaccguacuc

SEQ ID NO: 56133 - RNA, 333 nt, Artificial Sequence
  derived and/or modified sequence opt11 from anti-HIV_048-158932_VR-Chain
caauccguccucacccaacccgccuccgucuccggcucccccggccaauccaucaccaucuccugcuccggcuccucuuccaacaucggcgacaucuucgucuccugguaccaacaaguccccggcgccgcccccaaacuccucaucuacgacaacgacaaacgccccuccggcauccccgaccgcuucuccggcuccaaauccggcaccuccgccacccucgacaucaccggccuccaaaccggcgacgaagccgacuacuacugcggcaccugggacaccucccucuccgccggcggcgucuucggcaccggcaccaaagucaccguccua

SEQ ID NO: 56134 - RNA, 333 nt, Artificial Sequence
  derived and/or modified sequence opt11 from anti-HIV_048-155811_VR-Chain
caauccgcccucacccaacccgccuccgucuccggcucccccggccaauccaucaccaucuccugcaccggcaccuccuccgacgucggcuacgacuacgucuccugguaccaacuccuacccggcaccccccccaaacuccucaucuucaaaaacaacgaacgccccuccggcauccccgaccgcuucuccggcuccaaauccggcaccuccgccacccucggcaucaccggccuccaaaccggcgacgaagccgacuacuacugcgccaccugggacaccucccucuccgccggcggcgucuucggcaccggcaccaaagucaccguccuc

SEQ ID NO: 56135 - RNA, 333 nt, Artificial Sequence
  derived and/or modified sequence opt11 from anti-HIV_048-155464_VR-Chain
caauccgcccucacccaacccgccuccgucuccggcucccccggccaauccaucaccaucuccugcaccggcgccaccggcgacucaggccacaccuacgucuccugguaccaacaacuccccggcaccgcccccaaacuccucaucuacuccaacaacgaacgccccuccggcguccccgaccgauucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56136 - RNA, 333 nt, Artificial Sequence
  derived and/or modified sequence opt11 from anti-HIV_048-155392_VR-Chain
caauccguccucacccaaccccccuccgucuccgccgcccccggccaaauggucaccaucuccugcuccggcuccuccuccaacaucggcgacaacuacgucuccugguaccaacaacuccccggccgcggccccaaacuccucgucuacgacaccuacaaacgcuaccucgaaacccccgaccgcuucuccggcuccaaauccggcaccuccgccacccucggcauaaccggccuccaaaccggcgacgaagccgacuacuacugcggcaccugggacaccucccucuccgccggcggcgucuucggcaccggcaccaaagucaccguccuc

SEQ ID NO: 56137 - RNA, 333 nt, Artificial Sequence
  derived and/or modified sequence opt11 from anti-HIV_048-155389_VR-Chain
caauccguccucacccaaccccccuccgucuccgccgcccccggccaaaaagucaccaucuccugcuccggcaucuccuccaacaucggcaacaaccccgucuccugguaccaacaauuccccggcaccgcccccaaacuccucaucuacaaaaacgacaaacgccccuccggcauccccgaccgcuucuccggcuccaaauccggcaccuccgccacccucggcaucaccggccuccaaaccggcgacgaagccgacuacuacugcggcaccugggacaccucccucuccaccggcggcgucuucggcacaggcaccaaagucaccguccuc

SEQ ID NO: 56138 - RNA, 333 nt, Artificial Sequence
  derived and/or modified sequence opt11 from anti-HIV_048-154449_VR-Chain
caaucaguccuaaaacaaccccccuccgucuccggcgcccccggccuccgcgucaccaucuccugcaccggcggcuccuccaacaucggcggcuucgacguccacugguaccaacacuuccccggcaccgcccccaaacuccucaucuacgacaacgaccaacgccccuccggcauccccgaccgauucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56139 - RNA, 333 nt, Artificial Sequence
  derived and/or modified sequence opt11 from anti-HIV_048-153379_VR-Chain
caauccguccucacccaaccccccuccgucuccgccacccccggccaaaaagucaccaucuccugcuccggcucccgcuccaacauaggcucccacuacgucuccugguaccaacaauuccccgaauccgcccccaaacuccucaucuacaaaaacgacaaccgccccuccggcauccccgaccgcuucuccggcuccaaauccggcaccuccgccacccuaggcaucuccggccuccaaaccggcgacgaagccgacuacuacugcggcaccugggacaccucccucuccggcggcggcgucuucggcaccggcaccaaagucaccguccuc

SEQ ID NO: 56140 - RNA, 333 nt, Artificial Sequence
  derived and/or modified sequence opt11 from anti-HIV_048-153171_VR-Chain
caauccguccucacccaaccccccuccgucuccgccgcccccggccaaaaagucaccaucuccugcuccggcuccaccuccaacaucgaagacaucuacgucuccugguaccaacaccuccccggcaccgcccccaaacuccucaucuacgacaacaacaaacgccccuccggcauccccgaccgcuucuccggcuccaaauccggcaccuccgccacccucgccaucaccggccuccaaaccggcgacgaagccgacuacuacugcggcaccugggacaccucccucuccgccggcggcgucuucggcaccggcaccaaagucaccguccuc

SEQ ID NO: 56141 - RNA, 333 nt, Artificial Sequence
  derived and/or modified sequence opt11 from anti-HIV_048-152324_VR-Chain
caauccauggucacccaaucccccuccgucuccgccgcccccggccaaaaagucaccaucucaugcuccggcaccuccuccaacaucggccaaaacuacgucuccugguaccaacaacuccccggcaccgcccccaaacuccucaucuacgaaaacuccaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56142 - RNA, 333 nt, Artificial Sequence
  derived and/or modified sequence opt11 from anti-HIV_048-146102_VR-Chain
caauccguccucacccaaccccccuccgucuccgccgcccccggccaaaaagucaccaucuccugcuccggcuccuccuccaccaucggcaacaacuacaucuccugguaccaacuccuccccggcaccccccccaaacuccucaucuacaaaaacaacgaacgccccuccggcauccccgaccgcuucuccggcuccaaauccggcaccucagccacccucggcaucaccggccuccaaaccggcgacgaagccgacuacuacugcggcaccugggacaccucccucuccgccggcggcgucuucggcaccggcaccaaagucaccguccuc

SEQ ID NO: 56143 - RNA, 333 nt, Artificial Sequence
  derived and/or modified sequence opt11 from anti-HIV_048-145984_VR-Chain
caauccguccucacccaaccccucucagucuccggcgcccccggccaacgcgucaccaucuccugcaccggcuccuccuccaacaucggcuccaacuucgucuccugguaccaaguccuccccggcaccacccccaaacuccucaucuucaaaaacaacgaacgccccuccggcauccccgaccgcuucuccggcuccaaauccggcaccuccgccacccucggcaucaccggccuccaaaccggcgacgaagccgacuacuacugcggcgccugggacaccucccucuccgccggcggcgucuucggcaccggcaccaaagucaccguccuc

SEQ ID NO: 56144 - RNA, 333 nt, Artificial Sequence
  derived and/or modified sequence opt11 from anti-HIV_048-145371_VR-Chain
caauccguccucacccaaccacccuccgucuccgccgccuccggccaaaaagucuccauccccugcuccggcggcaccuccaacaucggcgacaacuacgucuccugguuccaacaauuccccggcuccgcccccaaaauccucaucuacgacuccgacaaacgccccucccgcaucuccgaccgcuucucagccuccaaauccggcaccuccgccacccucgacaucacccgccuccaaaccggcgacgaagccgacuacuacugcggcaccugggacaccucccucuccgccggcggcgucuucggcaccggcaccaaagucaccguccuc

SEQ ID NO: 56145 - RNA, 333 nt, Artificial Sequence
  derived and/or modified sequence opt11 from anti-HIV_048-144907_VR-Chain
caauccgcccucacccaacccgccuccgucuccggcucccccggccaauccaucaccaucuccugcaccggcacccgccgcgacgucggcuucaacuacgucuccugguaccaacaacaccccggcaccgcccccaaacuccucaucuacgaaaacaacaaacgccccuccggcauccccgacagauucuccggcuccaaauccggcaccucagccacccucggcaucaccggccuccaaaccggcgacgaagccgacuacuacugcggcaccugggacuccucccucuccgccggcggcgucuucggcaccggcaccaaagucaccguccuc

SEQ ID NO: 56146 - RNA, 333 nt, Artificial Sequence
  derived and/or modified sequence opt11 from anti-HIV_048-142298_VR-Chain
caauccguccucacccaaccccccuccgccuccggcacccccggccaacgcgucaccaucuccugcuccggcuccuccuccaccaucggcaacaacuacaucucaugguaccaacuccuccccggcaccccacccaaacuccucaucuucaaaaacaacgaacgccccuccggcauccccgaccgcuucuccgccuccaaauccggcaccuccgccacccuaggcaucaccggccuccaaaccggcgacgaagccgacuacuacugcggcaccugggacaccucccucuccgccggcggcgucuucggcaccggcaccaaagucaccguccuc

SEQ ID NO: 56147 - RNA, 333 nt, Artificial Sequence
  derived and/or modified sequence opt11 from anti-HIV_048-142277_VR-Chain
caauccguccucacccaaccccccuccgucuccggcgcccccggccaacgcauaaccaucuccugcaccggcuccuccuccaacaucggcgccuacgacguccaaugguaccaacaccuacccggcaccgcccccaaacuccucaucuacaaaaacaccgaacgccccuccggcauccccgaccgcuucuccggcuccaaauccggcaccuccgccacccucgacaucaccggacuccaaaccggcgacgaagccgacuacuacugcggcaccugggacaccucccucuccgccggcggcgucuucggcaccggcaccaaagucaccguccuc

SEQ ID NO: 56148 - RNA, 333 nt, Artificial Sequence
  derived and/or modified sequence opt11 from anti-HIV_048-141934_VR-Chain
caauccguccucacccaaccccccuccgucuccggcgcccccggccaacgcgucaccaucuccugcaccggcaacuccuccaacaucggagccuacgacguccacugguaccaacaacuccccggcaccgcccccaaacucaugaucuacgaagucuccaaacgccccucaggcauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccua

SEQ ID NO: 56149 - RNA, 333 nt, Artificial Sequence
  derived and/or modified sequence opt11 from anti-HIV_048-141207_VR-Chain
caauccguccucacccaaccccccuccgucuccgccgcccccggccaaaaagucaccaucgccugcuccggcuccucauccaacaucggcaacaacuacgucuccugguaccaacaacuccccggcaccgcccccaaacuccuaaucuacgccaacaaccgccgccccuccggcauccccgaccgcuucuccgccuccaaauccggcaccuccgccacccuaggcaucaccggccuccaaaccggcgacgaagccgacuacuacugcggcaccugggacaccucccucuccgccggcggcgucuucggcaccggcaccaaagucaccguccuc

SEQ ID NO: 56150 - RNA, 333 nt, Artificial Sequence
  derived and/or modified sequence opt11 from anti-HIV_048-140796_VR-Chain
caauccguccucacccaaccacccuccgucuccgccacccccggccaaaaagucaccaucuccugcuccggcacccgcuccaacaucggcaacaacuacgucuccugguaccgacaauuccccggcaccgcccccaaacuccucaucuacgaagacaacaaacgccccuccggcauccccgcccgcuucuccggcuccaaauccggcaccuccgccacacucggcaucaccggccuccaaaccggcgacgaagccgacuacuacugcggcaccugggacaccucccucuccgccggcggcgucuucggcaccggcaccaaagucaccguccuc

SEQ ID NO: 56151 - RNA, 333 nt, Artificial Sequence
  derived and/or modified sequence opt11 from anti-HIV_048-139893_VR-Chain
caauccguccucacccaaccccccuccgucuccgccacccccggccaaaaagucaccuucuccugcuccggcuccuccuccaccaucggcaaaaacuacgucuccugguaccaaguccuccccggcaccgcccccaaacuccucaucuacaaaaacaacaaacgccccuccggcauccccgaccgcuucuccggcuccaaauccggcaccuccgccacccucggcaucaccggccuccaaaccggagacgaagccgacuacuacugcggcaccugggacuccucacucuccgccggcggagucuucggcaccggcaccaaagucaccguccuc

SEQ ID NO: 56152 - RNA, 333 nt, Artificial Sequence
  derived and/or modified sequence opt11 from anti-HIV_048-138820_VR-Chain
caauccguccucacccaaccacccuccgucuccggcgcccccggccaaaaagucaccaucuccugcuccggcuccggcuccaacaucggcaacaccuacgucuccugguaccaacaccuccccggcaccgcccccaaacuccuaaucuacgaaaacaacaaacgccccuccggcauccccgaccgcuucuccggcuccaaauccgccaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56153 - RNA, 333 nt, Artificial Sequence
  derived and/or modified sequence opt11 from anti-HIV_048-135858_VR-Chain
caauccguccucacccaaccccccuccgccucaggcacccccggccaacgagucaccaucuccugcuccggcuccuccucaaacaucggcuccuccuacgucuacugguaccaacaauuccccggccgcuccccccgccuccucaucuaccgcaacaacgaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56154 - RNA, 333 nt, Artificial Sequence
  derived and/or modified sequence opt11 from anti-HIV_048-134968_VR-Chain
caauccguccucacccaaccccccuccgucuccgccgcccccggccaaaaagucaccaucuucugcuccggcuccuccuccaacaucggcaaaaacuacgucuccugguaccaacaacuccccggcaccgcccccaaacuccucaucuacgaaaacuccaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56155 - RNA, 333 nt, Artificial Sequence
  derived and/or modified sequence opt11 from anti-HIV_048-134312_VR-Chain
caauccguccucacccaaccccccuccgccuccggcacccccggccaacgcgucaccaucuccugcuccggcuccuccuccaacaucggcaacaacuacgucuccugguaccgccuccuccccggcaccgcccccaaacuccucaucuacaaaaacgacaaccgccccuccggcauccccgaccgauucuccggcuccaaauccggcaccuccgcaacccucggcaucuccggccuccaaaccggcgacgaagccgacuacuacugcggcaccugggacaccucccucuccggcggcggcgucuucggcaccggcaccaaagucaccguccuc

SEQ ID NO: 56156 - RNA, 330 nt, Artificial Sequence
  derived and/or modified sequence opt11 from anti-HIV_048-132253_VR-Chain
uccgcccucacccaacccgccuccgucuccggcuccccaggccaauccaucgccaucuccugcaccggcaccuccuccgacgucggcuacgaccucgucuccugguaccaacaacaccccggcaccgcccccaaacuccucaucuacgacaacaacaaacgccccuccggcauccccgaccgcuucuccggcuccaaauccggcaccuccgccacccucggcaucaccggccuccaaacaggcgacgaagccgacuacuacugcggcaccugggacaccucccuauccgccggcggcgucuucggcuccggcaccaaagucaccguccuc

SEQ ID NO: 56157 - RNA, 333 nt, Artificial Sequence
  derived and/or modified sequence opt11 from anti-HIV_048-130710_VR-Chain
caauccguccucacccaaccccccuccgucgccggcgcccccggccaacgcgucaccaucuccugcaccggcaacaccuccaacaucggcggcuacgacguccacugguaccaacaacuacccggcaccccccccaaacuccuaaucuucaaaaacaacgaacgccccuccggcauccccgaccgcuucuccggcuccaaauccggcacauccgccacccucggcaucaccggccuccaaaccggcgacgaagccgacuacuacugcggcaccugggacaccucccucuccgccggcggcgucuucggcaccggcaccaaaguaaccguccuc

SEQ ID NO: 56158 - RNA, 333 nt, Artificial Sequence
  derived and/or modified sequence opt11 from anti-HIV_048-128564_VR-Chain
caauccguccucacccaaccccccuccgccuccggcacccccggccaacgcgucaccaucuccugcuccggcuccuccuccaacaucggcuccaacaccgucaacugguaccaacaacuccccggcaccgcccccaaacuccucaucuacaaaaacaccgaacgccccuccggcauccccgaccgcuucuccggcuccaaauccggcaccuccgccacccucgacaucaccggccuccaaaccggcgacgaagccgacuacuacugcggcaccugggacaccucccucuccgccggcggcgucuucggcaccggcaccaaagucaccguccuc

SEQ ID NO: 56159 - RNA, 333 nt, Artificial Sequence
  derived and/or modified sequence opt11 from anti-HIV_048-126702_VR-Chain
caauccguccucacccaaccccccuccgccuccgccgcccccggccaacgcgucaccaucuccugcuccggcuccaacuccaacaucggcaacaacuacgucuccugguaccaacaacuccccggcaccgcccccaaacuccucaucuacgacaacuccaaacgccccuccggcauccccgaccgcuucuccgccuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56160 - RNA, 333 nt, Artificial Sequence
  derived and/or modified sequence opt11 from anti-HIV_048-124521_VR-Chain
caauccguccucacccaaccccccuccgucuccggcgcccccggccaacgcgucacaaucuccugcaccggcuccuccuccaccuucggcggcuacgacgucuacugguaccaacaaauccccggcaccgcccccaaacuccucaucuacgaaaacaacaaacgccccuccggcauccccgaccgcuucuccggcuccaaauccggcaccuccgccacccucgccaucaccggccuccaaaccggcgacgaagccgacuacuacugcggcaccugggacggcucccucuccaccggcggagucaucggcaccggcaccaaagucaccguccuc

SEQ ID NO: 56161 - RNA, 333 nt, Artificial Sequence
  derived and/or modified sequence opt11 from anti-HIV_048-122740_VR-Chain
caauccguccucacccaaccccccuccauguccgccgcccccggccaauccgucaccaucuccugcuccggauccaccuucaacaucgaaaaacaccaagucaccuggcuccgccaccuccccggcaccgcccccaccuccgucaucaucaugaacucccaacgacccuccggcacccccgaccgcuucuccggcuccaaauccggcacauccgccacccucgccaucaccggccuccaaaccggcgacgaagccgacuacuacugcggcaccugggacggcucccucuccaccggcggcgucaucggcaccggcaccaaagucaccguccuc

SEQ ID NO: 56162 - RNA, 327 nt, Artificial Sequence
  derived and/or modified sequence opt11 from anti-HIV_048-119536_VR-Chain
gaacucacccaaucccccuccgucuccgcagcccccggcgaaaaagucaccaucuccugcuccggcaccaacuccaacaucggcuacuacuacgucuccugguaccaacaauuccccggcaccgcccccaaagucgucaucuacgaaaacaccaaacgcccauccggcauccccgaccgcuucuccggcuccaaauccggcaccuccgccacccucggcaucaccggccuccaaaccggcgacgaagccgacuacuacugcggcaccugggacaccucccucuccgccggcggcguauucggcuccggcaccaaagucaccguccuc

SEQ ID NO: 56163 - RNA, 333 nt, Artificial Sequence
  derived and/or modified sequence opt11 from anti-HIV_048-116929_VR-Chain
caauccguccucacccaaccccccuccgucuccggcgcccccggccaacgcgucaccaucuccugcaccggauccuccuccaacaucggcgacuacgacguccacugguaccaacaacuccccggcaccgcccccaaacuccuaaucuaccgcaacaaccaacgccccuccggcguccccgaccgcuucuccggcuccaaauccggcaccuccgccacccucggcaucaccggccuccaaaccggcgacgaagccgacuacuacugcggcaccugggacgccucccucuccgccggcggcgucuucggcaccggcaccaaagucaccguccuc

SEQ ID NO: 56164 - RNA, 333 nt, Artificial Sequence
  derived and/or modified sequence opt11 from anti-HIV_048-116577_VR-Chain
caauccguccucacccaaccccccuccgccuccggcacccccggccaacgcguaaccaucuccugcuccggcuccuccuccaacaucggcuccaacuacgucuccugguaccaaguccuacccggcaccgcacccaaacuccucaucuacaaaaacaacaaacgccccuccggcauccccgaccgcuucuccggcuccaaauccggcaccuccgccacccucggcaucaccggccuccaaaccggcgacgaagcagacuacuacugcgccaccugggacaccucccucuccgccggcggcgucuucggcaccggcaccaaagucaccguccuc

SEQ ID NO: 56165 - RNA, 333 nt, Artificial Sequence
  derived and/or modified sequence opt11 from anti-HIV_048-116046_VR-Chain
caauccguccucacccaaccccccuccgucuccggcgcccccggccaacgcgucaccaucucaugcaccggcuccuccuccaacauaggcggcuacgacguccacugguaccaacaauuccccggcaccgcccccaaacuccucaucuacgacaacgacaaacgccccuccggcauccccgaccgcuucuccggcuccaaauccggcaccuccgccacccucggcaucaccggccuccaaaccggcgacgaagccaacuacuacugcggcgccugggacaccucccucuccgccggcggcgucuucggcaccggcaccaaagucaccguccuc

SEQ ID NO: 56166 - RNA, 333 nt, Artificial Sequence
  derived and/or modified sequence opt11 from anti-HIV_048-115875_VR-Chain
caaucaguccucacccaaccacccucagucuccgccgcccccggccaacgcgucaccgucuccugcuccggcuccucauccaacaucggcaacaacuucgucuccugguaccaacaccuccccggcaccgcccccaaacuccuaaucuacgacaacuccaaccgccccuccggcauccccgaccgcuucuccggcuccaaauccggcaccuccgccacccucggcaucaccggccuccacaccggagacgaagccgacuacuacugcggcaccugggacaccucccucuccgccggcggagucuucggcuccggcaccaaagucaccguccuc

SEQ ID NO: 56167 - RNA, 333 nt, Artificial Sequence
  derived and/or modified sequence opt11 from anti-HIV_048-115599_VR-Chain
caaucaguccucacccaacccccaucagucuccgccgccccaggccaaauggucaccaucuccugcuccggcuccuccuccaacaucggcucccacuccgucuccugguaccaacacuuccccggcaccgcccccaaacucgucaucgaagaaaacgaccaacgccccuccggcauccccgaccgauucuccggcuccaaauccggcaccuccgccacccucggcauaaccggccuccaaaccggcgacgaaggcgacuacuacugcggcaccugggacaccucacucuccggcggcggcgucuucggcaccggcaccaaagucaccguccuc

SEQ ID NO: 56168 - RNA, 333 nt, Artificial Sequence
  derived and/or modified sequence opt11 from anti-HIV_048-113988_VR-Chain
caauccguccucacccaaccccccuccgucuccgccgcccccggccaaauggucaccaucuccugcuccggcuccucacacaacaucggcgaaaacuacgucuccugguaccaacaccuccccggcaccgcccccaaacuccucaucuucaaaaacaacgaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56169 - RNA, 333 nt, Artificial Sequence
  derived and/or modified sequence opt11 from anti-HIV_048-112989_VR-Chain
caaucaguccuaacccaacccccaagcgcaagcggaaccccaggccaacgcguaacccucagcugcagcggcggcucaagcaacaucggaaacgacaacguauacugguaccaacaaagacccggaaccacacccaaacuccuaaucuacaacgacaaccgacgcccaagcggaaccccagaccgauucuccggcucaaaaucaggcacaagcgccacccuagccauaaccggacuccaaaccggagacgaagccgacuacuacugcggcaccugggacggaagccuaagcacaggcggagucauaggcacaggcacaaaaguaaccguacuc

SEQ ID NO: 56170 - RNA, 333 nt, Artificial Sequence
  derived and/or modified sequence opt11 from anti-HIV_048-112435_VR-Chain
caauccguccucacccaaccccccuccgucuccgccgcccccggccaaaaagucuccaucuccugcuccggcuccuccuccaacaucggcaaaaacuacgucuccugguaccaacaacuccccggcaccgcccccaaacuccucaucuucaaaaacaacgaacgccccuccggcauccccgaccgcuucuccggcuccaaauccggcaccuccgccacccucggcaucaccggccuccaaaccggcgacgaagccgacuacuacugcgccaccugggacaccucccucuccgccggcggcgucuucggcaccggcaccaaagucacaguccuc

SEQ ID NO: 56171 - RNA, 333 nt, Artificial Sequence
  derived and/or modified sequence opt11 from anti-HIV_048-111339_VR-Chain
caauccguccucacccaaccccccuccgucuccgccgcccccggccaaaaagucaccaucuccugcaccggcuccuccuccaacaucggcggcuacgccguccacugguaccaacaaguccccgccaccgcccccaaacuccucaucuacgaaaacaacgaacgccccuccggcauccccgaccgcuucuccggcuccaaaucaggcaccuccgccacccucggcaucaccggccuccaaaccggcgacgaagccgacuacuacugcggcaccugggacacaucccucuccgccggcggcgucuucggcaccggcaccaaaguaaccguccuc

SEQ ID NO: 56172 - RNA, 333 nt, Artificial Sequence
  derived and/or modified sequence opt11 from anti-HIV_048-111055_VR-Chain
caaucagcccuaacacaacccgcaagcguaagcggaagcccaggccaaagcauaaccauaagcugcaccggaaccagaagcgacgucggauacaacuacguaagcugguaccaacaacaccccggaaaagcacccaaacuacuaaucuacgaaaacaccaaacgcccaagcggaaucccagacagauucucaggcucaaaaucaggcacaagcgcaacccuaggcauaaccggacuccaaaccggagacgaagccgacuacuacugcggaaccugggacacaagccuaagcgcaggcggagucuucggcucaggcacaaaaguaaccguacuc

SEQ ID NO: 56173 - RNA, 333 nt, Artificial Sequence
  derived and/or modified sequence opt11 from anti-HIV_048-111027_VR-Chain
caauccguccucacccaaccccccucagucuccgccgcccccggccaaaaagucaccaucuccugcuccggcuccaacuccaaccucggcaacaacuacgucuccugguaccaacaccuccccggcaccgccccccgccuccucaucuacgaagacaaaaaacgccccuccggcauccccgaccgcuucuccggcuccaaauccggcgccuccgccacccucgacaucaccggccuccaaaccggcgacgaagccgacuacuacugcggcaucugggacaccucccucuccgccggcggcgucuucggcaccggcaccaaagucaccguccuc

SEQ ID NO: 56174 - RNA, 333 nt, Artificial Sequence
  derived and/or modified sequence opt11 from anti-HIV_048-109721_VR-Chain
caauccguccucacccaaccccccucagucuccgccgcccccggccaaaaagucaccaucuccugcuccggcucauccuccgacaucggcuccaacuucgucuccugguaccaacaccuccccggcaccgccccccgccuccucaucuacgaaaacaaccgccgccccuccggcauccccgaccgcuucuccggcuccaaaucaggcaccuccgcaacccucgccaucaccggccuccaaaccggcgacgaagccgacuacuacugcggcaccugggacaccucccucaaccgcggcggcgucuucggcaccggcaccaaagucaccguccuc

SEQ ID NO: 56175 - RNA, 333 nt, Artificial Sequence
  derived and/or modified sequence opt11 from anti-HIV_048-109666_VR-Chain
caaucaguccugacccagcccccgagcaugagcgcggcaccgggcgaacgcguaaccauaagcugcagcggaagcucaagcaacaucggaaaccaccacguaagcugguaccaacaaaggcccgggaccgcgcccaaacuccugaucuacgaaaacaacgaacgcccgagcggaaucccagacagauucucgggcucaaaaucaggaucaagcgcgacccuggccauaaccggacuccagaccggagacgaggccgacuacuacugcggaaccugggacggacgccugaacauaggcggagucauaggcacaggcacaaaaguaaccguacuc

SEQ ID NO: 56176 - RNA, 333 nt, Artificial Sequence
  derived and/or modified sequence opt11 from anti-HIV_048-109196_VR-Chain
caauccguccucacccaaccccccuccgucuccgccgcccccggccaaaaagucaccaucuccugcuccggcuccuccuccaacaucggcaacaacuacgucuccugguaccaacaacuccccggcaccgcccccaaacuccucaucuacgaaaccaacaaacgccccuccggcauccccgaccgcuucuccggcuccaaauccggcaccucagccacccucgccaucaccggccuccaaaccggcgacgaagccgacuacuacugcggcaccugggacaccucccucuccggcggcggcgucuucggcaccggcaccaaagucaccguccuc

SEQ ID NO: 56177 - RNA, 333 nt, Artificial Sequence
  derived and/or modified sequence opt11 from anti-HIV_048-109051_VR-Chain
caaucaguccucacccaaccccccuccgucuccgccgcccccggccaaaaagucaccaucuccugcuccggcaacaacuccaacauggucaacaacuacaucuccugguaccaacuccuccccggcaccccccccaaacuccucaucuucaaaaacaacgaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56178 - RNA, 333 nt, Artificial Sequence
  derived and/or modified sequence opt11 from anti-HIV_048-108570_VR-Chain
caauccgcccucacccaaccacccuccgucuccgccgcccccggccaaaaagucaccaucucaugcuccggcaaauccuccaacaucggcaccaacuucgucuccugguaccaacaauuccccgaagccgcccccaaacuccucaucuacgacaacaacaaacgccccuccggcauccccgaccgcuucuccggcuccaaauccggcaccuccgccacccucggcaucaccggccuccaaaccggcgacgaagccgacuacuacugcggcaccugggacggcucccucuccaccggcggagucaucggcaccggcaccaaagucaccguacua

SEQ ID NO: 56179 - RNA, 327 nt, Artificial Sequence
  derived and/or modified sequence opt11 from anti-HIV_048-108033_VR-Chain
gaacucacccaaucccccuccgucuccgccgcccccggccaacgcgucaccaucuccugcuccggcaacuccuccaacaucggcaacaacuacgucuccugguaccaacuccuccccggcaccgcccccaaacuccucaucuacaaaaacgacaaacgccccuccggcauccccgaccgcuucuccggcuccaaauccggcaccuccgccacccucggcaucaccggccuccaaaccggcgacgaagccgacuacuacugcggcaccugggacaccucccucuccaccggcggcgucuucggcaccggcaccaaagucaccguccuc

SEQ ID NO: 56180 - RNA, 333 nt, Artificial Sequence
  derived and/or modified sequence opt11 from anti-HIV_048-107279_VR-Chain
caauccguccucacccaaccccccuccgucuccgccgcccccggccaaaaagucaucaucuccugcuccggcuccuccuccaacaucggcaaaaacuacgucuccugguaccaacaccuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacgccucccucuccgccggcggcguccucggcaccggcaccaaagucaccguccuc

SEQ ID NO: 56181 - RNA, 333 nt, Artificial Sequence
  derived and/or modified sequence opt11 from anti-HIV_048-106271_VR-Chain
caaucaguccuaacccaaccacccuccgucuccgccgcccccggccaaaaagucaccaucuccugcuccggcucccgcuccaacaucggcuccaacuacaucuccugguaccaacaacuccccggcaccgcccccaaacuccuaaucuacaaaaacgacaaacgccccuccggcauccccgaccgcuucuccggcuccaaauccggcaccuccgccauccucggcaucaccggccuccaaaccggcgacgaagccgacuacuacugcggcgcaugggacaccucccucuccgccggcggagucuucggcaccggcaccaaagucaccguccuc

SEQ ID NO: 56182 - RNA, 333 nt, Artificial Sequence
  derived and/or modified sequence opt11 from anti-HIV_048-106054_VR-Chain
caauccguccucacccaaccccccuccgucuccgccgcccccggccaacaagucaccaucuccugcuccggcuccacauccaacaucggcaacaacuacgucuccugguaccaacaaguccccggcaccgcccccaaacuccucaucuacgacaacaacaaccgccccucaggcauccccgaccgcuucuccggcuccaaauccggcaccuccgccacccucggcaucuccggccuccaaaccggcgacgaagccgacuacuacugcggaaccugggacaccucccucuccggcggcggcgucuucggcaccggcaccaaagucaccguccuc

SEQ ID NO: 56183 - RNA, 333 nt, Artificial Sequence
  derived and/or modified sequence opt11 from anti-HIV_048-104848_VR-Chain
caauccgcccucacccaacccgccuccgucuccggcucccccggccaauccaucaccaucuccugcaccggcaccucauccgacgucggcuacaacuacgucuccugguaccaacaacuccccggcaccgcccccaaacuacucaucuucgacaacgacgaccgccccuccgaaauccccgaccgcuucuccggcuccaaauccggcaccuccgccacccucggcaucaccggccuccaacccggcgacgaagccgacuacuacugcggcaccugggacuccucccucuccgccggcggcgucuucggcaccggaaccaaagucaccguccuc

SEQ ID NO: 56184 - RNA, 333 nt, Artificial Sequence
  derived and/or modified sequence opt11 from anti-HIV_048-104638_VR-Chain
caauccguccucacccaaccccccuccgccuccggaacccccggccaccgcgucaccaucuccugcuccggcaacuccuccaacaucggcggcaaccacgucuacugguaccaacaaguccccggcaccacccccaaacuccucaucuaccgcaacaacgaacgccccuccggcauccccgaccgcuucuccggcuccaaauccggcaccuccgccacccuaggaaucaccggccuccaaaccggcgacgaagccgacuacuacugcggcaccugggacaccucccucucagcaggcggcgucuucggcaccggcacaaaagucaccguccuc

SEQ ID NO: 56185 - RNA, 333 nt, Artificial Sequence
  derived and/or modified sequence opt11 from anti-HIV_048-104567_VR-Chain
caauccguccuaacccaaccccccuccgccuccggcacccccggccaacgcgucaccaucucaugcuccggcuccaacuccaacaucggcaccaacuucgucaacugguaccaacacguccccggccgcgcccccaaacuccuaaucuacaaaaacaccgaacgccccuccggcauccccgacagauucuccggcuccaaauccggcaccuccgcaacccucgacaucaccggccuccaaaccggcgacgaagccgacuacuacugcggcaccugggacaccucccucuccgccggcggcgucuucggcaccggcaccaaagucaccguccuc

SEQ ID NO: 56186 - RNA, 333 nt, Artificial Sequence
  derived and/or modified sequence opt11 from anti-HIV_048-102804_VR-Chain
caauccguccuaacccaaccccccuccgucuccaccgcccccggccaaaaagucaccaucuccugcuccggcuccuccuccaacaucggcuacuccuacgucuccugguuccaacaccuccccggcaccgcccccaaacuccucaucuacggcaacuccaaccgacccuccggcguccccgaccgcuucuccggcuccaaauccggcaccuccgccucccucgccaucaccggccuccaaaccggcgacgaagccgacuacuacugcggcaccugggacuccucccucuccgccggcggcgucuucggcaccggcaccaaagucaccguccuc

SEQ ID NO: 56187 - RNA, 333 nt, Artificial Sequence
  derived and/or modified sequence opt11 from anti-HIV_048-101676_VR-Chain
caauccguccucacccaaccccccuccgucuccggcgcccccggccaauccgucaccaucuccugcaccggcaccuccuccaacaucggcgacuucgacguccacugguaccaacaacuccccggcaccgcccccaaacuccuccucuacgaaaacaacaaacgccccuccggcauccccgaccgcuucuccggcuccaaauccggcaccuccgccacccucgccaucaccggccuacaaaccggcgacgaagccgacuacuacugcggcaccugggacggcucccucuccaccggcggcgucaucggcaccggcaccaaagucaccguccuc

SEQ ID NO: 56188 - RNA, 333 nt, Artificial Sequence
  derived and/or modified sequence opt11 from anti-HIV_048-097603_VR-Chain
caauccguccucacccaaccacccuccgucuccgccgcccccggccaaaaagucaccaucuccugcuccggcucaucauccaacaucggcaacaacuacgucuccugguaccaacaacuccccggcaccgcccccaaacuccucaucuacgacaccgucaaacgccccuccggcauccccgaccgcuucuccggcuccaaauccggcacauccgccacccucggcaucaccggccuccaaaccggcgacgaagccgacuacuacugcggaaccugggacuccucccucuccggcggcggcgucuucggcaccggcaccaaagucaccguccuc

SEQ ID NO: 56189 - RNA, 333 nt, Artificial Sequence
  derived and/or modified sequence opt11 from anti-HIV_048-097107_VR-Chain
caauccguccucacccaaccccccuccgucuccgccgcccccggccaaaaagucaccaucuccugcuccggcuccuccuccaacaucgaaaacaacuacgucuccugguaccgccaaguccccggcaccgcccccaaacuccucaucuacaaaaacgacaaccgccccuccggcauccccgaccgcuucuccggcuccaaauccggcaccuccgccacccucggcaucaccggccuccaaaccggcgacgaagccgacuacuacugcggcaucugggacacaucccucuccgccggcggcgucuucggcaccggcaccaaagucaccguccuc

SEQ ID NO: 56190 - RNA, 333 nt, Artificial Sequence
  derived and/or modified sequence opt11 from anti-HIV_048-096871_VR-Chain
caacccguccucacccaaccccccuccgccuccggcacccccggccaacgcgucaccaucuccugcuccggcuccuccuccaacaucggcuccaacuacgucuacugguaccaacaacuccccggcaccacccccaaacuccucaucuaccgcaacaaccaacgccccuccggcauccccgaccgcuucuccggcuccaaauccggcaccuccgccacccucggcaucaccggccuccaaaccggcgacgaagccgacuacuacugcggcaccugggacaccucccucuccaccggcggcgucuucggcaccggcaccaaagucaccguccuc

SEQ ID NO: 56191 - RNA, 333 nt, Artificial Sequence
  derived and/or modified sequence opt11 from anti-HIV_048-096668_VR-Chain
caaucaguccucacccaaccccccuccgucuccgccgcccccggccaaaaagucaccaucuccugcuccggcuccggcuccaacaucggcaacaacuacgucuccugguaccaacaacuccccggcaccgcccccaaacuccucaucuacaaaaacaccgaacgacccuccggcauccccgaccgcuucuccggcucaaaauccggcaccuccgccacccucgacaucaccggccuccaaaccggcgacgaagccgacuacuacugcggcaccugggacaccucccucuccgccggcggcgucuucggcaccggcacaaaaguaaccguccuc

SEQ ID NO: 56192 - RNA, 333 nt, Artificial Sequence
  derived and/or modified sequence opt11 from anti-HIV_048-095236_VR-Chain
caauccguccucacccaaccccccuccguaucagccccccccggccaaaaagucaccaucuccugcuccggcaccaccuccaacaucggcuccaacuacgucgccugguaccaacaacuacccggcaccgcccccaaacucgucaucuacgaaaacuccaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56193 - RNA, 333 nt, Artificial Sequence
  derived and/or modified sequence opt11 from anti-HIV_048-094155_VR-Chain
caaucaguccuaacccaacccccaagcgucagcgcagccccaggccaaaaaguaaccgucagcugcuccggcagcucauccgacaucggagaaaacuacgucagcugguaccaacaauuccccgaaaccgcccccaaacuccuaaucuacgacaacaacaaacgccccagcggaaucccagacagauucucaggcucaaaaucaggcacaagcgccacccucgccaucaccggacuccaaaccggagacgaagccgacuacuacugcggcaccugggacucaagccucagcgcaggcggagucuucggcacaggcacaaaagucaccguccuc

SEQ ID NO: 56194 - RNA, 333 nt, Artificial Sequence
  derived and/or modified sequence opt11 from anti-HIV_048-093219_VR-Chain
caaccccuccucacccaaccacccgccgucuccgccacccccggccaacgcgucaccaucuccugcaccggcuccuccuccaacaucggccgcaccuucgucaacugguaccaacaacuccccggcaccgcccccaaacuccucaucuacgaaaacuccaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56195 - RNA, 333 nt, Artificial Sequence
  derived and/or modified sequence opt11 from anti-HIV_048-092976_VR-Chain
caauccguccucacccaaccccccuccgucuccgccgccuccggccaaaaagucaccaucuccugcuccggcuccuccuccaacaucggcaacaacuacgucuccugguaccaacaccuccccggcaccgcacccaaacuccucaucuacaaaaacgacaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcacaggcaccaaagucaccguccuc

SEQ ID NO: 56196 - RNA, 333 nt, Artificial Sequence
  derived and/or modified sequence opt11 from anti-HIV_048-090866_VR-Chain
caauccguccucacccaaccccccuccgucuccgccgcccccggccaaaaagucaccaucuccugcuccggcucccgcuccaacaucggcucaaacuacaucuccugguaccaacaacuccccggcaccgcccccaaacuccucaucuacgacaacaacaaacgccccuccggcauccccgaccgcuucuccggcuccaaauccggcaccuccgccacccucggcaucaccggccuccaaaccggcgacgaagccuacuacuacugcggcaccugggacaccucccucuccgccggcggcgucuucggcuccggcaccaaagucaccguccuc

SEQ ID NO: 56197 - RNA, 333 nt, Artificial Sequence
  derived and/or modified sequence opt11 from anti-HIV_048-090650_VR-Chain
caauccgcccucacccaacccgccuccgucuccggcucccucggccaauccaucaccaucuccugcuccggcuccuccuccaccaucggcaacaacuacgucuccugguaccaaguccuccccggcgccgcccccaaacuccucaucugcaaaaacaacgaacgacccuccggcauccccgaccgcuucucaggcuccaaauccggcaccuccgccacccucggcaucaccggccuccaaaccggcgacgaagccgacuacuacugcggcaccugggacaccucccuauccgccggcggcgucuucggcacaggcaccaaagucaccguccuc

SEQ ID NO: 56198 - RNA, 333 nt, Artificial Sequence
  derived and/or modified sequence opt11 from anti-HIV_048-089009_VR-Chain
caauccguccucacccaaccccccuccgucuccgccgcccccggccaaaaagucaccaucuccugcuccggcggcuccuccaacaucggcaacaacuacgucucaugguaccaacaacuccccgaaaccgcccccaaacucaucaucuacgacaacaacaaacgccccuccggcauccacgaccgcuucucaggcuccaaauccggcaccuccgccacccucgacaucaccgcccuccaaaccggcgacgaagccgacuacuacugcggcaccugggacaccucccucuccgccggcggcgucuucggcaccggcaccaaagucaccguccuc

SEQ ID NO: 56199 - RNA, 333 nt, Artificial Sequence
  derived and/or modified sequence opt11 from anti-HIV_048-088654_VR-Chain
caauccgcccucacacaaccccgcuccgucuccgccgcccccggccaaaaagucuccaucuccugcuccggccgcuccaccaaccucggcuacaacuacgucuccugguaccaacaccuccccggcgccgcccccaaaguccuaaucuacgaaaacaacaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56200 - RNA, 333 nt, Artificial Sequence
  derived and/or modified sequence opt11 from anti-HIV_048-086513_VR-Chain
caauccgcccucacccaaccccccuccgucuccgccgcccccggccaaaaagucaccaucuccugcuccggcuccaccuccaacaucggcaacaacuacgucuccugguaccaacaacuccccggcaccgcccccaaacuccucaucuacaaaaacgacaaccgccccuccggcauccccgaccgcuucucauccuccaaaucaggcaccuccgccacccucggcaucaccggccuccaaaccggcgacgaagccgacuacuacugcggcaucugggacaccucccucuccgccggcggcgucuucggcaccggcaccaaagucaccguccuc

SEQ ID NO: 56201 - RNA, 324 nt, Artificial Sequence
  derived and/or modified sequence opt11 from anti-HIV_048-086024_VR-Chain
cucgcccaaccccccuccgucuccggcacccccggccaacgcgucaccaucuccugcuccggcuccuccuccaacaucggcuccaacgccgucaacugguaccaacaauuccccggcaccgcccccaaacuccucaucuacgacaccgacaaacgccccuccggcauccccgaccgcuucuccggcuccaaauccggcaccuccgccauccucggcaucaccggccuccaaaccggcgacgaagccgacuacuacugcggcgccugggacaccucccucuccgccggcggcgucuucggcaccggcaccaaagucaccguccuc

SEQ ID NO: 56202 - RNA, 333 nt, Artificial Sequence
  derived and/or modified sequence opt11 from anti-HIV_048-085857_VR-Chain
caaucagcccucacccaaccccgcuccgucuccggcucccucggccaauccgucaccaucuccugcaccggcacaaccuccgacgucggcuucgacuacgucuccugguaccaaguccuccccggcaccgcccccaaacuccucaucuacaaaaacgacaaacgacccuccggcauccccgaccgcuucuccggcuccaaauccggcaccuccgccacccucggcaucaccggccuccaaaccggcgacgaagccgacuacuacugcggcaccugggacaccucccucuccaccggcggcgucuucggcaccggcaccaaagucaccguccuc

SEQ ID NO: 56203 - RNA, 333 nt, Artificial Sequence
  derived and/or modified sequence opt11 from anti-HIV_048-084277_VR-Chain
caauccguccuccgacaaccacccucccuauccggcgcccccggccaacgcgucacccucuccugcaccggcuccuccuccaacaucggcggcuacgacguccacugguaccaacacguccccggcaccgcccccaaacuccucaucuacgaaaacaccaaacgccccuccggcauccccgaccgcuucuccggcucaaaauccggcaccuccgccacccucggcaucaccggccuccaaaccggcgacgaagccgacuacuacugcggcaccugggacaccucccucuccgccggcggcgucuucggcuccggcacaaaagucaccguccuc

SEQ ID NO: 56204 - RNA, 333 nt, Artificial Sequence
  derived and/or modified sequence opt11 from anti-HIV_048-084245_VR-Chain
caauccacccucacccaaccccccuccgucuccgccgcccccggccaaaaagucaccaucuccugcuccggcuccaacuccaacaucggcaaacacuacgucuccugguaccaacaauuccccggcgccguccccaaacuccucaucuacgaaaacaaaaaacgccccuccggcauccccgaccgcuucuccggcuccaaauccgacaccuccgccacccucgacaucaccggccuccaaaccggcgacgaagccgacuacuacugcggcaccugggacaccucccucuccgccggcggcgucuucggcuccggcaccaaagucaccguccuc

SEQ ID NO: 56205 - RNA, 333 nt, Artificial Sequence
  derived and/or modified sequence opt11 from anti-HIV_048-082487_VR-Chain
caaucccuccucacccaaccccccuccgucuccgccgcccccggccaaaaagucaccaucuccugcuccggcuccuccuccaccaucggcaacaacuacgucuccugguaccaaguccuccccggcgccgcccccaaacuccucaucugcaaaaacaacgaacgccccuccggcauccccgaccgcuucuccggcuccaaauccggcaccuccgccacccucggcaucaccggccuacaaaccggcgacgaagccgacuacuacugcggcaccugggacaccucccucuccgccggcggcgucuucggcuccggcaccaaaguaaccguccuc

SEQ ID NO: 56206 - RNA, 333 nt, Artificial Sequence
  derived and/or modified sequence opt11 from anti-HIV_048-081787_VR-Chain
caauccguccucacccaaccacccuccgucuccggcgcccccggccaacgcguaaccaucuccugcaccggcuccuccuccaacaucggcuccuacgacguccacugguaccaacaacuccccggcaccgcccccaaacuccuaaucuacgaaaacuccaaacgccccuccggcauccccgaccgcuucuccggcuccaaaucaggcaccuccgccacccucggcaucaccggccuccaaaccggcgacgaagccgacuacuacugcggcaccugggacaccucccucuccggcggcggcgucuucggcaccggcaccaaagucaccguccuc

SEQ ID NO: 56207 - RNA, 333 nt, Artificial Sequence
  derived and/or modified sequence opt11 from anti-HIV_048-081062_VR-Chain
caauccguccucacccaaccccccuccgucuccgccgcccccggccaaaaagucaccaucuccugcuccggcaccuccuccaacaucggcgccaacuacgucuccugguaccaacaaguccccggcaccgcccccaaacuccucaucuacgaaaacaacaaacgccccuccggcacccccgaccgcuucuccggcuccaaauccggcaccuccgccacccucggcaucaccggccuccaaaccggcgacgaagccgacuacuacugcggcaccugggacaccucccucuccgccggcggagucuucggcuccggcaccaaagucaccguccuc

SEQ ID NO: 56208 - RNA, 333 nt, Artificial Sequence
  derived and/or modified sequence opt11 from anti-HIV_048-079639_VR-Chain
caauccguccucacccaaccacccuccgucuccgccgcccccggccaaaaagucaccaucuccugcuccggcuccuccuccaacaucggcaaaaacuacgucuccugguaccaacaccuccccggcaccgcccccaaacuccucaucuacgaaaacaacaaacgccccuccggcauccccgaccgcuucuccggcuccaaauccggcaccgccgccacccucggcaucaccggccuacaaaccggcgacgaagccggcuacuacugcggcaccugggacaccucccucuccgccggaggcgucuucggcaccggcaccaaagucaccguccuc

SEQ ID NO: 56209 - RNA, 333 nt, Artificial Sequence
  derived and/or modified sequence opt11 from anti-HIV_048-079126_VR-Chain
caauccguccucacccaaccccccuccgucuccgccgcccccggccaaaaagucaccaucuccugcucaggcuccuccuccaacaucggcaacaacuacgucuccugguaccaacaccuacccggcaccccccccaaacuccucaucuucaaaaacaacgaacgccccuccggcaucccagaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56210 - RNA, 333 nt, Artificial Sequence
  derived and/or modified sequence opt11 from anti-HIV_048-073118_VR-Chain
caauccguccucacccaaccccccuccgucuccgccgccccccgccacaacgucaccaucuccugcuccggcggcuccuccaacaucggcaacaacuucgucuccugguaccaauaccuccccggcaccgcccccaaacuccucaucuacgacaacaacaaacgccccuccggcauccccgaccgcuucuccggcuccaaauccggcaccuccgccacccucggcaucaccggccuccaaaccggcgacgaagccgacuacuacugcgccaccugggacaccucccucuccgccggcggcgucuucggcaccggcaccaaagucaccguccuc

SEQ ID NO: 56211 - RNA, 333 nt, Artificial Sequence
  derived and/or modified sequence opt11 from anti-HIV_048-070264_VR-Chain
caauccguccucacccaaucccccuccgucuccgccgcccccggccaaaaagucaccaucuccugcuccggcaccuccucaaacaucggcaacaccuacgucuccugguaccaacaacuccccggcaccgcccccaaacuccucaucuacaaaaacgacaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucacaguccuc

SEQ ID NO: 56212 - RNA, 333 nt, Artificial Sequence
  derived and/or modified sequence opt11 from anti-HIV_048-069426_VR-Chain
caaucaguccuaacccaaccccccuccgucuccgccgcccccggccaaaaagucaccaucuccugcuccggcuccuccuccaccaucggcaacaacuacgucuccugguaccaacaacuacccggaaccgcacccaaacuccucaucuacaaaaacaacaaacgccccuccggcguccccgaccgcuucuccggcuccaaauccggcaccuccgcaacccccggcaucaccggccuccaaaccggcgacgaagccgacuacuacugcggcaccugggacaccucccucuccgccggcggcgucuucggcaccggcaccaaagucaccguccuc

SEQ ID NO: 56213 - RNA, 333 nt, Artificial Sequence
  derived and/or modified sequence opt11 from anti-HIV_048-068564_VR-Chain
caauccgcccuaacccaaccccgauccgucuccggcucccccggccaauccgucgccaucuccugcaccggcaccuccuccgacgucggcuacaacuacgucuccugguaccaaguccuacccggcaccgcccccaaacuccucaucuacaaaaacaacgaacgccccuccggcauccccgaccgcuucuccggcuccaaauccggcaccuccgccacccucggcaucaccggccuccaaaccggcgacgaagccgacuacuacugcggaaccugggacaccucccucuccgccggcggcgucuucggcaccggcaccaaagucaccguccuc

SEQ ID NO: 56214 - RNA, 333 nt, Artificial Sequence
  derived and/or modified sequence opt11 from anti-HIV_048-068345_VR-Chain
caauccguccucacccaaacccccuccgucuccgccgcccccggccaacgcgucaccaucuccugcuccggcuccaccuccaacaucggcaacaacuacgucuccugguaccaacaacuccccggcaccgcccccaaacuccucaucuacgaaaacaacaaacgccccuccggcauccgcgaccgcuucuccgccuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56215 - RNA, 333 nt, Artificial Sequence
  derived and/or modified sequence opt11 from anti-HIV_048-067337_VR-Chain
caauccguccucacccaaccccccucagucuccgccgcccccggccaaaaagucaccaucuccugcuccggcgccuccuacaacaucggcaaaaacuccgucuccugguaccaacaacuccccggcaccgcccccaaacuccucaucuacaaaaacgacaaacgccccucaggaauccccgaccgcuucuccggcuccaaauccggcgccuccgccacccucgacaucaccggccuccaaaccggcgacgaagccgacuacuacugcggaaucugggacaccucccucuccgccggcggcgucuucggcaccggcaccaaagucaccguccuc

SEQ ID NO: 56216 - RNA, 333 nt, Artificial Sequence
  derived and/or modified sequence opt11 from anti-HIV_048-067180_VR-Chain
caauccguccucacccaaccccccuccgucuccgccgcccccggccaaaaagucaccaucuccugcuccggcuccucccccaacaucggcaacaacuacgucuccugguaccaacgccuccccggcaccgcccccaaacuccucaucuacgaaaacgaccaacgccccucuggcauccccgaccgcaucuccggcuccaaaucaggcacauccgccacccucggcaucaccggccuccaaaccggcgacgaagccgacuacuacugcggcaccugggacaccucccucuccaccggcggcgucuucggcaccggcaccaaagucaccguccuc

SEQ ID NO: 56217 - RNA, 333 nt, Artificial Sequence
  derived and/or modified sequence opt11 from anti-HIV_048-063017_VR-Chain
caauccguccucacccaaccccccuccgucuccgccgcccccggccaaaaagucaccaucuccugcuccggcuccuccuccaacaucggcaacaacuacgucuccugguaccaacaccaccccggcaaagcccccaaacucaugaucuacgaagucuccaaacgacccuccggaauccccgaccgcuucuccggcuccaaauccggcaccuccgccacccucggcaucaccggccuccaaaccggcgacgaagccgacuacuacugcggcaccugggacaccucccuaaaccgcggaggcgucuucggcaccggcaccaaagucaccguccuc

SEQ ID NO: 56218 - RNA, 333 nt, Artificial Sequence
  derived and/or modified sequence opt11 from anti-HIV_048-061885_VR-Chain
caauccguccucacccaaccccccuccgucuccgccgcccccggccaaaaagucaccaucuccugcuccggcuccuccuccaacaucggcucccacuacaucuccugguaccaacaauuccccggcgccgcccccaaacuccucaucuacgaaaacgacaaacgccccuccggcauccccgaccgcuucuccgccuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56219 - RNA, 333 nt, Artificial Sequence
  derived and/or modified sequence opt11 from anti-HIV_048-061671_VR-Chain
caauccguccucacccaaccccccuccgccuccggcacccccggccaacgcgucaccaucuccugcuccggcucccgauccaacaucggcuccaacuacgucuacugguaccaacaauuccccggcacagcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcgccaccugggacaccucccucuccgccggcggcgucuucggcaccggcacaaaagucaccguccuc

SEQ ID NO: 56220 - RNA, 333 nt, Artificial Sequence
  derived and/or modified sequence opt11 from anti-HIV_048-060700_VR-Chain
caaucgguccugacccagcucccgagccugagcgcggccccgggccaaaaagugaccauaagcugcagcggaagcucaagcaacaucggaaacaacuacguaagcugguaccaacaacugcccgggaccgcacccaaacuccuaaucuacgaaaacaacaaacgaccgagcggaaucccggacagguucucaggcucgaaaucaggcacaagcgcaacccuaggcauaaccggacuccagaccggagacgaggccgaauacuacugcgcgaccugggacgcgagccugagcggaggcggagucuucggcacaggcacaaaaguaaccguacuc

SEQ ID NO: 56221 - RNA, 333 nt, Artificial Sequence
  derived and/or modified sequence opt11 from anti-HIV_048-060592_VR-Chain
caauccguccucacccaaccccccuccgucuccgccgcccccggccaaaaagucaccaucuccugcuccggcuccuccuccaacaucggcaaaaacuacgucuccugguaccaacaauuccccggaaccgcccccaaacuccucaucuacgaaaacaacaaacgccccuccggcauccccgaccgcuucuccgccuccaaauccgccaccuccgccacccucgucaucaccggccuccaaaccggcgacgaagccgucuacuacugcggcaccugggacaccucacucuccgccggcggcgucuucggcuccggcaccaaagucaccguccuc

SEQ ID NO: 56222 - RNA, 333 nt, Artificial Sequence
  derived and/or modified sequence opt11 from anti-HIV_048-060300_VR-Chain
caacccguccucacccaaccccccuccgccuccggcacccccggccaacgcgucaccaucuccugcuccggcuccuccuccaacaucggcaccaacaccgucaacugguaccaacaauuccccggcaccgcccccaaacuccucaucuacaaaaacaacgaacgccccuccggcauccccgaccgcuucuccggcuccaaauccggcaccuccgccacccucggcaucaccggccuccaaaccggcgacgaagccgacuacuacugcggcaccugggacaccucccucuccggcggcggcgucuucggcaccggcaccaaagucaccguccuc

SEQ ID NO: 56223 - RNA, 333 nt, Artificial Sequence
  derived and/or modified sequence opt11 from anti-HIV_048-059141_VR-Chain
caacccguccucacccaaccccccuccgccuccggcacccccggccaacgcgucuccaucuccugcuccggaaacuucuccaacaucggcuccaaauacgucuacugguaccaacaaauccccggcaccgcccccaacgucaucaucuaccgcaccaaccuacgccccuccggcauccccgaccgcuucuccgccuccaaaucaggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56224 - RNA, 333 nt, Artificial Sequence
  derived and/or modified sequence opt11 from anti-HIV_048-057777_VR-Chain
caauccguccucacccaaccccccucccucuccgccgcccccggccaacgcgucaccaucuccugcuccggcuccuccuccaacaucggcaacaacuacgucucaugguaccaacaauuccccggcaccgcccccacccuccucaucuacgaaaacgacaaacgccccuccggcauccccgaccgcuucuccgccuccaaauccggcaccuccgccacccucggcaucaccggacuccaagccggcgacgaagccgacuacuacugcggcaccugggacaccucccucuccgccggcggcgucuucggcaccggcaccaaagucaccguccuc

SEQ ID NO: 56225 - RNA, 333 nt, Artificial Sequence
  derived and/or modified sequence opt11 from anti-HIV_048-056928_VR-Chain
caauccguccucacccaaccccccuccguauccgccgcccccggccaaaaagucaccaucuccugcuccggcuccuccuccaccaucggaaacaacuacgucuccugguaccaacuccuccccggcaccgcccccaaacuccucaucuacgacaacgacaaccgccccuccgacauccccgaccgcuucuccggcuccaaauccggcaccuccgccacccucggcaucaccggccuccaaaccggcgacgaagccgacuacuacugcggcgccugggacaccucacucuccgccggcggcgucuucggcaccggcaccaaagucaccguccuc

SEQ ID NO: 56226 - RNA, 333 nt, Artificial Sequence
  derived and/or modified sequence opt11 from anti-HIV_048-056131_VR-Chain
caauucguccucacccaacccgccuccgucuccggaucccccggccaauccaucaccaucuccugcuccggcaccuccuccgacgucggcuacaacuacgucuccugguaccaacaacuccccggcaccgcacccaaacuccuaaucuacgaaaacaccaaacgccccuccggcauccccgaccgcuucuccggcuccaaauccggcaccuccgccacccucggcaucaccggccuccaaaccggcgacgaagccgacuacuacugcggaaccugggacaccucccucuccgccggcggcgucuucggcuccggcaccaaagucaccguccuc

SEQ ID NO: 56227 - RNA, 333 nt, Artificial Sequence
  derived and/or modified sequence opt11 from anti-HIV_048-055864_VR-Chain
caauccguccucacccaaccccccuccgucuccgucgcccccggccaaaaagucaccaucuacugcuccggcuccucauccaacaucggaaaaaacuccgucuccugguacguccaaguccccggcaccgcccccaaauuccucaucuacgaaaacaaccaacgccccuccggcaucuccgaccgcuucuccggcuccaaauccggcaccuccgccacccucggcaucuccggccuccaaaccggcgacgaagccgacuacuacugcggcaccugggacaccucccucuccggcggcggcgucuucggcaccggcaccaaagucaccguccuc

SEQ ID NO: 56228 - RNA, 333 nt, Artificial Sequence
  derived and/or modified sequence opt11 from anti-HIV_048-055094_VR-Chain
caauccguccucacccaaccccccuccgucuccggcgcccccggccaacgcgucaccaucuccugcuccgccucauccuccuccaucggcaacgacuucgucuccugguaccaacaacuccccggcacagcccccaaacuccucaucuccgaaaacaacaaacgccccuccggcauccccgaccgcuucuccggcuccaaauccggcacauccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56229 - RNA, 333 nt, Artificial Sequence
  derived and/or modified sequence opt11 from anti-HIV_048-054343_VR-Chain
caauccguccucacccaaccacccuccgucuccggcgcccccggccaacgcgucaccaucuccugcaccggcuccuccuccaacaucggcggcuacgacgucaacugguaccaacaacuccccggcaccgcccccaaacuccucaucuucaaaaacaacgaacgccccuccggcauccccgaccgcuucuccggcuccaaauccggcaccuccgccacccucggcaucaccggccuccaaaccggcgacgaagccgacuacuacugcggcaccugggacaccucccucucagccggcggcgucuucggcaccggcaccaaagucaccguccuc

SEQ ID NO: 56230 - RNA, 333 nt, Artificial Sequence
  derived and/or modified sequence opt11 from anti-HIV_048-054193_VR-Chain
caauccguccucacccaaccccccuccgucuccgccgcccccggccaaaaagucaccaucuccugcuccggcggcuccucaaacaucggcaacaacuacgucuccugguaccaccaaguccccggcaccgcacccaaacuccucaucuucgaaaacaacaaacgccccuccggcauccccgaccgcuucuccggcuccaaauccggcaccuccgccacacucggcaucaccggccuccaaaccggcgacgaagccgacuacuacugcggcaccugggacaccucccucuccggcggcggcgucuucggcaccggcaccaaagucaccguccuc

SEQ ID NO: 56231 - RNA, 333 nt, Artificial Sequence
  derived and/or modified sequence opt11 from anti-HIV_048-052521_VR-Chain
caauccguccucacccaaccccccuccgucuccgccgcccccggccaaaaagucaccaucuccugcuccggcuccuccuccaacaucggccgccacuccgucuccugguaccaacaacuccccggcaccgcccccaaacuccucaucuacgacaccgacaaacgccccuccggcauccccgaccgcuucuccggcuccaaauccggcaccuccgccacccucggcaucaccggccuccaaaccggcgacgaagccgacuacuacugcggcaccugggacaccucccucuccggcggcggcgucuucggcaccggcaccaaagucaccguccuc

SEQ ID NO: 56232 - RNA, 333 nt, Artificial Sequence
  derived and/or modified sequence opt11 from anti-HIV_048-049037_VR-Chain
caauccguccucacccaaccacccuccgucuccgccgcccccggccaaaaagucaccaucuccugcuccggcuccuccuucaacaucggcaacaacuacgucuccugguaccaacaccuccccggcaccgcccccaaacuccucaucuacgccgccgucacccgccccuccggcauccccgaccgcuucuccggcuccaaauccggcaccuccgccacccucgacaucaccggacuccaaaccggagacgaagccgacuacuacugcggcaccugggacaccucccucuccgccggcggcgucuucggcaccggcaccaaagucaccguccuc

SEQ ID NO: 56233 - RNA, 333 nt, Artificial Sequence
  derived and/or modified sequence opt11 from anti-HIV_048-048720_VR-Chain
caauccguccucacccaaccccccgccgucuccgccgcccccggccaacgcgucgccaucuccugcuccggcaccuccuccaacaucggcuccaaccucgucuccugguaccaacaacuccccggcaaagccccccgccuccucaucuacgacaacuacaaacgccccuccggcauccccgaccgcuucuccggcuccaaauccggcaccuccgccacccucggcaucaccggccuccaaaccggcgacgaagccgacuacuacugcggcaccugggacaccucccucuccaccggcggcgucuucggcaccggcaccaaagucaccguccua

SEQ ID NO: 56234 - RNA, 333 nt, Artificial Sequence
  derived and/or modified sequence opt11 from anti-HIV_048-048542_VR-Chain
caauccguccucacccaaccccccuccgucuccgccgcccccggccaaaaagucaccaucuccugcuccggcuccuccuccaacaucggaaacaacuucgucuccugguaccaacaacuccccggcaccgcccccaaacuccucaucuacaacaacgaccgccgccccuccggcguccccgaccgcuucuccgccuccaaauucggcaccgccgccacccucggcaucaccggccuacaaaccggcgacgaagccgacuacuacugcggcaccugggacuccucccucuccgccggcggcgucuucggcaccggcaccaaagucaccguccuc

SEQ ID NO: 56235 - RNA, 333 nt, Artificial Sequence
  derived and/or modified sequence opt11 from anti-HIV_048-047777_VR-Chain
caaucaguccucacccaaccccccuccgccuccggcacccccggccaacgcgucaccaucuccugcuccggcucauccgccaacaucggcaccaacuacgucuucugguaccaacaccuccccggcaccgcccccaaacuccucaucuacgaaaacaacaaacgccccuccggcauccccgaccgauucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56236 - RNA, 333 nt, Artificial Sequence
  derived and/or modified sequence opt11 from anti-HIV_048-046841_VR-Chain
caauccguccucacacaaccccccuccgucuccgccgcacucggccaaaaagucaccaucaccugcuccggcgacaacggcaacaucggcuaccacuacgucuccugguaccaacaagucggccgcgccgcccccaaacuccucaucuacgccaacaacaaacgccccuccggcauccccgaccgcuucuccggcuccaaauccggcaccuccgccacccucggcaucaccggccuccaaaccggcgacgaagccgacuacuacugcggcaccugggacaccucccuauccgccggcggcgucuucggcuccggcaccaaagucaccguccuc

SEQ ID NO: 56237 - RNA, 333 nt, Artificial Sequence
  derived and/or modified sequence opt11 from anti-HIV_048-046202_VR-Chain
caauccguccucacccaaccccccuccgucuccgccgcccccggccaaaaagucaccaucuccugcucaggcuccuccuccaacaucggcaacaacuacgucagcugguaccaacaccuccccggcaccgcccccaaacuccucaucuacgacaccuacaaacgccacucaggcguccccgaccgcuucuccaacuccaaauccggcaccuccgccacccucgccaucaccggccuccaaaccggagacgaaggcgacuacuacugcggcgccugggacaccucccucucagccggcggcgucuucggcaccggcaccaaagucaccguccuc

SEQ ID NO: 56238 - RNA, 333 nt, Artificial Sequence
  derived and/or modified sequence opt11 from anti-HIV_048-046059_VR-Chain
caauccguccucacccaaccccccuccgucuccgccgcccccggccaaaacgucaccaucuccugcuccggcaccuccuccaacaucgaaaacaacuacgucuccugguaccaaacacuccccggcaccgcccccaaacuccucaucuacgacaacaacaaacgccccuccggcauccccgaccgauucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56239 - RNA, 333 nt, Artificial Sequence
  derived and/or modified sequence opt11 from anti-HIV_048-043568_VR-Chain
caauccguccucacccaaccacccuccgucuccgccgcccccggccaaaaagucaccaucuccugcuccggcuccgacuccaacaucggcuccaacuacgucuccugguaccaacaacuccccggcgccgcccccaaacuccucaucuacaaaaacaacaaccgccccuccggcauccccgaccgcuucuccggcuccaaauccggcaccuccgccacccucggcaucuccggccuccaaaccggcgacgaagccgacuacuacugcggcaccugggacaccucccuauccggcggcggcgucuucggcaccggcaccaaagucaccguccuc

SEQ ID NO: 56240 - RNA, 333 nt, Artificial Sequence
  derived and/or modified sequence opt11 from anti-HIV_048-042713_VR-Chain
caauccguccucacccaaccccccuccgucuccgccgcacccggccaaaaagucaccaucuccugcuccggcucaucaucaaacaucggccgccacuacgucuccugguaccaacaacuccccggcaccgcccccaaacuccuaaucuacgacaacaacucccgccccuccggcauccccgaccgcuucuccggcuccaaauccggcaccuccgccacccucggcaucaccggccuccaaaccggcgacgaagccgacuacuacugcggcaccugggacaccucccucaaccgaggcggcgucuucggcaccggcacaaaagucaccguccuc

SEQ ID NO: 56241 - RNA, 333 nt, Artificial Sequence
  derived and/or modified sequence opt11 from anti-HIV_048-042440_VR-Chain
caauccguccucacccaaccccccuccgccuccggcacccccggccaacgcgucaccaucuccugcuccggcuccuccuccaacaucggcaccaacaccgucaacugguaccaacaacuccccggcaccgcccccaaacuccucaucuacgaaaacuccaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcucaggcaccaaagucaccguccuc

SEQ ID NO: 56242 - RNA, 333 nt, Artificial Sequence
  derived and/or modified sequence opt11 from anti-HIV_048-040511_VR-Chain
caauccguccucacccaaccccccuccgucuccgccgcccccggccaaaaagucaccaucuccugcuccggcuccuccuccaacaucggcaacaacuacgucuccugguaccaacaccuccccggcaccgcccccaaacuccucaucuacgaaaacaacaaacgcuccuccggcauccccgaacgcuucuccggcucccaauccggcaccuccgccacccucggcaucaccggccuccaaaccggcgacgaagccgacuacuacugcggcaccugggacaccucccucuccaccggcggcgucuucggcaccggcaccaaagucaccguccuc

SEQ ID NO: 56243 - RNA, 333 nt, Artificial Sequence
  derived and/or modified sequence opt11 from anti-HIV_048-039195_VR-Chain
caauccguccucacccaaccccccuccgucuccgccgcccccggccaacgcgucaccaucuccugcuccggcuccaccuccaacaucggcaaccacuacgucuccugguaccaacaacuccccggcaccgcccccaaacuccucaucuacgacaacggcaaccgccccuccggcauccccgaccgcuucuccggcuccaaauccggcaccuccgccacccucgacaucaccggccuccaaaccggcgacgaagccgacuacuacugcggcaccugggacaccucccucaaccgcggcggcgucuucggcaccggcaccaaagucaccguccuc

SEQ ID NO: 56244 - RNA, 333 nt, Artificial Sequence
  derived and/or modified sequence opt11 from anti-HIV_048-036935_VR-Chain
caauccguccucacccaaccacccuccauguccgccgcccccggcgaacgcgucaccaucuccugcaccggcuccuccuccaacaucggcggcuacgacguccacugguaccaacaacuccccggcaucgcccccaaaauccucaucuaccgcaacuccauccgccccuccggcauccccgaccgcuucuccggcuccaaauccggcaccuccgccacccucggcaucaccggccuccaaaccggcgacgaagccgacuacuacugcggaaccugggacaccucccucuccaccggcggcgucuucggcaccggcaccaaagucaccguccuc

SEQ ID NO: 56245 - RNA, 333 nt, Artificial Sequence
  derived and/or modified sequence opt11 from anti-HIV_048-034478_VR-Chain
caauccguccucacccaaccccccuccgucuccgccgcccccggccaaaaagucaccaucuccugcaccggcuccggcuccaacaucggcaacaacgacgucuccugguaccaacaacuccccggcaccgccccccgacuccucaucuacggcgacaacaaacgccccuccggcauccccgaccgcuucuccggcuccaaauccggcacauccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56246 - RNA, 333 nt, Artificial Sequence
  derived and/or modified sequence opt11 from anti-HIV_048-031641_VR-Chain
caauccguccucacccaaccccccuccgucuccgccgcccccggccaaaaagucaccaucuccugcuccggcaacaacuccaacaucggcaacaacuacgucuccugguaccaacaacuccccggaaccgcccccaaacuccucaucuacgaaaacuccaaacgccccuccggcauccccgaccgauucuccggcuccaaauccggcaccuccgccacccucggcaucaccggccuccaaaccggcgacgaagccgacuacuacugcggcaccugggacaccucccucuccgccggcggcgucuucggcucaggcaccaaagucaccguccuc

SEQ ID NO: 56247 - RNA, 333 nt, Artificial Sequence
  derived and/or modified sequence opt11 from anti-HIV_048-029760_VR-Chain
caauccgcccucacccaacccgccuccgucuccggcuccuccggccaauccaucaccaucuccugcaccggcaccaacuccgacgucggcuacgacuacgucugcugguaccaacaacuccccggcaccgcccccaaacuccucaucuacgaaaacaacaaacgccccuccggcauccccgaccgcuucuccggcuccaaaucaggcaccuccgccacccucggcaucaccggccuccaaaccggcgacgaagccgacuacuacugcggcaccugggacaccucccucuccgccggcggagucuucggcaccggcaccaaagucaccguccuc

SEQ ID NO: 56248 - RNA, 333 nt, Artificial Sequence
  derived and/or modified sequence opt11 from anti-HIV_048-027970_VR-Chain
caauccguccucacccaaccccccuccgucuccgccccccccggccaaaaagucaccaucuccugcuccggcaccaccuccaacaucggcuccaacuacgucgccugguaccaacaauuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcgccaccugggacaccucccucuccgccggcggcgucuucggcaccggcaccaaagucaccguccuc

SEQ ID NO: 56249 - RNA, 333 nt, Artificial Sequence
  derived and/or modified sequence opt11 from anti-HIV_048-027337_VR-Chain
caauccguccuaacccaaccccccuccgucuccgccgcccccggccaaaaagucaccaucuccugcuccggcuccuacuccaacaucggcaacaacuaccucuccugguaccaacaacuccccggaaccgcccccaaacuccucaucuacaaaaacaacaaacgccccuccggcguccccgaccgauucuccggcuccaaauccggcgccuccgccacccucgacaucaccggccuccaaaccggcgacgaagccgacuacuacugcggcaucugggacaccucccucuccgccggcggcgucuucggcaccggcaccaaagucaccguccuc

SEQ ID NO: 56250 - RNA, 333 nt, Artificial Sequence
  derived and/or modified sequence opt11 from anti-HIV_048-027217_VR-Chain
caauccguccuaacccaaccacccuccgucuccgccgcccccggccaaaaagucaccaucuccugcuccggcuccuccuccaucaucggcaacaacuacgucuccugguaccaacaacuccccggcaccgcccccaaacuccucaucuacgaaaacaacaaacgccccuccggcauccccgaccgcuucucaggcuccaaauccggcaccuccgccacccucgccaucgccggccuccaaaccggcgacgaagccgacuacuacugcgccaccugggacaccucccucuccgccggcggcgucuucggcacaggcaccaaagucaccguccuc

SEQ ID NO: 56251 - RNA, 333 nt, Artificial Sequence
  derived and/or modified sequence opt11 from anti-HIV_048-026760_VR-Chain
caauccguccuaacccaaccacccuccgucuccgccgcccccggccaaaaagucaccaucuccugcuccggcuccuccuccaacaucggcaacaacuacgucuccugguaccaacaccuccccggcaccgcccccaaacuccucaucuacgacaccgucaaacgccacuccggcguccccgaccgcuucuccggcuccaaaucaggcaccuccgccacccucggcaucuccggccuccaaaccggcgacgaagccgacuacuacugcggcaccugggacaccucccucuccgccggcggcgucuucggcuccggcaccaaagucaccguccuc

SEQ ID NO: 56252 - RNA, 333 nt, Artificial Sequence
  derived and/or modified sequence opt11 from anti-HIV_048-024800_VR-Chain
caaucaguccuaacccaacccccaagcguaagcgcagccccaggccaaaaaguaaccauaagcugcagcggaagcuacagcaacaucggaaacaacuacguaagcugguaccaaguccuacccggaaccgcacccaaacuccucaucuacaaaaacaacgaacgcccaagcggaaucccagacagauucucaggcucaaaaucaggcacaagcgcaacccuaggcauaaccggacuccaaaccggagacgaagccgacuacuacugcggaaccugggacacaagccuaagcgcaggcggcgucuucggcacaggcacaaaaguaaccguacuc

SEQ ID NO: 56253 - RNA, 333 nt, Artificial Sequence
  derived and/or modified sequence opt11 from anti-HIV_048-024313_VR-Chain
caauccguccucacccaaccacccuccgucuccgccgcccccggccaaaaagucaccaucuccugcuccggcuccuccuccaccaucggcaacucacacgucuccugguaccaaauccuccccggcaccgcccccaaacuccucaucuacaaagacgacaaacgccccuccggcauccccgaccgcuucuccggcuccaaauccggcaccuccgccacccucggcaucaccggccuccaaaccggcgacgaagccgacuacuacugcggcaccugggacaccucccucaaccgcggcggcgucuucggcaccggcaccaaagucaccguccuc

SEQ ID NO: 56254 - RNA, 333 nt, Artificial Sequence
  derived and/or modified sequence opt11 from anti-HIV_048-021748_VR-Chain
caaucggucuuaacccagcccccgagcgugagcgcggccccgggccagcgcgugaccauaagcuguagcgggagcacgagcaauaucgggaacaauuacgugagcugguaccagcaauugcccgggaccgcgcccaagcucuugaucuaugaaaauaacaagcgcccgagcgggaucccggacagguucucgggcucgaaaucgggcacgagcgcgaccuugggcauaagcgggcuccagaccggggacgaggccgauuacuauugcgggaccugggacucgagcuugagcggaggcggggucuuuggcacgggcacgaaagugaccgugcuc

SEQ ID NO: 56255 - RNA, 333 nt, Artificial Sequence
  derived and/or modified sequence opt11 from anti-HIV_048-020991_VR-Chain
caauccguccucacccaaccccccuccgccuccggcacccccggccaaaaagucaccaucuccugcuccggcuccuccuccaccaucggcaacaacuacgucuccugguaccaaguacuccccggcaccgcccccaaacuccucaucuacaaaaacgacaaacgccccuccggcauccccgaccgcuucuccggcuccaaauccggcaccucagccacccucggcaucaccggccuccaaaccggcgacgaagccgacuacuacugcggcaccugggacaccucccucuccaccggcggcgucuucggcaccggcaccaaagucaccguccuc

SEQ ID NO: 56256 - RNA, 333 nt, Artificial Sequence
  derived and/or modified sequence opt11 from anti-HIV_048-020340_VR-Chain
caauccguccucacccaaccccccuccgucuccgccgcccccggccaacgcgucaccaucuccugcuccggcuccuccuccaacgucggcaacaacuacgucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggagacgaagccgacuacuacugcggcaccugggacgccucccucuccgccggcggcgucuucggcaccggcaccaaagucaccguccuc

SEQ ID NO: 56257 - RNA, 333 nt, Artificial Sequence
  derived and/or modified sequence opt11 from anti-HIV_048-019993_VR-Chain
caauccguccucacccaaccccccuccgucuccggcgcccccggccaacgcgucaccaucuccugcaccggcuccuccuccuccaucggcggcuucgacguccacugguaccaacgccuccccggaaccgccccccgccuccucaucuacgaaaacaacaaacgccccuccggcaucccagaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56258 - RNA, 333 nt, Artificial Sequence
  derived and/or modified sequence opt11 from anti-HIV_048-019947_VR-Chain
caaucggucuugacccagcccccgagcgugagcgcggccccgggccagcgcgugaccauaagcuguagcgggagcucgagcaauaucgggagcaaguacgugagcugguaccagcaauugcccgggaccgcgcccaagcucuugaucuaugaaaacagcaagcgcccgagcgggaucccggacagguucucgggcucgaaaucgggcacgagcgcgaccuugggcauaaccgggcuccagaccggggacgaggccgauuacuauugcgggaccugggacacgagcuuaagcacgggcggggucuuuggcacgggcacgaaagugaccgugcuc

SEQ ID NO: 56259 - RNA, 333 nt, Artificial Sequence
  derived and/or modified sequence opt11 from anti-HIV_048-017871_VR-Chain
caauccguccucacccaaccccccuccgucuccgccgcccccggccaaaaagucaccaucuccugcuccggcuccuccuccaacaucggcaaccgcuacgucuccugguaccaacaacuccccggcaccgcccccaaacuccucaucuacaaaaacaacaaacgccccuccggcauccccgaccgcuucuccggcuccaaauccggcaccuccgccacccucggcaucaccggccuacaaaccggcgacgaagccgacuacuacugcggcaccugggacggaucccucuccaccggcggcgucaucggcaccggcaccaaagucacaguccuc

SEQ ID NO: 56260 - RNA, 333 nt, Artificial Sequence
  derived and/or modified sequence opt11 from anti-HIV_048-015931_VR-Chain
caauccguccucacccaaccccccuccgucuccgccgcccccggccaaaaagucaccaucuccugcuccggcggcuccuccaacaucggcuccaccuacgucuccugguaccaacaaguccccggaaccgcccccaaacuacucaucuacgaaaacaacaaacgccccuccggcauccccgaccgcuucucaggcucaaaauccggcaccuccgccacccucgacaucaccggccuccaaaccggcgacgaagccgacuacuacugcggcaccugggacaccucccucuccggcggcggcgucuucggcaccggcaccaaagucaccguccuc

SEQ ID NO: 56261 - RNA, 333 nt, Artificial Sequence
  derived and/or modified sequence opt11 from anti-HIV_048-015920_VR-Chain
caaucccuccucacccaaccccccuccgucuccgccgcccccggccaaaaagucaccaucucaugcuccggcuccuccuccaccaucggaaacaacuacgucuccugguaccaaguccuccccggcaccgcccccaaacuccucaucuacaaaaacaacgaacgccccuccggcauccccgaccgcuucuccggcuccaaauccggcaccucagccacccucggcaucaccggccuccaaaccggcgacgaagccgaauacuacugcgccaccugggacgccucccucuccggcggcggcgucuucggcaccggcaccaaagucaccguccuc

SEQ ID NO: 56262 - RNA, 333 nt, Artificial Sequence
  derived and/or modified sequence opt11 from anti-HIV_048-013898_VR-Chain
caauccguccucacccaaccccccuccgucuccgccgcccccggccaaaaagucaccaucuccugcuccggcuccuccuccaacaucggcaaacacuccgucuccugguaccaacaacuccccggcaccgcccccgaacuccucaucuacgacaacaacaaccgccccuccggcauccccgaccgcuucuccggcucaaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56263 - RNA, 333 nt, Artificial Sequence
  derived and/or modified sequence opt11 from anti-HIV_048-013429_VR-Chain
caauccguccucacccaaccacccuccgucuccgcagcccccggccaaaaagucaccaucuccugcuccggcuccuccuccaacaucggcaacaacuacgucuccugguaccaacaacuccccggcaccgcccccacccuccucaucuacgaaaacgacaaacgccccuccggcauccccgaccgcuucuccggcuccaaauccggcaccucagccacccucggcaucaccggccuccaaaccggcgacgaagccgacuacuacugcggcaccugggacuccucccucuccgccggcggcgucuucggcaccggcaccaaagucaccguccuc

SEQ ID NO: 56264 - RNA, 333 nt, Artificial Sequence
  derived and/or modified sequence opt11 from anti-HIV_048-012358_VR-Chain
caaucaguccucacccaaccccccuccgucuccgccgcccccggccaaaaagucaccaucuccugcuccggcuccaacuccgccaucggcaacaacuacgucuccugguaccaaguccuacccggcaccgcccccaaacuccucaucuacaaaaacaacgaacgccccuccggcauccccgaccgcuucucaggcuccaaauccggcaccuccgccacccucgacauaaccggccuccaaaccggcgacgaagccgacuacuacugcggcaccugggacaccucccucuccgccggcggcgucuucggcaccggcaccaaagucaccguccuc

SEQ ID NO: 56265 - RNA, 333 nt, Artificial Sequence
  derived and/or modified sequence opt11 from anti-HIV_048-011158_VR-Chain
caauccguccucacccaaccccccuccgucuccgccgcccccggccaaaaagucaccaucuccugcuccggcaucuccuccaacaucggcaacaacgacgucuccugguaccaacaacuccccggcaccgcccccaaacuccucaucuacgacaacgacaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56266 - RNA, 333 nt, Artificial Sequence
  derived and/or modified sequence opt11 from anti-HIV_048-010720_VR-Chain
caauccguccucacccaaccccccuccgucuccgccgcccccggccaaaaagucaccaucuccugcuccggcucauccuccaacaucggcucccacuacgucuccugguaccaacaaguccccggcaccgccccccgccucgucaucuacgaaaacuccaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcuccggcaccaaagucaccguccuc

SEQ ID NO: 56267 - RNA, 333 nt, Artificial Sequence
  derived and/or modified sequence opt11 from anti-HIV_048-009445_VR-Chain
caauccguccucacccaaccccccuccgucuccgccgcccccggccaaaaagucaccaucuccugcuccggcuccuccuccaacaucggcaacaacuacgucuccugguaccaacaacuccccggcaccguccccaaacuccucaucuacgacaccuacacccgccccuccggcacccccgaccgcuucuccggcuccaaauccggcaccuccgccacccucgccaucaccggccuccaaaccggcgacgaagccgacuacuacugcggcaccugggacggcucccucuccaccggcggcgucaucggaaccggcaccaaagucaccguccuc

SEQ ID NO: 56268 - RNA, 324 nt, Artificial Sequence
  derived and/or modified sequence opt11 from anti-HIV_048-006126_VR-Chain
cagagcgugcucacgcaaccgcccucggucucgggcgcgcccgggcaaaaggucacaaucucgugcucgggcauaagcucgaacuuuggcauaagcugguaccagcaagugcccgggaccgcgcccaagcucuugaucuaugaaaaugacaagcgcccgagcgggaucccggacagauucucgggcucgaaaucgggcacgagcgcgaccuugggcauaaccgggcuccagaccggggacgaggccgauuacuauugcgggaccugggacacgagccugagcgcgggcggggucuuuggcacgggcacgaaagugaccgugcuc

SEQ ID NO: 56269 - RNA, 333 nt, Artificial Sequence
  derived and/or modified sequence opt11 from anti-HIV_048-005652_VR-Chain
caaucggucuugacccagcccccgagcgugagcgcggccccgggccagaaagugaccauaagcuguagcgggagcaauagcgcaaucggaaacaauuacgugagcugguaccaggucuugcccgggaccgcgcccaagcucuugaucuaugacacguacaagcgcgcgagcgggaucccggacagguucucgggcucgaaaucgggcacgagcgcgaccuugggcauaaccgggcuccagaccggagacgaggccgauuacuauugcgggaccugggacacgagcuugagcgggggcggggucuuuggcacgggcacgaaagugaccgugcuc

SEQ ID NO: 56270 - RNA, 333 nt, Artificial Sequence
  derived and/or modified sequence opt11 from anti-HIV_048-005532_VR-Chain
caauccguccucacccaaccccccuccgucuccgccgcccccggccaaaaagucaccaucuccugcuccggcaccuccuccaacaucggcaacaccuacgucuccugguaccaacaacuccccggcaccgcccccaacuaccucaucuacaaaaucgacaaacgccccuccggcauccccgaccgcuucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56271 - RNA, 333 nt, Artificial Sequence
  derived and/or modified sequence opt11 from anti-HIV_048-005189_VR-Chain
caaucggucuugacccagcccccgagcgugagcgcggccccgggccagaaagugaccauaagcuguagcgggagcgggagcacgaucgggaacaaugacgugagcugguaccagcaauuacccggggccgcgcccaagcucuugaucuaugaagauaacaagcgcccgagcgggaucccggccagguucucgggcucgaaaucgggcacgagcgcgaccuuacgcauaaccgggcuccagaccggggacgaggccgauuacuauugcgggaccugggacucgagcuugagcgcaggcggggucuuuggcacgggcacgcgcguaagcgugcuc

SEQ ID NO: 56272 - RNA, 333 nt, Artificial Sequence
  derived and/or modified sequence opt11 from anti-HIV_048-005088_VR-Chain
caauccguccucacccaaccccccuccgucuccgccgcccccggccaaaaagucaccaucuccugcucaggcuccuccuccaacaucggcaaaaacuacgucuccugguaccaacaacuccccggaaccgcccccaaacuccuaaucuacgacaacaacaaccgccccuccggcauccccgaccgcuucuccggcuccaaauccggcaccuccgccacccucggcaucaccggccuccaaaccggcgacgaagccgacuacuacugcggcgccugggacaccucccucuccgccggcggcgucuucggcaccggcaccaaagucaccguccuc

SEQ ID NO: 56273 - RNA, 333 nt, Artificial Sequence
  derived and/or modified sequence opt11 from anti-HIV_048-004023_VR-Chain
caaucaguccucacccaaccacccuccgucuccgccacccccggccaaaaagucaccaucuccugcuccggcggcuccuccaacaucggcaaaaacgacgucuccugguaccaacaacuccccggaaccgcccccaaacuccucaucuacgacaccaacaaacgccccuccggcauccccgaccgcuucuccgccgcccgcuccggcaccuccgccacccucgacaucaccggccuccaaaccggcgacgaagcagacuacuacugcggcaccugggacaccucccucuccgccggcggcgucuucggcaccggaacaaaagucaccguccuc

SEQ ID NO: 56274 - RNA, 333 nt, Artificial Sequence
  derived and/or modified sequence opt11 from anti-HIV_048-001580_VR-Chain
caauccguccucacccaaccccccuccgucuccgccgcccccggccaaaaagucaccaucuccugcuccggauccuccuccaacaucggcaacaacuacgucuccugguaccaacaacuccccggcaccgcccccaaacuccuccucuacgaaaacaacaaacgccccuccggcauccccgaccgcuucuccggcuccaaauccggcaccuccgccacccuagccaucaccggccuccaaaccggcgacgaagccgccuacuacugcggcaccugggacggcucccucuccaccggcggcgucaucggcaccggcaccaaagucaccguccuc

SEQ ID NO: 56275 - RNA, 333 nt, Artificial Sequence
  derived and/or modified sequence opt11 from anti-HIV_038-221120_VR-Chain
caaucaguccuaacccaacccccaagcguaagcgcagccccaggccaaaaaguaaccauaagcugcagcggaagcacaagcaacaucggcaaaaacuacgugagcugguaccaacaacuacccggaaccgcacccaaacuccugaucuacgacaacaacgaacgcccaagcggaaucccagacagauucucaggaucaaaaucaggcacaagcgcaacccuaggcauaaccggacuccaaaccggagacgaagccgacuacuacugcgcaaccugggacucaagccucagcggaggcggagucuucggcacaggcacacgcguaaccguacuc

SEQ ID NO: 56276 - RNA, 333 nt, Artificial Sequence
  derived and/or modified sequence opt11 from anti-HIV_038-197677_VR-Chain
caauccguccucacccaaccccccucagucuccgccgcccccggccaaaaagucaccgucuccugcuccggcuccaacuccaacaucggcaaccacuacgucuccugguaccaacaacuccccggcaccgcccccaaacuccucaucuacgacaacaacaaacgccccuccggcauccccgaccgcuucuccggcuccaaauccggcaccucagccacccucggcaucaccggccuccaaaccggcgacgaagccgacuacuacugcggcaccugggacuccucccucuccgccggcggcgucuucggcaccggcaccaaagucaccguccuc

SEQ ID NO: 56277 - RNA, 333 nt, Artificial Sequence
  derived and/or modified sequence opt11 from anti-HIV_038-196765_VR-Chain
cagagcgcgcucacgcaaccggccucggucucgggcucgcccgggcaaucgaucacgaucucaugcacgggcacgagcggggacgugggcuauaacuuggucucgugguaucaacagcucccgggcacggccccgaaagugcucauauacgagaacaauaaaaggcccucaggcauacccgaucgcuuuagcgggagcaagagcgggaccucggccacgcucgggaucacgggcuugcaaacgggcgaugaagcggacuauuacuguggcacgugggauagcucgcucucggccgggggcguguucgggaccgggaccaaggucacggucuug

SEQ ID NO: 56278 - RNA, 333 nt, Artificial Sequence
  derived and/or modified sequence opt11 from anti-HIV_038-186200_VR-Chain
caauccguccucacccaaccccccuccgccuccggcacccccggccaacgcaucaccaucuccugcuccggcaccuccuccaacaucggcuccaacaucgucuccugguaccaacaccuccccggcaccacccccaaacucgucaucuuccgcaacaaccaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56279 - RNA, 333 nt, Artificial Sequence
  derived and/or modified sequence opt11 from anti-HIV_038-126170_VR-Chain
caauccguccucacccaaccccccuccgucuccgccccccccggccaaaaagucaccaucuccugcuccggcaccaccuccaacaucggcuccaacuacgucgccugguaccaacaacuccccggcaccgcccccaaacuccucaucuacgacaacgucaaacgcccaacaaacauccccgaccgcuucuccggcuccaaauccggcaccuccgccacccuaggcaucaccggccuccaaaccggcgacgaagccgacuacuacugcggcaccugggacuccucccucuccgccggcggcgucuucggcaccggcaccaaagucaccguccuc

SEQ ID NO: 56280 - RNA, 333 nt, Artificial Sequence
  derived and/or modified sequence opt11 from anti-HIV_038-108545_VR-Chain
caaucaguccugacccagcccccaagcgcaagcggaaccccaggccaacgcguaaccauaagcugcagcggaagcucaagcaacaucggauacaacaccguaagcugguaccaacaacugcccggaaccgcacccaaacuccuaaucuacgaaaacaacaaacgcccaagcggaaucccagacagauucucaggcucgaaaucaggcacaagcgcaacccugggcauaaccggacuccagaccggagacgaagccgacuacuacugcgggaccugggacucaagccuaagcgcaggcggagucuucggcacaggcacaaaaguaaccguacuc

SEQ ID NO: 56281 - RNA, 333 nt, Artificial Sequence
  derived and/or modified sequence opt11 from anti-HIV_038-107263_VR-Chain
caaucaguccucacccaaccacccuccgccuccggcacccccggccaacgcgucaccaucuccugcuccggcuccuccuccaacaucggcuccaacaccgucaacugguaccaacaaguacccggcaccgcccccaaccuccucaucuacuccaacgaccaacgccccuccggcauccccgaccgcuucuccggcuccaaauccggcaccuccgcaacccuaggcaucaccggccuccaaaccggcgacgaagccgacuacuacugcggcaccugggacuccucccuauccgccggcggcgucuucggcaccggcaccaaagucaccguccuc

SEQ ID NO: 56282 - RNA, 333 nt, Artificial Sequence
  derived and/or modified sequence opt11 from anti-HIV_038-104530_VR-Chain
caaucggucuugacccagcccccgagcgugagcgcggccccgggccagaaagugaccauaagcuguagcgggagcucgagcaauaucgggagcaauuacgugagcugguaccagcacuugcccgggaaagcgcccaagcuauugaucuaugacaauaacaagcgcccgagcggaaucccggacagguucucgggcucgaaaucgggcacaagcgcgaccuugggcauaaccgggcuccagaccggggacgaggccgauuacuauugcggaaccugggacucgagcuugagcgcgggcggggucuuuggcacaggcacgaaagugaccgugcuc

SEQ ID NO: 56283 - RNA, 333 nt, Artificial Sequence
  derived and/or modified sequence opt11 from anti-HIV_038-099169_VR-Chain
caauccguccucacccaaccccccuccgccuccggcacccccggccaacgcgucuccaucuccugcuccggcaucaccuccucccucggcucaaaccacauguccugguaccaacaacuccccggcaccgcccccaaacuccucaucuacgaaaacaacaaacgccccucaggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56284 - RNA, 333 nt, Artificial Sequence
  derived and/or modified sequence opt11 from anti-HIV_038-075067_VR-Chain
caauccguccucacccaaccccccuccgucuccggcgcccccggccaacgcgucaccaucuccugcuccggcuccuccuccaccaucggcaacaacuacgucuccugguaccaacuccuccccggcaccgcccccaaacuacuaaucuacaaaaacaacaaacgccccuccggcauccccgaccgauucuccggcuccaaauccggcaccuccgccacccucggcaucaccggccuccaaaccggcgacgaagccgacuacuacugcggcaccugggacaccucccucuccgccggcggcgucuucggcaccggcaccaaagucaccguccuc

SEQ ID NO: 56285 - RNA, 333 nt, Artificial Sequence
  derived and/or modified sequence opt11 from anti-HIV_038-072368_VR-Chain
caauccguccucacccaaucccccuccgccuccggcacccccggccaacgcgucaccaucuccugcuccggcuccuccuccaacaucggcaacaacuacgucuccugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56286 - RNA, 333 nt, Artificial Sequence
  derived and/or modified sequence opt11 from anti-HIV_038-068503_VR-Chain
caauccguccucacccaaccccccuccgucuccgccgcccccggccaaauggucaccaucuccugcuccggcucccgcuccaacaucgaaaaccacuacgucuccugguaccaacaccuccccggcgccgcccccaaacuccucaucuacgacaacggcaaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56287 - RNA, 333 nt, Artificial Sequence
  derived and/or modified sequence opt11 from anti-HIV_038-068016_VR-Chain
caauccguccucacccaaccccccuccgccuccggcacccccggccaacgcgucaccaucuccugcuccggaucauccuccaacaucgaauccaacuucgucuacugguaccaacaauuccccggcaccacccccaaacuccuaaucuaccgcgacggccaacgccccuccggcauccccgaccgcuucuccggcuccaaauccggcaccuccgccacccucggcaucaccggccuccaaaccggcgacgaagccgacuacuacugcggcaccugggacuccucccucuccgccggcggcgucuucggcaccggcacaaaagucaccguccuc

SEQ ID NO: 56288 - RNA, 333 nt, Artificial Sequence
  derived and/or modified sequence opt11 from anti-HIV_038-063958_VR-Chain
caauccguccucacccaacccccauccgucuccggcgcccccggccaacgcgucaccaucuccugcaccggcuccuccuccaacaucggcaacuccggcguccacugguaccaacaacuccccggcaccgcccccaaacuccucaucuacgaaaacaacaaacgccccuccggcauccccgaccgcuucuccggcuccaaauccggcaccuccgccacccucggcaucaccggccuccaaaccggcgacgaagccgacuacuacugcggcaccugggacuccucccuauccgccggcggcgucuucggcaccggcaccaaagucaccguccuc

SEQ ID NO: 56289 - RNA, 333 nt, Artificial Sequence
  derived and/or modified sequence opt11 from anti-HIV_038-033733_VR-Chain
caauccguccucacccaaccccccuccgccuccggcacccccggccaacgcgucaccaucuccugcuccggcuccuccuccaacaucggcuccaaauacgucuacugguaccaacaacuccccggcaccgcacccaaacuccucaucuacgacaacgacaaacgccccuccggcauccccgaccgcaucucagccuccaaauccggcaccuccgccacccucgacaucacccgccuccaaaccggcgacgaagccgacuacuacugcggcaccugggacuccucccucuccgccggcggcgucuucggcaccggcaccaaagucacaguccuc

SEQ ID NO: 56290 - RNA, 333 nt, Artificial Sequence
  derived and/or modified sequence opt11 from anti-HIV_038-030557_VR-Chain
caauccguccucacccaaccccccuccgucuccgccgcccccggccaaaaagucaccauauccugcuccggcuccuccuccaccaucggcaacaacuacgucuccugguaccaacuccuccccggcaccgcccccaaacuccucaucuacaaaaacaacaaacgccccuccggcauccccgaccgcuucuccggcuccaaauccggcaccuccgccacccucggcaucaccggccuccaaaccggcgacggcgccgacuacuacugcggcaccugggacaccucccucuccgccggcggcgucuucggcaccggcaccaucgucaccguccuc

SEQ ID NO: 56291 - RNA, 333 nt, Artificial Sequence
  derived and/or modified sequence opt11 from anti-HIV_038-024298_VR-Chain
caauccguccucacccaaccccccuccgucuccgccgcccccggccaaaaagucaccaucuccugcuccggcuccuccuccaacaucggcaacucccacgucuccugguaccaacaauuccccggcaccggccccaaacuccucaucuacgaaaacgccaaacgccccuccggcauccccgaccgcaucuccggcuccaaauccgacaccuccgccacccucggcaucaccggccuccaaaccggcgacgaagccgacuacuacugcggcaccugggacuccucccucuccgccggcggcgucuucggcaccggcaccaaagucaccguccuc

SEQ ID NO: 56292 - RNA, 333 nt, Artificial Sequence
  derived and/or modified sequence opt11 from anti-HIV_038-011154_VR-Chain
caauccguccucacccaaccccccuccgucuccgccgcccccggccaacgcaucaccaucuccugcuccggcuccucauccaacaucggcaacaacuacgucuccugguaccaacaacuacccggcaccgcccccaaacuccucaucuacaaaaacaacaaacgccccuccggcauccccgaccgcuucuccggcuccaaauccggcaccucagccacccucggcaucaccggccuccaaaccggcgacgaagccgacuacuacugcggcaccugggacaccucccucucagccggcggcgucuucggcaccggcaccaaagucaccguccuc

SEQ ID NO: 56293 - RNA, 318 nt, Artificial Sequence
  derived and/or modified sequence opt11 from anti-HIV-1_LightChain
gagaucgugcucacgcaaucgcccgggaccuugagccugagcccgggcgagcgcgcgaccuugagcugucgcgcgagccagagcgugagcaauaacuuucucgcgugguaucaauauaaaccgggccagcccccgcgcgugcucauauacgggaccucgcgcagggccucgggcauacccgaucgcuuuagcgggagcgggagcgggaccgauggcucgcucacgaucucgcgcuuggaagcggaagauuucgcggucuauuacugucaacaguacgaguucuuuggccagggcacgcgcuuggaaaugaaaaggacc

SEQ ID NO: 56294 - RNA, 318 nt, Artificial Sequence
  derived and/or modified sequence opt11 from anti-HIV-1_LightChain
gaagucguccucacccaaucccccggcacccucucccucucccccggcgaacgcgccacccucuccugccgcgccucccaauccgucucccgaaacuaccucgccugguaccaacaaaaacucggccacggcccccgccuccucgucuacgccaccucccgccgcgccaccggcauccccgaccgcuucaucggcucccaauccggcaccgaauacaaccucaccaucacccgccucgaccccggcgacuucgcccaauacuucugccaacaauacgaauucuucggccccggcacccgccucgacaucaaacgcacc

SEQ ID NO: 56295 - RNA, 309 nt, Artificial Sequence
  derived and/or modified sequence opt11 from anti-HIV-1_LightChain
gaagucguccucacccaaucccccggcacccucucccucucccccggcgaacgcgccuccuucuccugcaaauccucccaauacggccacaccgccugguaccaacaaaaacucggccacggcccccgccuccucaucuacgccaccucccgccgcgccaccggcauccccgaccgcuucaucggaucccaauccggcaccgaauacaaccucaccaucacccgccucgaccccggcgacuucgcccacuacuucugccaacaaaacgaauucuucggccccggcacccgccucgacaugaaacgcacc

SEQ ID NO: 56296 - RNA, 306 nt, Artificial Sequence
  derived and/or modified sequence opt11 from anti-HIV-1_LightChain
gaaaucguccucacccaaucccccuccucccucucccucucccccggcgaacgcgccucccucuccugccgcggcucccacggccacgucgccugguaccaacacaaacccggccaaaucccccgccuccucaucuacgccaccuccaaacgcgccuccggcaucuccgaccgcuucuccggcuccggcuccggcaccgacgccacccuauccaucucccgccucgaacccgaagacuucgccgucuacuucugccaacaauacgaauucuucggccaaggcacccgccucgaaauaaaacgcacc

SEQ ID NO: 56297 - RNA, 306 nt, Artificial Sequence
  derived and/or modified sequence opt11 from anti-HIV-1_LightChain
gaaaucaugcucacccaaucccccggcacccucucccucucccccggcgaacgcgccacccucuccugccgcggcucccacggccacgucgccugguaccaacaaaaacccggccgaaucccccgccuccucaucuacggcaccuccaaacgcgccuccggcauccccgaccgcuucuccggcuccggcuccggcaccgacgccacccucaccaucucccgccucgaauccgaagacuucgccgucuacuucugccaacaauacgaauucuucggccaaggcacccgccucgacaucaaccgcacc

SEQ ID NO: 56298 - RNA, 309 nt, Artificial Sequence
  derived and/or modified sequence opt11 from anti-HIV-1_LightChain
gaauccguccucacccaaucccccggcacccucucccucucacccggcgaaaccgccucccucuccugcaccgccgcccucuacggccacaugaccugguaccaaaaaaaacccggccaaccccccaaacuccuccucuacgccuccuccaaacgcgccuccggcauccccgaccgcuucuccggcucccaauucggcaaacaauacacccuaaucaucaccaaaauggaacccgaagacuucgccgaauacuacugccaacaauucgaagucuucggccaaggcacccgccucgacaugcgccgcacc

SEQ ID NO: 56299 - RNA, 306 nt, Artificial Sequence
  derived and/or modified sequence opt11 from anti-HIV-1_LightChain
gaagucguccucacccaaucccccggcacccucucccucucccccggcgaacgcgccacccucuccugccgcggcucccacggccaccucuccugguaccaauacaaacccggccaacccccccgcguccucaucuacggcaccucccgccgcgccuccggcauccccgaccgcuucuccggcuccggcuccggcaccgacggcucccucaccaucucccgccucgaagccgaagacuucgccgucuacuacugccaacaauacgaauucuucggccaaggcacccgucucgaaaugaaacgcacc

SEQ ID NO: 56300 - RNA, 309 nt, Artificial Sequence
  derived and/or modified sequence opt11 from anti-HIV-1_LightChain
gaagucguccuaacccaauccccaggcacccucucacucucccccggcgaacgcgccucacucuccugcaaauccucccaauacggccacaccgccugguaccaacaaaaacucggccaaggcccccgccuccucaucuacgccaccucacgccgcgccaccggcauccccgaccgcuucuccggcucccaauccggcaccgaauacaaccucaccaucacccgccucgaccccggcgacuucgcccaauacuucugccaacaauacgaauucuucggccccggcacccgccucgacaucaaacgcacc

SEQ ID NO: 56301 - RNA, 306 nt, Artificial Sequence
  derived and/or modified sequence opt11 from anti-HIV-1_LightChain
gaaaucaugcucacccaaucccccggcacccucucccucucccccggcgaacgcgccacccucuccugccgcggcucccacggccacgucgccugguaccaacaaaaaccaggccgcaucccccgccuccucaucuacggcaccuccaaacgcgccuccggcauccccgaccgcuucuccggcuccggcuccggcaccgacgccacccucaccaucucccgacucgaauccgaagacuucgccgucuacuacugccaacaauacgaauucuucggccaaggcacccgccucgacaucaaacgcacc

SEQ ID NO: 56302 - RNA, 309 nt, Artificial Sequence
  derived and/or modified sequence opt11 from anti-HIV-1_LightChain
gaauccguccucacccaaucccccggcacccucucccucucccccggcgaaaccgccucccucuccugcaccgccgccuccuacggccacaugaccugguaccaaaaaaaacccggccaaccccccaaacuccucaucuucgccaccuccaaacgcgccuccggcauccccgaccgcuucuccggcucccaauucggcaaacaauacacccucaccaucacccgcauggaacccgaagacuucgccggcuacuacugccaacaagucgaauucuucggccaaggcacccgccucgaaauacgccgcacc

SEQ ID NO: 56303 - RNA, 309 nt, Artificial Sequence
  derived and/or modified sequence opt11 from anti-HIV-1_LightChain
gacauccaaaugacccaaucccccuccucccucuccgccuccgucggcgaccgcgucaccaucaccugccaagccucccaagacaucuccaacuaccucaacugguaccaacaaaaacccggcaaagcccccaaacuccucaucuacgacgcauccaaccucgaaaccggcguccccucccgcuucuccggcuccggcuuccacaccaccuucucccucaccaucuccggccuccaacgcgacgacuucgccaccuacuucugcgccguccucgaauucuucggccccggcaccaaagucgacuucaac

SEQ ID NO: 56304 - RNA, 309 nt, Artificial Sequence
  derived and/or modified sequence opt11 from anti-HIV-1_LightChain
gacauccaaaugacccaaucccccuccucccucuccgccuccgucggcgaccgcgucaccaucaccugccaagccucccaagacaucaccaacuaccucaacugguaccaacaaaaacccggccgcgcccccaaacuccucguccacggcgccuccaaccuccaacgcggcguccccucccgcuucuccggcuccggcuuccacaccaccuucacccucaccaucuccucccuccaacccgacgacgucgccaccuacuucugcgaagucuuccaaugguucggccccggcacccgcgucgacuucaac

SEQ ID NO: 56305 - RNA, 309 nt, Artificial Sequence
  derived and/or modified sequence opt11 from anti-HIV-1_LightChain
ggcuuccaacucacccaaucccccuccucccucuccgccuccgucggcgaccgcgucuccaucaacugccaagccggcgaaggcaucggcuccucccucaacugguaccaacaaaaacccggccgcgcccccaaacuccucguccacggcgccuccaaccuccaacgcggcguccccucccgauucuccggcuccggcuuccacaccaccuucacccuaaccaucuccucccuccaacccgacgacgucgccaccuacuucugcgaagucuuccaaugguucggccccggcacccgcgucgacuucaac

SEQ ID NO: 56306 - RNA, 309 nt, Artificial Sequence
  derived and/or modified sequence opt11 from anti-HIV-1_LightChain
ggcauccaacucacccaaucccccuccucccucuccgucuccgucggcgaccgcgucaccaucaccugccgcgccucccaaggcaucggcaacucccucaacugguaccaacaaaaacccggcaaagcccccaaccucauggucuucggcaccaccaaacucaaccgcggcguccccucccgcuucuccggcuccggcuccggcaccaccgccacccucaccaucaacucccuccaacccgaagacaucgccaccuacuucugccaagucuucgaauuccucggccccggcaccaaacucgacaugaaa

SEQ ID NO: 56307 - RNA, 309 nt, Artificial Sequence
  derived and/or modified sequence opt11 from anti-HIV-1_LightChain
gacauccaaaugacccaaucccccuccucccucuccgccuccguaggcgaccgcgucaccaucaccugccaagccggccaaggcaucggcucaucccucaaaugguaccaacaaaaacccggccgcgccccccgccuccucguccacggcgccuccaaccuccaccgcggcguccccucccgcuucuccggcuccggcuuccacaccaccuucucccucaccaucuccggccuccaacgcgacgacuucgccaccuacuucugcgccguccucgaauucuucggccccggcaccaaagucgacuucaac

SEQ ID NO: 56308 - RNA, 309 nt, Artificial Sequence
  derived and/or modified sequence opt11 from anti-HIV-1_LightChain
ggcauccaacucacccaaucccccucaucccucuccgccuccgucggcgaccgcgucaccaucaccugccaagccucccaaggcaucggcuccucccuccaaugguaccaacaaaaacccggccgcgcccccaaccuccucguccacggcgccuccaaccuccaccgcggcguccccucccgcuucuccggcuccggcuuccacaccaccuucucccucaccaucuccggccuccaacgcgacgacuucgccaccuacuucugcgccguccuagaauucuucggccccggcaccaaagucgaaaucaaa

SEQ ID NO: 56309 - RNA, 309 nt, Artificial Sequence
  derived and/or modified sequence opt11 from anti-HIV-1_LightChain
ggcguccaacucacccaaucccccuccucccucuccgccuccgucggcgaccgcgucuccaucaacugccaagccggccaaggcaucggcuccucccucaacugguaccaacaaaaacgcggcaaagcccccaaacuccucguccacggcgccuccacccuccaacgcggcguccccucccgcuucuccggcuccggcuuccacaccaccuucacccucaccaucuccucccuccaacccgacgacgucgccaccuacuucugcgaagucuuccaaugguucggccccggcacccgcgucgacuucaac

SEQ ID NO: 56310 - RNA, 306 nt, Artificial Sequence
  derived and/or modified sequence opt11 from anti-HIV-1_LightChain
uacauccaacucacccaaucccccuccucccucuccgccuccaucggcgaccgcgucaccaucgccugccgcgccucccaaggcaucggcuacguccacugguaccaacaaaaacgcggcaaaccccccaaacuccucauccacggcgccuccauccucgaacgcggcguccccucccgcuucuccggcuccggcuccggcacccucuucaaccuaaccgucuccggccuccaacccgaagacuucgccaccuacaugugccaagucuucgaauccuucggccccggcaccaaaguccaaaugaaa

SEQ ID NO: 56311 - RNA, 309 nt, Artificial Sequence
  derived and/or modified sequence opt11 from anti-HIV-1_LightChain
ggcauccaacucacccaaucccccuccucccucuccgccucccucggcgaccgcgucaccaucaccugccaagccucccaaggcaucggcuccucccuccaaugguaccaacaaaaacccggcaaagcccccaaacuccucguccacggcgccuccaaacuccaccgcggcguccccucccgcuucuccggcuccggcuuccacaccaccuucucccucaccaucuccucccuacaacccgaagacuucgccaccuaccucugccaaguccucgaauucuucggccccggcaccaaagucgacuucaac

SEQ ID NO: 56312 - RNA, 309 nt, Artificial Sequence
  derived and/or modified sequence opt11 from anti-HIV-1_LightChain
ggcauccaacucacccaaucccccuccucccucuccgccuccgucggcgacaccgucaccaucaccugccaagccucccaaggcaucggcuccucccuccaaugguaccaacaaaaacgcggccgcgcccccaaacuccucguccacggcgccuccaaccuccaaggcggcguccccucccgcuucuccggcuccggcuuccacaccaccuucacccucgccauccgcggccuccaacccgacgacuucgccaccuacuucugccaaucccucgaauucuucggccccggcaccaaagucgacaugaaa

SEQ ID NO: 56313 - RNA, 306 nt, Artificial Sequence
  derived and/or modified sequence opt11 from anti-HIV-1_LightChain
uacauccaacucacccaaucccccuccucccucuccgccuccgucggcgaccgcgucaccaucaccugccgcgccucccaagacaucggcuacgucuccugguacgcccaaaaacgcggccgcgcccccaaacuccucauccacggcgccuccggccucgaacgcggcguacccucccgcuucuccggcuccggcuccggcacccucuucacccucaccaucgaaucccuccaacccgaagacuucgccaccuacaugugccaagucuucgaauccuucggccccggcaccaaagucgaaaugaaa

SEQ ID NO: 56314 - RNA, 309 nt, Artificial Sequence
  derived and/or modified sequence opt11 from anti-HIV-1_LightChain
ggcauccaacucacccaaucccccuccucccucuccgccuccgucggcgaccgcgucuccaucaacugccaagccggccaaggcaucggcuccucccucaacugguaccaacaaaaacccggccgcgcccccaaacuccucguccacggcgccuccaaccuccaacgcggcguccccucacgcuucuccggcuccggcuuccacaccaccuucacccucaccaucuccucccuccaacccgacgacgucgccaccuacuucugcgccgucuuccaaugguucggccccggcacccgcgucgacuucaac

SEQ ID NO: 56315 - RNA, 366 nt, Artificial Sequence
  derived and/or modified sequence opt11 from anti-HIV-1_HeavyChain
agccagcaauugguccagagcgggacccaggucaagaaaccgggcgcgagcguacgcauaagcugucaagcgagcggguacacguucacggacuauguccugcacugguggaggcaagcacccgggcaagggcucgaguggaugggcuggaucaagcccguguacggggccaggaacuaugccaggcgcuuucaagggcgcauagacuucagcagggacauauacagggaaauagccuauauggaucucucgggcuugcgcucggacgauaccgcgcucuauuucugugccagggacgggagcggggacgauaccucguggcaucucgauccauggggccagggcacgcucgugaucgugagcgcg

SEQ ID NO: 56316 - RNA, 366 nt, Artificial Sequence
  derived and/or modified sequence opt11 from anti-HIV-1_HeavyChain
ucgcaacagcucgugcaaucgggcacgcaagugaaaaagcccggggccucggucaggaucucgugccaggccucgggcuauaccuuuaccgauuacuugcuccauugguggcgccaggccccgggccagcgcuuggaauggaugggguggauaaaaccggucuauggcgcgcgcaauuacgcgcacagguuccagggcaggaucaauuucgaucgcgauaucuaucgcgagaucgcguucauggacuugagcgggcucaggagcgaugacacggccguguacuuuugcgcgcgcgauggcgggggcgaugacaggaccuggcucuuggacacgugggggcaagggaccuuggucguggucucgagc

SEQ ID NO: 56317 - RNA, 366 nt, Artificial Sequence
  derived and/or modified sequence opt11 from anti-HIV-1_HeavyChain
caaguccaccucgaacaacccggcuccgucguccgcuggcccggcgccucccucacccucuccugcaccgccuccggcuacaucuucgucaacuaccacauccacuggcuccgccaagcccccggccaacgccucgaacuccuaggcaccaucaaccccgucggcggcgccaccuccuacgcccaaaaauuccgcggccgacucguccucacccgcgacaucggcuccuccaccgucacccuccuccucaaccaccuccgccgcgacgacuccgccgucuacuucugcgcccgcgaauccaacgccuccggccgcggccgcuccauggaccacuggggccgcggcucccgcgucaucgucucccaa

SEQ ID NO: 56318 - RNA, 366 nt, Artificial Sequence
  derived and/or modified sequence opt11 from anti-HIV-1_HeavyChain
caagugcaauugguccagagcggggccgaggucaagaaaccgggcgcgagcgugcgcgugagcugucaagcgagcggguacacguucacgaacuacaucuugcacugguggaggcaagcgcccgggcaagggcucgaguggaugggcuugaucaagcccguguacggggccgugaacuaugccaggcaauuucaagggcgcauacaauugaccagagacauauacagggaaauagccuuucucgaucucucgggccugcgcucggacgauaccgcagucuauuacugugccagagacgagagcggggacgaucucaaguggcaucuccaucccuggggccagggcacgcaagugaucgugagcccg

SEQ ID NO: 56319 - RNA, 366 nt, Artificial Sequence
  derived and/or modified sequence opt11 from anti-HIV-1_HeavyChain
cagguccagcucgugcaaucgggcgcggaagugaaaaagcccggggccucggucaggaucucaugccaggccucgggcuauaccuuuaccgauuacgugcuccauugguggcgccaggccccgggccagggcuuggaauggaugggguggauaaaaccggucuauggcgcgcgcaauuacgcgcgcagguuccagggcaggaucaacuucgaucgcgauaucuaucgcgagaucgcguacauggacuugagcgggcucaggagcgaugacacggccagguacuuuugcgcgcgcgauggcucgggcgaugacacgagcuggcacuugcacccgugggggcaagggaccuuggucauagucucggcc

SEQ ID NO: 56320 - RNA, 366 nt, Artificial Sequence
  derived and/or modified sequence opt11 from anti-HIV-1_HeavyChain
ucacaacaacucguccaauccggcacccaagucaaaaaacccggcgccuccguccgagucuccugccaagccuccggcuacaccuucaccaacuacauccuccacugguggcgccaagcccccggccaaggccucgaauggaugggccucaucaaacccgucuacggcgccgucaacuacgcccgccaauuccaaggccgcauccaacucacccgagacaucuaccgcgaaaucgccuuccucgaccucuccggccuccgcaccgacgacaccgccgucuacuacugcgcccgcgacgaauccggcgacgaccucaaauggcaccuacaccccuggggccaaggcacccaagucaucgucuccccc

SEQ ID NO: 56321 - RNA, 366 nt, Artificial Sequence
  derived and/or modified sequence opt11 from anti-HIV-1_HeavyChain
caaguccaccucgaacaauccggcuccgucguccgcuggcccggcgccucccucacccucuccugcaccgccuccggcuacaucuucgucaacuaccacauccacuggcuccgccaagcccccggccaacgacucgaacucaugggcaccaucaaccccgucggcggcgccaccuccuacacccaacgcuuccgcggccgccucguccucacacgcgacaucggcuccaacaccgucacccuccuccucaaccaccuccgcuccgacgacuccgccgucuacuucugcgcccgcgaauccaacgccuccggccgaggccgcuccauggaccacuggggccgcggcucccacgucaucgucucaccc

SEQ ID NO: 56322 - RNA, 366 nt, Artificial Sequence
  derived and/or modified sequence opt11 from anti-HIV-1_HeavyChain
ucccaacaccucguccaauccggcacccaagucaaaaaacccggcgccuccguccgcgucuccugccaagccuccggcuacaccuucaccaacuacauccuccacugguggcgccaagcccccggccaaggccuagaauggaugggccuaaucaaacccgucuacggcgccgucaacuacgcccgacaauuccaaggacgcauccaacucacccgcgacaucuaccgcgacaucgccuuccucgaccucuccggccuccgcuccgacgacaccgccguauacuacugcgcccgcgacgaauccggcgacgaccucaaauggcaccuccaccccuggggccaaggcacccaagucaucgucuccccc

SEQ ID NO: 56323 - RNA, 366 nt, Artificial Sequence
  derived and/or modified sequence opt11 from anti-HIV-1_HeavyChain
ucccaacaacucguccaauccggcacacaagucaaaaaaccaggcgccuccguccgcaucuccugccaagccuccggcuacaccuucaccgacuacguccuccacugguggcgacaagcccccggccaaggccucgaauggaugggcuggaucaaacccgucuacggcgcccgcaacuacgcccgccgcuuccaaggccgcaucaacuucgaccgcgacaucuaccgcgaaaucgccuacauggaccucuccggccuccgauccgacgacaccgcccgcuacuucugcgcccgcgacggcuccggcgacgacaccuccuggcaccuccaccccuggggccaaggcacccucgucaucgucuccgcc

SEQ ID NO: 56324 - RNA, 366 nt, Artificial Sequence
  derived and/or modified sequence opt11 from anti-HIV-1_HeavyChain
caaguccaccucgaacaacccggcuccgucguccgcuggcccggcgccucccuaacccucuccugcaccgccuccggcuacaucuucguaaacuaccacauccacuggcuacgccaagcccccggccaacgccucgaacuccucggcaccaucaaccccgucggcggcgccaccuccuacgcccaaaaauuccgcggccgacucguccucacccgcgacaucggcuccuccaccgucacccuccuccucaaccaccuccgccgcgacgacuccgccgucuacuucugcgcccgcgaauccaacgccuccggccgcggccgcuccauggaccacuggggccgcggcaaacccgucaucgucuccccc

SEQ ID NO: 56325 - RNA, 321 nt, Artificial Sequence
  derived and/or modified sequence opt11 from anti-HIV-1_HeavyChain
gaaaucgucaugacccaaucccccgccauccucuccgucucccccggcgaccgcgccaccuucuccugccgcgccucccaauccgucaaaaacaaccuagccugguaccaaaaacgccccggccaagccccccgccuccucaucuucgacgccuccucccgcgccuccggcauccccgcccgcuucuccggcggcggcuccggcaccgaauucacccucaccgucaacuccaugcaauccgaagacuucgccaccuacuacugccaacaauacgaagaauggccccgcaccuucggccaaggcaccaaagucgaaaucaug

SEQ ID NO: 56326 - RNA, 321 nt, Artificial Sequence
  derived and/or modified sequence opt11 from anti-HIV-1_HeavyChain
caaaucguccucacccaauccccccccacccuaucccucucccccggcgaacgcgccacccucuccugccgcgccucccaauccgucaaaaacaaccucgccugguaccaaaaacgccccggccaagccccccgccuccucaucuucgacaccuccucccgcgccuccaacauccccgcccgauucuccggcggcggcuccggcaccgaauucacccucaccgucaacuccaugcaauccgaagacuucgccaccuacuacugccaacaauacgaagaauggccccgcaccuucggccaaggcaccaaagucgaaaucauc

SEQ ID NO: 56327 - RNA, 321 nt, Artificial Sequence
  derived and/or modified sequence opt11 from anti-HIV-1_HeavyChain
gaaaucgucaugacccaaucccccgccguccucucagucucccccggcgaccgcgccacccucuccugccgcgccucccaauccgucaaaaacaaccucgccugguaccaaaaacgccccggccaagccccccgccuccucaucuucgacaccuccucccgcgccuccaacauccccgcccgcuucuccggcggcggcuccggcaccgaauucacccucaccgucaacuccaugcaauccgaagacuucgccaccuacuacugccaacaauacgaagaauggccccgcaccuucggccaaggcaccaaagucgaaaucaac

SEQ ID NO: 56328 - RNA, 321 nt, Artificial Sequence
  derived and/or modified sequence opt11 from anti-HIV-1_HeavyChain
gaaaucguccucacccaauccccccccacccucuccgucucccccggcgaagccgccacccucuccugccgcgccucccaauccgucaaaaacaaccucgccugguaccaccucaaagccggccaagccccccgccuccucaucuucgacgccuccucccgcgccggcgacgcccccgcccgcguauccggcuccggcuacggcaccgaauucacccucaccgucaacuccguccaauccgaagacuucggcgacuacuacugccaacaauacgaagaauggccccgcaccuucggccaaggcaccaaagucgaccuccgc

SEQ ID NO: 56329 - RNA, 321 nt, Artificial Sequence
  derived and/or modified sequence opt11 from anti-HIV-1_HeavyChain
gaaaucgucaugacccaauccccccccacccucuccgucucccccggcgaaaccgccacccucuccugccgcgccucccaaaacgucaaaaacaaccucgccugguaccaacucaaacccggccaagccccccgccuccuaaucuucgacgccucaucccgcgccggcggcauccccgaccgcuucuccggcuccggcuacggcaccgacuucacccucaccgucaacuccguccaauccgaagacuucggcgacuacuucugccaacaauacgaagaauggccccgcaccuucggacaaggcaccaaagucgaccuccgc

SEQ ID NO: 56330 - RNA, 321 nt, Artificial Sequence
  derived and/or modified sequence opt11 from anti-HIV-1_HeavyChain
gaaaucgucaugacccaaucccccgccguccucuccgucucccccggcgaccgcgccacccucuccugccgcgccucccaauccgucaaaaacaaccucgccugguaccaaaaacgccccggccaagccccccgccuccucaucuucgacaccuccucccgcgccuccaacauccccgcccgcuucuccggcggcggcuccggcaccgaauucacccuaaccgucaacuccaugcaauccgaagacuucgccaccuacuacugccaacaauacgaagaauggccccgcaccuucggccaaggcaccaaagucgaaaucauc

SEQ ID NO: 56331 - RNA, 399 nt, Artificial Sequence
  derived and/or modified sequence opt11 from anti-HIV-1_HeavyChain
gaaguacaccuccaagaauccggccccggccucguccgcccccucgaaacccucucccucaccugcaccgccuccggcgccuccauccgcggcggcgaauggggcgacaacgacuaccacuggggcuggguccgacacucccccgaaaaaggccucgaauggaucggcuccauccacuggcgcggcaccacccacuacaacgcccccuuccgcggccgcgccacccucuccaucgacaccucccgcaaccaauucuuccuccgccucaccuccaugaccgccgacgacaccgccgucuacuacugcgucaaacacaaauaccacgacaucgucauggucguccccaucgccggcugguucgaccccuggggccaaggccuccaagucaccgucuccgcc

SEQ ID NO: 56332 - RNA, 399 nt, Artificial Sequence
  derived and/or modified sequence opt11 from anti-HIV-1_HeavyChain
gaaguccaccuccaagaauccggccccggccucguccgcccccucgaaacacucucccucacaugcaccgccuccggcgccuccauccgcggcggcgaauggggcgacaacgacuaccacuggggcuggguccgccacucccccgaaaaaggccucgaauggaucggcuccauccacuggcgcggcaccacccacuacaacgcccccuuccgcggccgcgccacccucuccaucgacaccucccgcaaccaauucuuccuccgccucaccuccaugaccgccgacgacaccgccgucuacuacugcgucaaacacaaauaccacgacaucgucauggucguccccaucgccggcugguucaaccccuggggccaaggccuccaagccaccguccccucc

SEQ ID NO: 56333 - RNA, 399 nt, Artificial Sequence
  derived and/or modified sequence opt11 from anti-HIV-1_HeavyChain
caaguccaacucaaagaauccggccccggccucgucaaacccuccgaaacacucucccuaaccugcaccgucuccggcggcuccaugcgcggcaccgacuggggcgaaaacgacuuccacuacggcuggauccgccacuccuccgccgaaggccucgaauggaucggcuccauccacuggcgcggcaccacccacuacaaaauguccuuccgcucccgcgccaccaucuccaucgacaccuccaacaaccgauucucccucauguucuccuucgucaccgccgaagacaccgccgucuacuacugcgcccgccacaaauaccacgacaucuuccgcgucguccccgucgccggcugguucgaccccuggggccaaggccuccucgucaccgucuccucc

SEQ ID NO: 56334 - RNA, 399 nt, Artificial Sequence
  derived and/or modified sequence opt11 from anti-HIV-1_HeavyChain
gaaguccaccuccaagaauccggccccggccucguccgcccccucgaaacccucucccucaccugcaccgccuccggcgccuccauccgcggcggcgaauggggcgacaacgacuaccacuggggcuggguccgccacucccccgaaaaaggccucgaauggaucggcuccauccacuggcgcggcaccacccacuacaacgcccccuuccgcggccgcgccacccucucaaucgacaccuccaaaaaccaauucucacuccgccucaccuccaugaccgccgacgacaccgccgucuacuacugcguaaaacacaaauaccacgacaucgucauggucguccccuucgccggcugguucgaccccuggggccaaggccuccgcgucaccgucuccgca

SEQ ID NO: 56335 - RNA, 399 nt, Artificial Sequence
  derived and/or modified sequence opt11 from anti-HIV-1_HeavyChain
gaagugcaucugcaagagagcgggcccggacucgugcgaccgcucgagaccuugagcuugaccuguaccgcgagcggggccucgaucaggggcggggaauggggcgauaacgauuaccacuggggguggguacgacauagcccggaaaagggccuggaauggaucgggagcauacacuggcgcgggaccacgcacuauaacgcgcccuuucgcgggcgcgcgacccugagcauagacacgagcaagaaccaguucuuucucaggcucacgagcaugaccgcggacgauacagcggucuauuacugugucaagcacaaguaccaugacauaugcauggucgugcccauagccgggugguuugacccgugggggcaaggacuccaggucacggucucgcaa

SEQ ID NO: 56336 - RNA, 399 nt, Artificial Sequence
  derived and/or modified sequence opt11 from anti-HIV-1_HeavyChain
caaguccaccuccaagaauccggccccggacucguccgcccccucgaaacccucucucucacaugcaccgcauccggcgccucaauccgaggcggagaauggggagacaacgacuaccacuggggcuggguccgccacucccccgaaaaaggccucgaauggaucggcuccauccacuggcgcggcaccacccacuacaacgcccccuuccgcggccgcgccacccucuccaucgacaccucccgcaaccaauucuuccuacgccucaccucaaugacagccgacgacaccgccgucuacuacugcgucaaacacaaauaccacgacaucgucauggucguccccaucgccggcugguucgaccccuggggacaaggccuccaagucacagucuccuca

SEQ ID NO: 56337 - RNA, 399 nt, Artificial Sequence
  derived and/or modified sequence opt11 from anti-HIV-1_HeavyChain
caagugcaucugcaagagagcgggcccggacucgugcgcccgcucgagacccugagccugaccugcaccgcgagcggggccucaaucaggggcggggaauggggcgauaacgauuaccacugggggugggugcgccacagcccggaaaagggccuggaauggaucgggagcauacacuggcgcgggaccacgcacuauaacgcgcccuuccgcgggcgcgcaacccugagcauagacacgagcaggaaccaguucuuccucagacucacgagcaugaccgcggacgauaccgcggucuauuacugugucaagcacaaguaccacgacauagucauggucgugcccauagccgggugguuugacccgugggggcaagggcuaagggucacggucucgcaa

SEQ ID NO: 56338 - RNA, 399 nt, Artificial Sequence
  derived and/or modified sequence opt11 from anti-HIV-1_HeavyChain
caagugcacuuacaagagagcgggcccgggcucgugcgcccgcucgagaccuugagccuaaccuguaccgcgagcggggccucgaucaggggcggagaauggggcgauaacgauuaccauugggggugggugcgccacagcccgggcaagggacuggaauggaucgggagcauacacuggcgcgggaccacgcacuacaacgcgcccuuucgcgggcgcgcgacccugagcauagacacguucaggaaccaguucuuucucaggcucacgagcaugaccgcggacgauaccgcggucuauuacugugucaagcacaaguaccaugacauagucauggucgugcccauagccgggugguuugacccgugggggcaagggcuccaggucacggucucgcaa

SEQ ID NO: 56339 - RNA, 399 nt, Artificial Sequence
  derived and/or modified sequence opt11 from anti-HIV-1_HeavyChain
gaagugcacuuacaagagagcgggcccgggcucgugcgcccgcucgagaccuugagcuugaccuguaccgcgagcggggccucgauaaggggcggggaauggggcgauaacgauuaccauugggggugggugcgccauagcccggaaaagggcuuagaauggaucgggagcauacacuggcgcgggaccacgcacuauaacgcgcccuuucgcgggcgcgcgaccuugagcauagacacgagcaggaaccaguucuuccuaaggcuaacgagcaugacagcggacgauaccgcggucuauuacugugucaagcacaaguaccaugacauagucauggucgugcccauagccgggugguuugacccgugggggcaagggcucaggggcacggucucggcc

SEQ ID NO: 56340 - RNA, 393 nt, Artificial Sequence
  derived and/or modified sequence opt11 from anti-HIV-1_HeavyChain
caagugcaauugguccagagcggggccgugaucaagaccccgggcucgagcgugaaaauaagcugucgcgcgagcggguacaauuucagggacuauagcauacacugggucaggcucauaccagauaaaggguucgaguggauaggcuggaucaagcccuuguggggcgccgugagcuaugccaggcaauugcaagggcgcgugagcaugaccaggcaauugagcagggacccggacgaucccgauuggggcgucgcguacauggaauuuagcgggcucacgcccgcggacacggccgaguacuuuugcguacgcagggggucgugcgauuacuguggggauuucccguggcaguacuggggccagggcacggucguggucgugagcucggcc

SEQ ID NO: 56341 - RNA, 393 nt, Artificial Sequence
  derived and/or modified sequence opt11 from anti-HIV-1_HeavyChain
caagugcaacugguccagagcggggccgugaucaagaccccgggcucgagcgugaaauugagcugucgcgcgagcggguacaauuucagggacuauaguauacacugggucaggcucauacccgauaaaggguucgaguggauaggcuggauaaagcccuuguggggcgccgugagcuaugccaggcaauugcaagggcgcgugagcaugaccaggcaauugagccaggacccggacgaucccgauuggggcgucgcguacauggaauuuagcgggcuaacgcccgcggacacggccgaguacuuuugcgugcgcagggggucgugcgauuacuguggggauuucccguggcaguacuggggccagggcacggucguggucgugagcucggcc

SEQ ID NO: 56342 - RNA, 303 nt, Artificial Sequence
  derived and/or modified sequence opt11 from anti-HIV-1_LightChain
accgccggccucacccaaucccccggcacccucucccucucccccggcgaacgcgccauccucuccugccgcaccucccaauacggcucccucgccugguaccaacaacgccccggccaagccccccgccucgucaucuacgccggccucacccgcgccaccggcauccccgaccgcuucuccggcucccgcuggggcgccgaauacaaccucaccaucuccaaccucgaauccgaagacuucggcgucuacuacugccaacaauacgacuucuucggccaaggcaccaaaguccaagucgac

SEQ ID NO: 56343 - RNA, 378 nt, Artificial Sequence
  derived and/or modified sequence opt11 from anti-HIV-1_HeavyChain
caggugcaguuagugcagagcgggagcggggugaagaaguugggggcgagcgugagggugagcuguuggacgagugaggacauauucgagaggacggaguugauacauugggugaggcaggcgccggggcagggguuggaguggauagggugggugaaggcggugaguggggcggugaauuacgggagcuuggacuuuaggcauagggugagcuugacgagggauagggaccugagcacggcgcauauggauauaaggggguugacgcaggacgauacggcgacguauuucugugcgaggcagaaguucgcgaggggagaccaggggugguucuuugacuugugggggagggggacguugauaguggugaguagcgcg

SEQ ID NO: 56344 - RNA, 384 nt, Artificial Sequence
  derived and/or modified sequence opt11 from anti-HIV-1_HeavyChain
cagguccagcucgugcaaucgggcucgggcgugaaaaagcucggggccucggucagggucucaugcuggacaucggaagauaucuuugaaaggaccgagcuaauacacugggucaggcaagcgcccgggcaagggcucgaguggauaggcugggucaaggccgugaccgggaccgugaacuuuggcucgcucaauuucaggcaaagggucucgcucacgcgcgaucgcgaucucuuuacagcgcacauggacauacgcgggcucacgcaaggggacacggcaacguacuuuugcgcgcgccagaaauuugaaaaguacacgggcgggcaagggugguauuucgaucuauggggcaggggcacgcucauagucgugagcucggcc

SEQ ID NO: 56345 - RNA, 378 nt, Artificial Sequence
  derived and/or modified sequence opt11 from anti-HIV-1_HeavyChain
caaguccaacucguccaaucaggcucagccaugaaaaaacccggcgccuccguccgcgucuccugcuggaccuccgaagacaucuucgacaccaccgaacucaucuacuggguccgccaagcccccggccaaggccucgaauggaucggcugggucaaaaucgucucaggcaccgucaacuucgccucccucgacuuccgcaaccgcaucucccucucccgcgaccgcgaccucuucaccgcccacauggacauccgcggccucacccaaggcgacaccgccaccuacuucugcgcccgccaaaaauucuacgccggcggccaaggcugguacuucgaccucuggggccgcggcacccucaucgucgucuccuccgcc

SEQ ID NO: 56346 - RNA, 387 nt, Artificial Sequence
  derived and/or modified sequence opt11 from anti-HIV-1_HeavyChain
cagguccagcucgugcaaucgggcgcggaagugaaaaagcccggggcaucggucagggucucgugcuggaccucggaagauaucuuugacacgaccgagcucauauacugggucaggcaagcgcccgggcaagggcucgaguggauaggcugggucaagaucgugagcgggaccgugaacuuugccucgcucgauuucaggaacaggaucucgcucucgcgcgaucgcgaucuaucgaccgcgcacauggacauacgcgggcucacgcaagaugacacggccacguacuuuugcgcgcgccagaaauuugaaucgcgcuauaccgggggccagggcugguacuuugacuugugggggcgcgggacccauaucguggucucgagcgcg

SEQ ID NO: 56347 - RNA, 387 nt, Artificial Sequence
  derived and/or modified sequence opt11 from anti-HIV-1_HeavyChain
caaguccaacucguccaauccggcuccgccaugaaaaaacccggcgccucaguccgcgucuccugcuggaccuccgaagacaucuucgaacgcaccgaacucaucuacuggguccgccaagcccccggccgcggccucgaauggaucggcugggucaaaaccgucuccggcaccgucaacuucggcucauccgacuuccgcaaccgcaucucccucacccgcgaccgcgaccucuccaccgcccacauggacauccgcggccucacccaagacgacaccgccaccuacuucugcgcccgccaaaaauucgaaucccucuacuccgacgaccaaggcuccuacuucgaccucuggggccgcggcacccucaucaucgucuccuccgcc

SEQ ID NO: 56348 - RNA, 387 nt, Artificial Sequence
  derived and/or modified sequence opt11 from anti-HIV-1_HeavyChain
caaguccaacucguccaauccggacucgaagucaaaaaaccaggcgccuccguccgcgucuccugcuggaccuccgaagacaucuucgacaccaccgaacucaucuacuggguccgccaagcccccggccaaggccucgaauggaucggcugggucaaaaucguauccggcaccgucaacuucgccucccucgacuuccgcaacagaaucucacucucccgcgaccgcgaccuauccaccgcccacauggacauccgcggccucacccaagacgacaccgccaccuacuucugcgcccgccaaaaauucgccucccgcuacuccggcgaccaaggcuccuacuucgaccucuggggccgcggcacccuaaucaucgucuccuccgcc

SEQ ID NO: 56349 - RNA, 387 nt, Artificial Sequence
  derived and/or modified sequence opt11 from anti-HIV-1_HeavyChain
caaguccaacucguccaauccgcauccggcguccgccgccccggcgccuccguccgagucuccugcuggaccuccgaagacaucuucgaacgcucagaacucaucuacuggguccgacaagcccccggccgcggccucgaauggaucggcuggaucaaacucgucuccggcgccguaaacuucggcucagucgacuuccgcgaccgcgucucccuaacccgcgaccgcgaccucuucaccgcccacauggacauccgaggccucacccaagacgacaccgccaccuacuucugcgcccgccaaaaauucgccucccgcuacucaggcgaccaaggcuccuacuucgaccucuggggccgcggcacccucaucaucgucuccuccgcc

SEQ ID NO: 56350 - RNA, 375 nt, Artificial Sequence
  derived and/or modified sequence opt11 from anti-HIV-1_HeavyChain
caagugcaauugguccagagcggaagcggggucaagaaaccgggcgcgagcgugcgcgugagcuguuggacgagcgagggcauauucgagaaaucggaauugauccauugggugcgccaggccccgggccagggcuuggaauggaucgggugggugaaaacggucacgggcgcggucaauuucgggcaccagaucucggacagggucucgcucacgcgcgaucgagaucucuuuaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucggcc

SEQ ID NO: 56351 - RNA, 378 nt, Artificial Sequence
  derived and/or modified sequence opt11 from anti-HIV-1_HeavyChain
caggugcagcuggugcagagcggggcggaggugaagaagccgggggcgagcgugagggugagcuguuggacgagcgaggacauauucgagaagagcgaguugauacauugggugaggcaggcgccggggcagggguuggaguggauagggugggugaagacggugacgggggcggugaauuucgggagcagugauuuuaggcagagggugagccugacgagggacagggacuuguucacggcgcauauggauauaaggggguugacgcagggggauacggcgacguauuucugugcgaggcagaaguuugagaggggggggcaggggugguauuuugacuugugggggagggggacguugauaguggugaguagugca

SEQ ID NO: 56352 - RNA, 378 nt, Artificial Sequence
  derived and/or modified sequence opt11 from anti-HIV-1_HeavyChain
caggugcaguuggugcagagcggggcggaggugaagaggccgggggcgagcgugaaggugagcuguuggacgagcgaggacauauucgagaggacagaguugauacauugggugaggcaggcgccggggcagggguuggaguggauagggugggugaagacggugaguggggcggugaauuucgggagcccgaacuuuaggcauagggugagcuugacgagggacagggacuuguucacggcgcauauggauauaaggggguugacgcagggggauacggcgacguauuucugugcgaggcagaaguucgagaggggggggcaggggugguacuuugacuugugggggagggggacguugauaguggugaguagugcg

SEQ ID NO: 56353 - RNA, 378 nt, Artificial Sequence
  derived and/or modified sequence opt11 from anti-HIV-1_HeavyChain
caggugcagcuggugcagagcgggagcggggugaagaagccgggggcgagcgugagggugagcuguuggacgagcgaggacauauucgaggggagugaguugauacauuggguaaggcaggcgccggggcagggguuggaguggauagggugggugaagacgguaacgggggcggugaauuucgggagcgcguacuuuaggcauagggugagcuugacgagggacagggacuuguucacggcgcauauggauauaaggggguugacgcagggggauacggcgacguauuucugugcgaggcagaaguucaugagcggggggcaggggugguacuuugacuugugggggagggggacggugauaguggugaguagugcg

SEQ ID NO: 56354 - RNA, 387 nt, Artificial Sequence
  derived and/or modified sequence opt11 from anti-HIV-1_HeavyChain
caagugcaauuggucccgagcgggagcggggucaagaaaccgggcgcgagcgugcgagugagcuguuggacgagcgaggacauauucgagcgcacggaauugauccauugggugcgccaggccccgggccagggauuggaauggauagggugggugaaaacgguaacgggcgcggucaauuucgggagcuuggacuuucgacauagaaucagcuugaccagggacagggacuuguucacggcccauauggauauaaggggcuugacccagggcgauaccgcgaccuauuucugugccaggcaaaaguucgagagcagguacacgggcgggcaagggugguauuucgaucucuggggcaggggcacgcacauaguagugagcucggcc

SEQ ID NO: 56355 - RNA, 378 nt, Artificial Sequence
  derived and/or modified sequence opt11 from anti-HIV-1_HeavyChain
caggugcaguuggugcagagcgggagcggggugaagaaggugggggcgagcgugagggugagcuguuggacgagcgaggacauauucgagaggacggaguugauacauugggugaggcaggcgccggggcagggguuggaguggauagggugggugaaggcggugaguggggcggugaauuacgggagcuuggacuuuaggcauagggugagcuugacgagggacagggacuuguucacggcgcauauggauauaaggggguugacgcaggacgauacggcgauauauuucugugcgaggcagaaguucuaugcgggggggcaggggugguacuuugacuugugggggagggggacguugauaguggugaguagcgcg

SEQ ID NO: 56356 - RNA, 387 nt, Artificial Sequence
  derived and/or modified sequence opt11 from anti-HIV-1_HeavyChain
caaguccaacuaguccaaagcggagccgaagucaaaaaaccaggcucaagcguacgcguaagcugcuggaccagcgaagacauauucgaacgcacagaacuaauccacuggguacgccaagccccaggccaaggccucgaauggaucggauggguaaaaacagucacaggcgcagucaacuucggcagcccaaacuuccgccaccgcgucagccuaaccagagacagagaccuauucacagcccacauggacaucagaggccuaacccaaggcgacaccgcaaccuacuucugcgccagacaaaaauucgaaagccgauacucaggcgaccaaggaagcuacuucgaccucuggggcagaggcacacucauaaucgucagcucggcc

SEQ ID NO: 56357 - RNA, 375 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacacguucacgagcuauuacaugcacugggucaggcaagcgcccgggcaagggcucgaguggauaggcugggucaagcccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgccagaaauauuacgcgggcgggcaagggugguauuucgaucucuggggcaggggcacgcucauagucgugagcucggcc

SEQ ID NO: 56358 - RNA, 375 nt, Artificial Sequence
  derived and/or modified sequence opt11 from anti-HIV-1_HeavyChain
caagugcaauugguccagagcggggccgaggucaagaaaccgggcgcgagcgugcaagugagcuguaaagcgagcggguacccguucacgaaauauuacaugcacugggucaggcaagcgccagggcaagggcucgaguggauaggcugggucaaggccgugagcggggccgugaacuauggcucgcucgauuucaggcacagggucucgcucacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggaacgcucauagucgugagcucggcc

SEQ ID NO: 56359 - RNA, 375 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacacguucacgggcuauuacaugcacugggucaggcaagcgcccgggcaagggcucgaguggauaggcugggucaagaccgugagcggggccgugaacuuuggcucgcucaauuucaggcacagggucucgcucacgcgcgaucgcgaucucuuuaccgcgcacauggacauacgcgggcucacgcaaggggacacagccacguacuuuugcgcgcgccagaaauuugccaggggcgaucaagggugguuuuucgaucucuggggcaggggcacgcucauagucgugagcucggcc

SEQ ID NO: 56360 - RNA, 402 nt, Artificial Sequence
  derived and/or modified sequence opt11 from anti-HIV-1_HeavyChain
caaguccaacucguccaauccggcuccggcgucaaaaaacccggcgccucaguccgcgucuccugccgcgccuccgaagaccucuucggcgacgaaaucaucuacgacgacgaagucauccacuggcuccgccaaguccccggccaacgccccgaauggaugggcuggauacgccccaaaaccggcgcccgcaaccaagcccgccaauuccaaccccgcaucucccucacccgcgaccgcgcacucuccaccgccuaccucgaccuaaacucccucaccagcgccgacuccggcacauacuucugcgcccgccaaaccuucaaacccgacuucuacuucgccgaccaaggauggucauucaaccucuggggccgcggcgcccacuucaucgucuccucagca

SEQ ID NO: 56361 - RNA, 381 nt, Artificial Sequence
  derived and/or modified sequence opt11 from anti-HIV-1_HeavyChain
caagugcaauugguccagagcgggggcggggucaagaaaccgggcgcgagcgcgagcuuuagcugucgcacgagcgaggacccguucgauaacgaguucuuugacucggaauuuaugcauugggugcgcuugaccccgggccagcgcccggaauggaugggguggaugaacccgcgcucgggcgggguaaauuacgcgggccaguucaggcccaggaugucaauguggcgcgaucgcgagcucucgaccgcguacauggaauugcgagaucucacguucgcggacacgggcuuguacuuuugcgcgcgcaggaaagaggacgauuacgauugguauuacgaucucuggggcaggggcgcgcacauaaucgugagcgcggcc

SEQ ID NO: 56362 - RNA, 384 nt, Artificial Sequence
  derived and/or modified sequence opt11 from anti-HIV-1_HeavyChain
caggugcaguuggugcaggcgggggggggggugaagaagccgggggcgagugugacguugagcuguaagacggcggaugaggauguguuugaugcggcguauaugcauugggugagacaggcgccggggcagacguuugagugguugggguggaugaagccggugacgggggcggugaauuaugcgaggaaguuucaggggagggugaguuuuuauaggacgagggaguuggggauagcguauauggaucugaggaauuugagguuugaugauacggcgguguauuuuugugcgaggaagacggcgggggaugugagcggggauaagaggggguuuuuuuuugauuugugggggagggggaguagggugauagugaguagugcg

SEQ ID NO: 56363 - RNA, 384 nt, Artificial Sequence
  derived and/or modified sequence opt11 from anti-HIV-1_HeavyChain
cagguccagcucgugcaaucgggcgcggaagugaaaaagcccggggccucggucacgcucucgugcaagaccgcggacgaggacguguucgaugccgcguacaugcacugggucaggcaagcgcccgggcaaacguucgagugguugggcuggaugaagcccgugaccggggccgugagcuaugccaggaaauuucaagggcgcgugagcuuuuacaugaccagggaauugggcauggccuauauggaucucaggaacuugcgcuuugacgauaccgcggucuauuucugugccaggaaaacggccggggacgugagcggggacaaucgcggguacuuuuucgaucuauggggcaggggcucgcgcgugaucgugagcucggcc

SEQ ID NO: 56364 - RNA, 384 nt, Artificial Sequence
  derived and/or modified sequence opt11 from anti-HIV-1_HeavyChain
caagugcaauugguccagagcgaggccgaggucaagaaaccgggcgcgagcaugaccgugagcugugaaacggccgaugaagauauauuugacgcggccuauaugcauugggugcgccaggccccgggccagaccuuugaauggcucggguggaugaaaccggucacgggcgcggucaauuacgcgagaaaguuccagggcaggaucucguucuaucgcacgcgcgagcucgcgaucgcguacauggaccugcgcgaucucagguucgaugacacggccguguacuuuugcgcgcgcaagaccgcgggcgaugucucgggcgauaacaggggcuauuucuuugacuugugggggcgcgggagcagggucauagucucgagcgcg

SEQ ID NO: 56365 - RNA, 420 nt, Artificial Sequence
  derived and/or modified sequence opt11 from anti-HIV-1_HeavyChain
caaucccaccucgaacaauccggauccgccaugaaaaaacccggcgccuccguccgcgucuccugcuggaccuccgaagacaucuucgacaccaccgaacuccucuggguccgccaagcccccggccaaggacucgaauggaucggcugggucaaaaucgucuccggcaccgucaacuucgccucccucgacuuccgcaaccgcaucucccucucccgcgaccgcgaccucuccaccgcccacauggacauccgcggccucacccaagacgacaccgccaccuacuacugcgcccgccaaaaauucgcaucccgcuacagcggcgaccaaggcuccuacuucgaccucuggggccgcggcacccucaucaucgucucauccgccuccaccaaaggccccuccgucuucccccacgaccuc

SEQ ID NO: 56366 - RNA, 417 nt, Artificial Sequence
  derived and/or modified sequence opt11 from anti-HIV-1_HeavyChain
cagagccaucucgagcaaucgggcucggccaugaaaaagcccggggccucggucagggucucaugcuggaccucggaagauaucuuugaaaggaccgagcucauauacugggucaggcaagcgcccgggcgcgggcucgaguggauaggcugggucaagaccgugagcgggaccgugaacuuuggcucaagcgauuucagaaacaggaucucgcucacacgcgaucgcgaucucuuuaccgcgcacauggacauacgcgggcucacgcaaggggacacggccacguacuuuugcgcgcgccagaaauuugaaaggggcgggcaagggugguauuucgaucucuggggcaggggaacgcucauagucgugagcucggccucgaccaauggcccgaucgggcucccgcccaggagcgcg

SEQ ID NO: 56367 - RNA, 423 nt, Artificial Sequence
  derived and/or modified sequence opt11 from anti-HIV-1_HeavyChain
caagcccaccucgaacaaucaggcucaggcgucaaaaaacccggcgccuccguccgcgucuccugcuggacauccgaagacaucuucgaaaaauccgaacucauccacuggguccgccaagcccccggccaaggccucgaauggaucggcugggucaaaaccgucaccggcgccgucaacuucggcuccuccgacuuccgccaacgcguaucccucacccgcgaccgcgaccuauucaccgcccacauggacauccgcggccucacccaaggcgacaccgccaccuacuucugcgcccgccaaaaauucgaaucccucuacuccgacgaccaaggcuccuacuucgaccucuggggccgcggaacccuaaucaucgucuccuccgcauccaccaaaggccccucauccuccccaaccaucugc

SEQ ID NO: 56368 - RNA, 417 nt, Artificial Sequence
  derived and/or modified sequence opt11 from anti-HIV-1_HeavyChain
caggcccaucucgagcaaucgggcucgggcgugaaaaagcccggagccucggucagggucucgugcuggaccucggaagauaucuuugaaaggaccgagcucauacacugggucaggcaagcgcccgggcaagggcucgaguggauaggcugggucaagaccgugagcggggccgugaacuuuggcucgccaaauuucaggcacagggucucgcucacgcgcgaucgcgaucucuuuaccgcgcacauggacauacgcgggcucacgcaaggggacacggcaacguacuuuugcgcgcgccagaaauuugaaaggggcgggcaagggugguauuucgaucucuggggaaggggcacgcucauagucgugagcucggccucgaccaagggcccgagcguguucccgcacgaucucagg

SEQ ID NO: 56369 - RNA, 411 nt, Artificial Sequence
  derived and/or modified sequence opt11 from anti-HIV-1_HeavyChain
caagcacaccuagaacaaagcggaagcggagucaaaaaaccaggcgccagcguccgaguaagcugcuggacaagcgaagacauauucgaacgcacagaacuaauccacuggguccgccaagccccaggccaaggccuagaauggaucggcuggguaaaaacagucucaggcgcagucaacuucggcagcccaaacuuccgccaccgcgucagccuaacccgagacagagaccuauucacagcccacauggacaucagaggccuaacccaaggcgacaccgccaccuacuucugcgccagacaaaaauucgaacgcggcggccaaggcugguacuucgaccuauggggccgcggaacccuaaucguagucucaagcucacuacaccaaggacccucaggccuaccccacgac

SEQ ID NO: 56370 - RNA, 417 nt, Artificial Sequence
  derived and/or modified sequence opt11 from anti-HIV-1_HeavyChain
caggcccaucucgagcaaucgggcucgggcgugaaaaagcccggggccucggucagagucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggcaacguacuuuugcgcgcgccagaaauuuuacgcgggcgggcaagggugguauuucgaucucuggggcaggggcacgcucauagucgugagcucagccucgaccaagggaccgagcguguucccgcacgaucucagg

SEQ ID NO: 56371 - RNA, 426 nt, Artificial Sequence
  derived and/or modified sequence opt11 from anti-HIV-1_HeavyChain
caagcccaccuagaacaauccggcuccggcgucaaaaaacccggcgccuccguccgcgucuccugcuggaccuccgaagacaucuucgaacgcaccgaacuaauccacuggguccgccaagcccccggccaaggccucgaauggaucggcugggucaaaaccgucuccggcgccgucaacuucggcucccccaacuuccgccaccgcguaucccucacccgcgaccgcgaccucuucaccgcccacauggacauccgcggccucacccaaggcgacaccgccaccuacuacugcgcccgccaaaaauucgaaucccucuacuccgacgaccaaggcucauacuucgaccucuggggccgaggcacccucaucaucgucuccucagccuccaccaaaggccccagcgucuucccccacgaccuacgc

SEQ ID NO: 56372 - RNA, 384 nt, Artificial Sequence
  derived and/or modified sequence opt11 from anti-HIV-1_HeavyChain
caggugcacuuggagcagagcgggagcggggugaagaagccgggggcgagcgugagggugagcuguuggacgagcgaggacauauucgagaagagugaguugauacauugggugaggcaggcgccggggcagggguuggaguggauagggugggugaagacggugacgggagcggugaauuucgggagcagugacuuuaggcagagggugagccugacgagggacagggacuuguucacagcgcauauggauauaaggggguugacgcagggggauacggcgacguauuucugugcgaggcagaaguucgagagcagguacacgggagggcaggggugguauuucgauuugugggggagggggacgcacauaguggugagcagu

SEQ ID NO: 56373 - RNA, 423 nt, Artificial Sequence
  derived and/or modified sequence opt11 from anti-HIV-1_HeavyChain
caaguguacauggaacaggccggggccggggucaagaaaccgggcgcgagcgugaccuugagcuguaaaacggccgaugaagaugucuuugacgcggccuauaugcauugggugcgccaggccccgggccagaccuuugaauggcucggguggaugaaaccggucacgggcgcggucaauuacgcgcgcaaguuccagggcagggucucguucuaucgcacgcgcgagcucgggaucgcguacauggacuugcgcaaucucagguucgaugacacggccguguacuuuugcgcgcgcaagaccgcgggcgaugucucgggcgauaaaaggggcuuuuucuuugacuugugggggcgcgggagcagggucauagucucgagcgcgagcacgaaagggcccucggucuuuccccaugacuugcgc

SEQ ID NO: 56374 - RNA, 414 nt, Artificial Sequence
  derived and/or modified sequence opt11 from anti-HIV-1_HeavyChain
caagcccaccucgaacaauccggcuccggcgucaaaaaacccggcaccuccguccgcgucuccugcuggaccuccgaagacaucuucgaacgcaccgaacucauccacuggguccgccaagcccccggccaaggccucgaauggaucggcugggucaaaaccguaaccggcgccgucaacuucggcucccccaacuuccgccaccgcgucucccucacccgcgaccgcgaccuauucaccgcccacauggacauccgcggccucacccaaggcgacacagccaccuacuucugcgcccgccaaaaauucgcccgcggcgaccaaggcugguucuucgaccucuggggccgcggcacccucaucgucgucuccuccgccuccaccaaaggccccuccgucuuccccaccaucugc

SEQ ID NO: 56375 - RNA, 411 nt, Artificial Sequence
  derived and/or modified sequence opt11 from anti-HIV-1_HeavyChain
caagugcaacugguccagagcggggccgaggucaagaaaccaggcgcgagcgugaaagugagcuguaaagcgagcggguacacguucacgagcuauuacaugcacugggucaggcaagcgcccgggcaagggcucgaguggauaggcugggucaagcccgugaccggggccgugaacuuuggcucgcccaauuucaggcacagggucucgcucacgcgcgaucgcgaucucuucaccgcgcacauggacauacgcgggcucacgcaaggggacacggccacguacuuuugcgcgcgccagaaauauuacgcgggcgggcaagggugguauuucgaucucuggggaaggggcacgcucauagucgugagcucggccucgaccaagggaccggucguguucccgaccauaugc

SEQ ID NO: 56376 - RNA, 381 nt, Artificial Sequence
  derived and/or modified sequence opt11 from anti-HIV-1_HeavyChain
cagguguauauggagcaggcgggggggggggugaagaagccgggggcgagugugacguugaguuguaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggauuugaggaauuugagguuugaugauacggcgguguauuuuugugcgaggaagacggcgggggaugugaguggggauaagaggggguuuuuuuuugauuugugggggagggggaguagggugauagugaguagu

SEQ ID NO: 56377 - RNA, 384 nt, Artificial Sequence
  derived and/or modified sequence opt11 from anti-HIV-1_HeavyChain
caggcccaucucgagcaaucgggcucgggagugaaaaagcccggggccucggucagagucucaugcuggaccucggaagauaucuuugaaaggaccgagcucauacacugggucaggcaagcgcccgggcaagggcucgaguggauaggcuggaucaagaccgugaccggggccgugaacuuuggcucgcucgauuucaggcacaggaucucacucacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 56378 - RNA, 420 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugaaaggaccgagcucauauacugggucaggcaagcgcccgggcgcgggcucgaguggauaggcuggguaaagaccgugagcgggaccgugaacuuuggcucgagcgauuucaggaacaggaucucgcucacgcgagaucgcgaucucucgaccgcgcacauggacauacgcgggcucacgcaagaugacacggccacguacuuuugcgcgcgccagaaauuugaaaggggcgggcaagggugguauuucgaucuauggggcaggggcacgcucauagucgugagcucggccucgaccgagggcccgagcaggagcuuuccccagaucuugcgc

SEQ ID NO: 56379 - RNA, 414 nt, Artificial Sequence
  derived and/or modified sequence opt11 from anti-HIV-1_HeavyChain
caggcgcaccuggagcagagcgggagugggguaaagaagccgggggcgagcgugagggugagcuguuggacgagcgaggacauauucgagaagagugaguugauacauugggugaggcaggcgccggggcagggguuggaguggauagggugggugaagacggugacgggggcggugaauuucgggagcagugacuuuagacagagggugagcuugacgagggacagggacuuguucacggcgcauauggauauaaggggguugacgcagggggauacggcgacguauuucugugcgaggcagaaguucuaugcgggggggcaggggugguacuuugacuugugggggagggggacguugauaugugugaguagcgcgagcccgagggcgcacaggagcaguccgaggagcgca

SEQ ID NO: 56380 - RNA, 384 nt, Artificial Sequence
  derived and/or modified sequence opt11 from anti-HIV-1_HeavyChain
caggcccaucucgagcaaucgggcucgggcgugaaaaagcccggggccucggucagggucucgugcuggagcucggaagauaucuuugaaaggaccgagcucauacacugggucaggcaagcgcccgggcaagggcucgaguggauaggcugggucaagaccgugaccggggccgugaacuuuggcucgcucgauuucaggcacaggaucucacucacgcgcgaucgcgaucucuuuaccgcgcacauggacauacgcgggcucacgcgcggggacacggccacguacuauugcgcgcgacagaaauuugaaucgcgcuauaccgggggccagggcugguacuuugacuugugggggcgcgggacccauaucguagucucgagc

SEQ ID NO: 56381 - RNA, 384 nt, Artificial Sequence
  derived and/or modified sequence opt11 from anti-HIV-1_HeavyChain
caggcccaucucgagcaaucaggcucgggcgugaaaaagcccggggccucggucagagucucgugcuggagcucggaagauaucuuugaaaggaccgagcuaauacacugggucaggcaagcgcccgggcaagggcucgaguggauaggcugggucaagaccgugaccggggccgugaacuuuggcucgcucgauuucaggcacaggaucucgcuaacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugaccugugggggcgcgggacccauaucauagucucgagc

SEQ ID NO: 56382 - RNA, 423 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccuccaucuucaucggcugcgaccgcccccucgacaaagacugguccggccucggcggauccaaacucucccucgcccccuccaucuucgccucccucgacuuccgcaaccgcaucucacucucccgcgaccgcgaccucuccaccgccuacauggacauccgcggccucacccaagacgacaccgccaccuacuucugcgcccgacaaaaauucgccucccgcuacuccggcgaccaaggcuccuacuucgaccucuggggccgcggcacccuaaucgucgucuccuccgccuccaccaaaggccccuccgucuucccccacgaccuc

SEQ ID NO: 56383 - RNA, 399 nt, Artificial Sequence
  derived and/or modified sequence opt11 from anti-HIV-1_HeavyChain
agggaauaucucgagcaaucgggcgggggcgugaaaaagcucggggccucggucagggucucgugcagggccucggaagaucucuucggcgaugaagugaucuacgacgaugaacugauccacuggcugcgccaggucccgggccagcgcccggaauggaugggguggauacgcccaaaaacgggcgcgcgcaaucaagcacgccaguuccagcccagaaucaaucucucacgcgaccgcgcgcuaaauaccgcguacuuggaccugagcucgcucacgagcgcggacucggccacguacuuuugcgcacgccagaccuuuaaaccggacuuuuacuuugccgaccaaggauggucauucaaccucuggggcaggggcgcgcgcgugaucgugagcuca

SEQ ID NO: 56384 - RNA, 384 nt, Artificial Sequence
  derived and/or modified sequence opt11 from anti-HIV-1_HeavyChain
cagguccaucucgugcaaucgggcgcggaagugaaaaagcccgggagcucggucagggucucgugcuggaccucggaagauaucuuugaaaggaccgagcucauacacugggucagacaagcgccagggcaagggcucgaguggauaggcuggguaaagaccgugaccggggccgugaacuuuggaucgcccaauuucaggcacagggucucgcucacgcgcgaucgcgaucucuuuaccgcgcacauggacauacgcgggcucacgcaaggggacacggccacguacuuuugcgcgcgccagaaauuugaaucacgcuauagcggggaccagggcucguacuuugaccugugggggcgcgggaccuugaucauagucucgagc

SEQ ID NO: 56385 - RNA, 414 nt, Artificial Sequence
  derived and/or modified sequence opt11 from anti-HIV-1_HeavyChain
caagcgcacuuggaacagagcgggagcggggucaagaaaccgggagcgagcgugcgcgugagcuguuggacgagcgaggacauauucgagcgcacggaauugauccauugggugcgccaggccccgggccagggcuuggaauggaucgggugggugaaaauagucucgggcgcggucaauuucgggagcccgaacuuucgccagcgcgugagcuugacaagggacagggacuuauucacggcccauauggauaucaggggccugacccagggagauaccgcgaccuauuucugugccaggcaaaaguucgagcgcgggggccagggcuggaucuuugaccugugggggcgcgggaccuugaucgcggucucgagcgcgagcacgaaagggcccucggucuuucccacgaucugu

SEQ ID NO: 56386 - RNA, 441 nt, Artificial Sequence
  derived and/or modified sequence opt11 from anti-HIV-1_HeavyChain
cgcgaauuccucgaacaaucaggcggcggcgucaaaaaacucggcgccucccuccgcgucucaugccgagccuccgaagaccuauucggcgacgaauucaucuacgacgacgaagucauccacuggcuacgccaaguccccggccaacgccccgaauggaugggcuggauccgccccaaaaccggcgcacgcaaccaagccacccaauuccaaccccgaaucucccucacccgcgaccgcgcccucuccaccgccuaccucgaccucaacucccucaccuccgccgacucaggcaccuacuucugcgcccgccaaaccuucaaacccgacuucuacuucgccgaccaaggcugguccuucaaccucuggggccgcggcgcccacuucaucgucuccuccgccuccaccaaaggcccauccgucuucccccacgacuccgcc

SEQ ID NO: 56387 - RNA, 399 nt, Artificial Sequence
  derived and/or modified sequence opt11 from anti-HIV-1_HeavyChain
cgcgaauaccucgaacaauccggaggcggcgucaaaaaacucggcgccucccuccgcgucuccugccgagcauccgaagaccucuucggcgacgaaaucaucuacgacgacgaagucauccacuggcuccgccaaguccccggccaacgccccgaauggaugggcuggauccgccccaaaaccggcgcccgcaaccaagcccgacaauuccaaccccgcaucucccucacccgcgaccgcgcccucuccaccgccuaccucgaccucaacucccucaccuccgccgacuccggcaccuacuucugcgcccgccaaaccuucaaacccgacuucuacuucgccgaccaaggcuggucauucaaccucuggggccgcggcgcccacuucaucgucuccucc

SEQ ID NO: 56388 - RNA, 384 nt, Artificial Sequence
  derived and/or modified sequence opt11 from anti-HIV-1_HeavyChain
caggcgcacuuggaacagagcgggagcgggguaaagaagccaggggcgagcgugagagugagcuguuggaguagcgaggacauauucgagaggacggaauugauacauugggugagacaggcgccgggacagggauuggaauggauagggugggugaagacggugacgggagcgguaaauuucgggagucuggacuuuagacauagaauaagccugacaagggacagggacuuguucacggcacauauggauauaaggggauugacacagggagauacagcgacguauuucugugcaaggcagaaguucgagagcagguacacgggagggcaggggugguauuucgaucuguggggaagggggacgcacauaguagugagcucg

SEQ ID NO: 56389 - RNA, 381 nt, Artificial Sequence
  derived and/or modified sequence opt11 from anti-HIV-1_HeavyChain
caggucuauauggagcaagcgggagggggcgugaaaaagcccggggccucgguaacgcucucgugcaagaccgcggacgaggacguguucgaugccgcguacaugcacugggucaggcaagcgcccgggcaaacguucgagugguugggcuggaugaagcccgugaccggggccgugagcuaugccaggaaauuucaagggcgcgugagcuuuuacaugaccagggaauugggcauggccuauauggaucucaggaacuugcgcuuugacgauaccgcggucuauuucugugccaggaaaacggccggggacgugagcggggacaaucgcggguacuuuuucgaucucuggggcaggggcucgcgcgugaucgugagcucg

SEQ ID NO: 56390 - RNA, 414 nt, Artificial Sequence
  derived and/or modified sequence opt11 from anti-HIV-1_HeavyChain
caggcccaucucgagcaaucgggcacgggcgugaaaaagcccggggccucagucagggucucuugcuggacaucggaagauaucuucgaaaagagcgagcucauacacugggucaggcaagcgcccgggcaagggcuagaguggauaggaugggucaagaucgugagcggggcagugaacuuuggaagucccaauuucagacaaagggucucgcucacgcgcgaucgcgaucuauucaccgcgcaaauggacauaagagggcuaacgcaaggggacacggccacguacuuuugcgcgcgacagaaauuugaaaggggcgggcaaggguggauauucgaucucuggggaaggggaacgcucauagccgugagcucggccucgaccaagggcccgagcguguucccgcacgaucua

SEQ ID NO: 56391 - RNA, 399 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaauugauccauugggugcgacaggccccgggccagggcuuggaauggaucgggugggugaaagcggucucgggcgcggucaauuacgggagcuuggacuuucgacaucgcgugagcuugaccagggacagggaccugagcacggcccauauggauaucaggggcuugacccaggacgauaccgcgaccuauuucugcgccaggcaaaaguucgcgcgaggggaccagggcugguucuuugacuugugggggcgcgggaccuugaucguggucucgagcgcgagcacgaaagggcccucgggc

SEQ ID NO: 56392 - RNA, 414 nt, Artificial Sequence
  derived and/or modified sequence opt11 from anti-HIV-1_HeavyChain
caagcccaccucgaacaaucaggcuccggcgucaaaaaacccggcgccuccguccgcgucuccugcuggaccuccgaagacauauucgaacgcaccgaacuaauccacuggguccgccaagcccccggccaaggccuagaauggaucggcugggucaaaaccgucacaggcgccguaaacuucggcucccccaacuucagacaccgcgucucccucacccacgaccgcgaccucuucacagcccacauggacauccgcggccucacccaaggcgacaccgccaccuacuucugcgcccgacaaaaauucuacgccggcggccaaggcugguacuucgaccucuggggccgcggaacccucaucugcgucuccuccgccuccaccaaaggcccauccggccuccccccccgcucc

SEQ ID NO: 56393 - RNA, 426 nt, Artificial Sequence
  derived and/or modified sequence opt11 from anti-HIV-1_HeavyChain
caagcccaccucgaacaauccggcuccggcgucaaaaaacucggcgccuccguccgcgucuccugcuggaccuccgaagacaucuucgaacgcaccgaacucauccacuggguccgccaagcccccggccaaggccucgaauggaucggcugggucaaagccgucucaggcgccgucaacuacggcucccucgacuuccgccaccgcgucucccucacccgcgaccgagaccucuccaccgcccacauggacauccgcggccucacccaagacgacacagccacauacuucugcgcccgccaaaaauucgaaucccucuacuccgacgaccaaggcucauacuucgaccucuggggccgcggcacccucaucaucgucuccuccgccuccaccaaaggccccucagucuucccccacgaccuacgc

SEQ ID NO: 56394 - RNA, 414 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggcuuagaauggaucgggugggugaaaacagucucgggcgcggucaauuucgggagcccgaacuuucgccaucgcgugagccugaccagggacagggacuuguucacggcccauauggauaucaggggcuugacccagggcgauaccgcgaccuauuacugugccaggcaaaaguucgagcgagggggccagggcugguacuuugacuugugggggcgcgggacccugaucguggucucgagcgcgagcacgaaagggcccucggucuuucccacgaucuau

SEQ ID NO: 56395 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggucgagcgaggacauauucgagcgcacggaauugauccauugggugcgacaggccccgggccagggcuuggaauggaucgggugggugaaaacagucacgggcgcggucaauuucgggagcuuggacuuuagacaucgcaucagcuugaccagggacagggacuuguucacggcccauauggauauaaggggcuugacccagggcgauaccgcgaccuauuacugugccaggcaaaaguucgagagcagguacacgggcgggcaagggugguauuucgaucucuggggcaggggcacgcacauagucgugagcucg

SEQ ID NO: 56396 - RNA, 414 nt, Artificial Sequence
  derived and/or modified sequence opt11 from anti-HIV-1_HeavyChain
caggcccaucucgagcaaucgggcucgggagugaaaaagcccggggccucggucagggucucgugcuggaccucggaagauaucuuugaagggagcgagcucauacacugggucaggcaagcgcccgggcaagggcucgaguggauaggcugggucaagaccgugaccggggccgugaacuuuggcucggccuauuucaggcacagggucucgcucacgcgcgaucgagaucucuuuaccgcgcacauggacauacgcgggcuaacgcaaggggacacggccacguacuauugcgcgcgccagaaauuuuacaagggcgggcaagggugguauuucgaucucuggggcaggggcacgcucauagucgugagcucggccucgaccaagggaccgagcguguucccgaccauaugc

SEQ ID NO: 56397 - RNA, 399 nt, Artificial Sequence
  derived and/or modified sequence opt11 from anti-HIV-1_HeavyChain
agggaauaucucgagcaaucgggcgggggcgugaaaaagccaggggccucggucagggucucgugcagggccucggaagaucucuuuggcgacgaaauaaucuaugacgaugaagugauccauuggcugcgccaggucccgggccagcgcccggaauggaugggguggauacgcccgaaaaauggcgggcgcaaucaagcgcgccaguuccagcccaggaucucgcucacgcgcgaucgcgcgcucaacaccgcguacuuggacuugaacucacucacgagcgcggacucgggaacguacuuuugcgcgcgccagaccuuuaaaccggacuuuuacuuugccgaucaaggguggucguucaaucuauggggcaggggcgcgcgcgugaucgugagcucg

SEQ ID NO: 56398 - RNA, 375 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaauugauccauugggugcgccaggccccgggccagggcuuggaauggaucgggugggugaaagcggucucgggcgcgguaaauuacgggagcuuggacuuucgccaucgagugagcuugaccagggacagggacuugagcacggcccauauggauaucaggggcuugacccaggacgauaccgcgaccuauuucugugccaggcaaaaguucgcgcgcggggaccagggcugguucuuugacuugugggggcgcgggacauugaucguggucucgagc

SEQ ID NO: 56399 - RNA, 420 nt, Artificial Sequence
  derived and/or modified sequence opt11 from anti-HIV-1_HeavyChain
caggucuauauggagcaagcgggcgggggagugaaaaagcccggggccucggucacgcucucgugcaagaccgcggacgaggacguguucgaugccgcguacaugcacugggucaggcaagcgcccgggcaaacguucgaguggcugggcuggaugaagcccgugaccggggcagugagcuaugccaggaaauuucaagggcgcgugagcuuuuacaugaccagggaauugggcauggccuauauggaucucaggaacuugcgauuugacgauaccgcggucuauuucugugccaggaaaacggccggggacgugagcggggacaaucgcggguacuuuuucgaucucuggggcaggggcucgcgcgugaucgugagcucggccucgaccaagggcccgagcguguucccgaccauaugc

SEQ ID NO: 56400 - RNA, 417 nt, Artificial Sequence
  derived and/or modified sequence opt11 from anti-HIV-1_HeavyChain
caggcccaucucgagcaaucgggaucgggcgugaaaaagcccggagccucggucagggucucgugcuggaccucggaagauaucuuugaagggagcgagcucauacacugggucagacaagcgcccgggcaagggcucgaguggauaggcugggucaagaccgugaccggggccgugaacuuuggcucggccuauuucaggcacagggucucgcucacgcgcgaucgcgaucucuuuaccgcgcacauggacauacgcgggcuaacgcaaucggacacggccacguacuuuugcgcgcgccagaaauuuuacgcgggcgggcaagggugguauuucgaucucuggggcagaggcacgcucauagucgugagcucggccucgaccaagggcccgagcguguucccgcacgaucucaga

SEQ ID NO: 56401 - RNA, 426 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacgagcgaggacauauucgagcgcacggaauugaucuauugggugcgccaggccccgggcagaggccuggaauggaucgggugggugaaaacggucucgggcacggucaauuucgggagcucggacuuucgcaaucgcaucagcuugaccagggacagggacuugagcacggcccauauggauauaaggggccugacccaggacgacaccgcgaccuauuucugugccaggcaaaaguucgagagcuuguacucagacgaucaagggagcuauuucgaucucuggggcaggggcacgcucauaaucgugagcucggccucgcccaagggaccgagcgggcucccgcccaggagcgcg

SEQ ID NO: 56402 - RNA, 411 nt, Artificial Sequence
  derived and/or modified sequence opt11 from anti-HIV-1_HeavyChain
cagguccagcucgugcaaucgggcgcggaagugaaaaagcccggggccucggucaaggucucgugcaaggccucgggcuauaccuuuaccacguacgggaucucguggguacgccaggccccgggccagggcuuggaauggaucggaugggugaaaacggucacgggcgcggucaauuucgggcaccagaucucggacagggucucgcucacgcgcgaucgagaucucuuuacagcgcacauggacauacgcgggcucacgcaaggggacacggccacguacuuuugcgcgcgccagaaauuuuacgcgggcgggcaagggugguauuucgaucucuggggcaggggcacgcucauagucgugagcucggccucgaccaagggcccgagcguguucccgcacgaucucagg

SEQ ID NO: 56403 - RNA, 417 nt, Artificial Sequence
  derived and/or modified sequence opt11 from anti-HIV-1_HeavyChain
caggcccagcucgagcaaucgggcucgggcgugaaaaagcccggggccucggucaggguaucgugcuggaccucggaagauaucuuugaaaggaccgagcuaauacacugggucaggcaagcgcccgggcaagggcucgaguggauaggcugggucaagaccgugaccggggccgugaacuuuggcucgagcgauuucaggcaaagggucucacucacgcgcgaucgcgaucucuuuaccgcgcacauggacauacgcgggcuaacgcaaggggacacggccacguacuuuugcgcgcgccagaaauuuuacgcgggcgggcaagggugguauuucgaucucuggggcaggggcacgcucauagucgugagcucggcaucgaccaagggcccgagcguguucccgcacgaucucagg

SEQ ID NO: 56404 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccgaacuuuaggcauagggugagcuugacgagggacagggacuuguucacggcgcauauggauauaaggggguugacgcagggggauacggcgacguauuacugugcgaggcagaaguucgagaggggggggcaggggugguacuuugacuugugggggagggggacguugauaguggugaguagc

SEQ ID NO: 56405 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggacgagcgaggacauauucgagaaaucggaauugauacauugggugcgccaggccccgggccagggcuuggaauggaucgggugggugaaaacggucacgggcgcggucaauuucgggagcucggacuuucgccagcgcgugagccugaccagggacagggacuuguucacggcccauauggauaucaggggcuugacccagggagauaccgcgaccuauuacugugccaggcaaaaguucgagagcagguacacgggcggacaagggugguauuucgaucuauggggcaggggcacgcacauagucgugagcucg

SEQ ID NO: 56406 - RNA, 414 nt, Artificial Sequence
  derived and/or modified sequence opt11 from anti-HIV-1_HeavyChain
caggcccaucucgagcaaucaggcucgggcgugaaaaagccaggggccucggucagggucucaugcuggaccucggaagauaucuuugaaaggaccgagcucauacacugggucaggcaagcgcccgggcaagggcucgaguggauaggcugggucaagaccgugaccggggccgugaacuuuggcucacccaauuucaggcacagggucucgcucacgagagaucgagaucucuuuaccgcgcacauggacauacgcgggcucacgcaaggggacacggccacguacuuuugcgcacgccagaaauuugaaaggggcgggcaagggugguauuucgaucucuggggcaggggcacgcucauagucgugagcucggccucgaccaagggcccgagcguguucccgaccauaugc

SEQ ID NO: 56407 - RNA, 381 nt, Artificial Sequence
  derived and/or modified sequence opt11 from anti-HIV-1_HeavyChain
cagguccagcucgugcaaucgggcgcggaagugcaaaagcccggggccucggucacggucucgugcaaggccucgggcuauaccuugaucucauacgggaucucgugggugcgccaggccccgggccagggcccggaauggaugggguggauacgcccgaaaacgggcgcgcgcaaucaagcgcgccaguuccagcccaggaucucacucacgcgcgaucgcgcgcucucgaccgcguacuuggaccugaacucacucacgagcgcggacucgggcacguacuuuugcgcgcgccagaccuuuaaaccggacuuuuacuuugccgaucaaggguggucguucaaucucuggggcaggggcgcgcacuuuaucgugagcuca

SEQ ID NO: 56408 - RNA, 414 nt, Artificial Sequence
  derived and/or modified sequence opt11 from anti-HIV-1_HeavyChain
caggcccaucuagagcaaucgggcucgggcgugaaaaagcccggggccucggucagggucucgugcuggaccucggaagauaucuugcgaaagaaagagcucauacacugggucaggcaagcgcccgggcaagggcucgaguggauaggcugggucaagaccgugaccgggaccgugaacuuuggcucgagcgauuucaggcaaagggucucgcucacgcgcgaccgcgaucucuuuaccgcgcacauggacauacgcgggcucacgcaaggggacacggccacguacuugugcgcgcgacagaaauuugaaaggggcgggcaaggguggauauucgaucucuggggcaggggcacgcucauagccgugagcucggcaucgaccaagggcccgagcguguucccgcacgaucuc

SEQ ID NO: 56409 - RNA, 426 nt, Artificial Sequence
  derived and/or modified sequence opt11 from anti-HIV-1_HeavyChain
caggcccaucucgagcaaucaggcucgggcgugaaaaagccaggggccucggucagggucucgugcuggagcucggaagauaucuuugaaaggaccgagcuaauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgacagaaauuugaaucgcgcuauaccgggggccagggcugguacuuugacuugugggggcgagggacccauaucguggucucgagcgcgagcacgaacgggcccauaggcuugccccaucgcucggcc

SEQ ID NO: 56410 - RNA, 384 nt, Artificial Sequence
  derived and/or modified sequence opt11 from anti-HIV-1_HeavyChain
caagcacaccuggaacagagcggaagcgggguaaagaaaccaggcgcaagcgugcgcguaagcugcuggacgagcgaggacauauucggaaaaucggaacuaauccacugggugcgccaggccccgggccagggccuggaauggaucggaugggugaaaacggucacgggcgcggucaauuucgggagcucggacuuucgccagcgcgugagccugaccagggacagggacuuguucacggcccauauggauaucagaggccugacccagggcgacacagcgaccuacuucugcgccagacaaaaguucgagagccuguacucagacgaccaagggagcuauuucgaccuauggggcagaggcacgcucauaaucgugagcucc

SEQ ID NO: 56411 - RNA, 417 nt, Artificial Sequence
  derived and/or modified sequence opt11 from anti-HIV-1_HeavyChain
caggcgcacuuggagcagagcgggagcggggugaagaagccgggggcgagugugagggugagcuguuggacgagcgaggacauauucgagaggacggagcugauacauugggugaggcaggcgccggggcaggggcuggaguggauagggugggugaagauagugaguggggcggugaauuucgggaguccgaacuuuaggcagagggugagcuugacgagggacagggacuuguucacggcgcauauggauauaaggggguugacgcagggggauacggcgacguauuucugugcgaggcagaaguucgagaggggggggcaggggugguacuuugacuugugggggagggggacguugauaguggugaguagcgcgagcacgaaagggccgaguggguugccgcaugggagugcg

SEQ ID NO: 56412 - RNA, 423 nt, Artificial Sequence
  derived and/or modified sequence opt11 from anti-HIV-1_HeavyChain
cagguccaguacgggcgcgaggccggggccgggaugaagaaaccgggcgcgagcaugaccgugagcuguaaaacagccgacgaagauaucuuugacgcggccuauaugcaccgcguacgccaggccccaggccagaccuuugaauggcucggauggaugaaaccggucacgggcgcggucaacuacgcgcgccaguuccagggcagggucucguucuaucgcacgcgagagcucgggaucgcauacauggaccuacgcgaucucaaguucgaugacacggccguguacuuuugcgcgcgaaagaccaagggcgaugucucgggcgaugacaggggcuucuucuuugaccugugggggcgcgggaccagagucauagucucgagcgcgagcacgaaagggcccucggucuuucccacgaucuau

SEQ ID NO: 56413 - RNA, 426 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaacugauccauugggugcgccaggccccgggccagggcuuggaauggaucgggugggugaaaacggucacgggcgcggucaauuucgggagccuggacuuucgccaucgcaucagcuugaccagggacagagacuuguucacggcccauauggauauaagaggcuugacccagggcgauacagcgaccuauuucugugccaggcaaaaguucgagagcagguacacgggcgggcaaggaugguauuucgaucuauggggcaggggcacgcacauaguagugagcucggccucgaccaagggcccaagcguguucccgcacgaucucagg

SEQ ID NO: 56414 - RNA, 423 nt, Artificial Sequence
  derived and/or modified sequence opt11 from anti-HIV-1_HeavyChain
caaguccaacucguccaauccgaagccgaacucaaaaaacccggcgccuccgucucagucuccugcaaagccuccggcuacuccuucaccucauacggcaucuccuggguccgccaaguccccggccaaggccuagaauggaucgcauggauccgccccaaaaccggcgcccgcaaccaagcccgacaauuccaaccccgcaucucccucacccgcgaccgcgcccucuccaccgccuaccucgaccucaacucccucacauccgccgacuccggcaccuacuucugcgcccgccaaaccuucaaacccgacuucuacuucgccgaccaaggcugguccuucaaccucuggggccgcggcgcccacuucaucgucuccuccgccuccaccaaaggccccuccgucuucccccacgaccuccgc

SEQ ID NO: 56415 - RNA, 414 nt, Artificial Sequence
  derived and/or modified sequence opt11 from anti-HIV-1_HeavyChain
caagcgcacuuggaacagagcgggagcggggucaagaaaccgggcgcgagcgugcgaguaagcuguuggacgagcgaggacauauucgagcgaacggaauugauccauugggugcgccaggccccgggccagggcuuggaauggaucgggugggugaaaacggucacgggcgcggucaauuucgggagcccgaacuuucgacaucgcgugagcuugaccagggacagggaccuguucacggcacauauggauaucaggggcuugacccagggcgauacagcgacauauuacugugccaggcaaaaguucgagcgcgggggccagggcugguacuuugacuugugggggcgcgggaccuugaucguggucucgagcgcgagcacgaaagggcccaguguauuuccccaugacuug

SEQ ID NO: 56416 - RNA, 381 nt, Artificial Sequence
  derived and/or modified sequence opt11 from anti-HIV-1_HeavyChain
cagguccagcucgugcaaucgggcgcggaagugcaaaagcccggggccucggucacggucucgugcaaggccucaggcuauacccugaucucguacgggaucucguggguacgccaggccccgggccagggcccagaauggaugggauggauacgcccgaaaacgggcgcgcgcaaucaagcgcgccaguuccagcccaggaucucgcucacgcgcgaccgcgcgcucucgaccgcguaccuggacuugaacucgcucacgagcgcggacucgggcacguacuauugcgcgcgccagaccuuuaaaccggacuuuuacuucgccgaucaaggguggucguucaaucucuggggcaggggcgcgcacuuuaucgugagcucg

SEQ ID NO: 56417 - RNA, 414 nt, Artificial Sequence
  derived and/or modified sequence opt11 from anti-HIV-1_HeavyChain
caggcgcacuuggagcagagcgggagcggggugaagaaguugggggcgagcgugagggugagcuguuggacgagcgaggacauauucgagaggacggaguugauacauugggugaggcaggcgccggggcagggguuggaguggauagggugggugaaggcggugaguggggcggugaauuacgggagcuuggacuuuaggcauagggugagcuugacgagggacagggaccuguucacggcgcauauggauauaaggggguugacgcaggacgauacggcgacauauuucugugcgaggcagaaguucgcgaggggggaccaggggugguucuuugacuugugggggagggggacauugauaguggugucgagcgcgagcacgaaggggccgaguguguuuccgcagauaugu

SEQ ID NO: 56418 - RNA, 378 nt, Artificial Sequence
  derived and/or modified sequence opt11 from anti-HIV-1_HeavyChain
caggcgcacuuggagcagagcgggagcggggugaagaagccgggggcgagugugagggugagcuguuggacgagcgaggacauauucgagaggacggaguugauacauugggugaggcaggcgccggggcagggguuggaguggauagggugggugaagacggugacgggggcggugaauuucgggagcccgaacuuuaggcauagggugagcuugacgagggacagggacuuguucacggcgcauauggauauaaggggguugacgcagggggauacggcgacguauuucugugcgaggcagaaguucgagagaggggggcaggggugguacuuugacuugugggggagagggacguugauaugugugaguagcgcg

SEQ ID NO: 56419 - RNA, 438 nt, Artificial Sequence
  derived and/or modified sequence opt11 from anti-HIV-1_HeavyChain
caaggcuaccucgcccaauccggcggcggcgucaaaaaacccggcaccucagccuccuucuccugccguaccuccgacgacaucuacgacaacgaauucuucgacuccgccuucaugcacuggguccgccucauccccggccaacgacccgaauggaugggcuggaugaacccccgcuccggcgccgucaacuacgcccgccaacuccaaccacgcgucuccauguaccgcgaccgcgaccucuccaccgccuaccucgaccuaaacucccucaccuccgccgacuccggcaccuacuucugugcccgccaaaccuucaaacccgacuucuacuucgccgaccaaggcugguccuucaaccuauggggccgcggcgcccacuucaucgucucauccgccuccaccaaaggccccuccguccuaccacacgaccuccgc

SEQ ID NO: 56420 - RNA, 414 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucacgcacugggucaggcaagcgcccgggcaagggcucgaguggauaggcugggucaagaucgugagcggggccgugaacuuuggcucgcccaauuucaggcaaagggucucgcucacgcgcgaucgcgaucucuuuacagcgcacauggacauacgcgggcuaacgcaaggggacacggccacguacuuuugcgcgcgccagaaauuugaaaggggcgggcaaggguggauauucgaucucuggggcaggggcacgcucauagccgugagcucggccucgaccaagggcccgagcguguucccgcgcucggcc

SEQ ID NO: 56421 - RNA, 414 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagaaagagcucauacacugggucaggcaagcgcccgggcaagggcucgaguggauaggcugggucaagaccgugaccggggccgugaacuucggcucgagcgauuucaggcaaagggucucgcucacgcgcgaucgcgaccucuuuaccgcgcacauggacauacgcgggcuaacgcaaggggacacagccacguacuuuugcgcacgccagaaauuuuacgcgggcgggcaagggugguauuucgaucucuggggcaggggcacgcucauagucgugagcucggccucgaccaagggcccgagcguguucccgcacgaucuc

SEQ ID NO: 56422 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccauugggugcgacaggccccgggccagggcuuggaauggaucgggugggugaaaacggucacgggcgcggucaauuucgggagcuuggacuuucgccaucgcaucagcuugaccagggacagggacuuguucacggcccauauggauauaaggggcuugacccagggcgauaccgcgaccuauuacugugccaggcaaaaguucgagagcagguacacgggcgggcaagggugguauuucgaucucuggggcaggggaacgcacauagucgugagcucg

SEQ ID NO: 56423 - RNA, 414 nt, Artificial Sequence
  derived and/or modified sequence opt11 from anti-HIV-1_HeavyChain
caggcccaucucgagcaaucgggcucgggcgugaaaaagcccggggccucggucagggucucgugcuggacaucggaagauaucuuugaaaagagcgagcucauacacugggucaggcaagcgcccgggcaagggcucgaguggauaggcugggucaagaccgugaccggggccgugaacuuuggcucaagcgauuucaggcaaagggucucgcuaacgcgcgaucgcgaucucuuuaccgcgcacauggacauacgcgggcucacgcaaggggacacggccacguacuauugcgcgcgccagaaauuuuacgcgggcgggcaagggugguauuucgaucucuggggcaggggcacgcucauagucgugagcucggccucgaccaagggcccgagcguguucccgaccauaugc

SEQ ID NO: 56424 - RNA, 384 nt, Artificial Sequence
  derived and/or modified sequence opt11 from anti-HIV-1_HeavyChain
caagcgcacuuggaacagagcgggagcggggucaagaaauugggcgcgagcgugcgagugagcuguuggacgagcgaggacauauucgagcgcacggaauugauccauuggguacgccaggccccgggccagggccuggaauggaucgggugggugaaagcggucucgggcgcggucaauuacgggagcuuggacuuucgccaucgcgugagcuugaccagggacagagaccugagcacggcccauauggauaucaggggcuugacccaggacgauaccgcgaccuauuucugugccaggcaaaaguucgagagccuguacucggacgaucaagggagcuauuucgaucuauggggcaggggcacgcucauaaucgugagcuca

SEQ ID NO: 56425 - RNA, 426 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggaccuccgaagacaucuucgaaggcucagaacucauccacuggguccgccaagcccccggccaaggccucgaauggaucggaugggucaaaaccgucaccggcgccgucaacuucggcuccgccuacuuccgccaccgcgucucccucacccgcgaccgagaccucuucacagcccacauggacauccgcggccucacccaaggcgacaccgccaccuacuucugcgcccgacaaaaauucgaaucccgcuacaccggcggccaaggcugguacuucgaccuauggggccgcggcacccacaucgucgucuccuccgccucaaccaaaggccccuccgucuucccccacgaccuccgc

SEQ ID NO: 56426 - RNA, 408 nt, Artificial Sequence
  derived and/or modified sequence opt11 from anti-HIV-1_HeavyChain
caaguccaacucguccacuccggcgccgaagucaaaaaacccggcgccuccaugaaagucuccugcaaaaccuccggauacucauucaccggcuacuacaugcacuggguccgccaagcccccggccaaggccucgaauggaugggcuggaucaaccccuccuccaacgacaccaacuacgcccaaaaauuccaaggccgcgucaccaugacccgcgacaccuccaucaacaccgccuacauggaacucucccgccuccgcuccggcgacaccgccaucuacuucugcgcccgccaaaaauucuacgccggcggccaaggcugguacuucgaccucuggggccgcggcacccucaucgucgucuccuccgccucaaccaaaggcccauccgucuuccccaccaucugc

SEQ ID NO: 56427 - RNA, 381 nt, Artificial Sequence
  derived and/or modified sequence opt11 from anti-HIV-1_HeavyChain
cagguguauauggagcaggcagggggaggggugaagaagccgggggcgagugugacgcugaguuguaagacggcggaugaggauguguuugaugcggcguauaugcauugggugaggcaggcgccggggcagacguuugagugguugggguggaugaagccggugacgggggcggugagcuaugcgaggagguuucaggggagggugagcuuuuacaugacgagggaguuggggauggcguauauggaucugaggaauuugagguuugaugauacggcgguguauuuuugugcgaggaagacggcgggggaugugagcggggauaauaggggguauuucuuugaucugugggggagggggaguagggugauagugagcagu

SEQ ID NO: 56428 - RNA, 414 nt, Artificial Sequence
  derived and/or modified sequence opt11 from anti-HIV-1_HeavyChain
caagggaccuuggaacagagcuggagcgaggucaagaaauugggcgcgagcgugcgcgugagcuguuggacgagcgaggacauauucaagaccgagcucauacacugggucaggcaagcgccagggcaagggcucgaguggauaggcgggaugaaggccgugagcggggccgugaacuauggcucgcucgauuucaggcacagggucucgcucacgcccgaucgagaucucucgaccgcgcacauggacauacgcgggcucacgcaagaugacacggccacguacuuuugcgcgcgccagaaauuugccaggggcgaucaagggugguuuuucgaucucuggggcaggggaacgcuaauagucgugagcucggccucaacaaagggaccgagcguguucccgcacgaucucagg

SEQ ID NO: 56429 - RNA, 423 nt, Artificial Sequence
  derived and/or modified sequence opt11 from anti-HIV-1_HeavyChain
caagcccaccuagaacaauccggcuccggcgucaaaaaacccggcgccuccguccgcgucuccugcuggaccucagaagacaucuucgaaaaaucagaacucauccacuggguccgccaagcccccggccaaggccucgaauggaucggcugggucaaaaccgucacaggcgccguaaacuucgccucccuagacuuccgaaaccgcaucucccucucccgcgaccgcgaccucuccaccgccuacauggacauccgcggccuaacccaagacgacaccgccaccuacuucugcgcccgccaaaaauucgccucccgcuacuccggcgaccaaggcucauacuucgaccucuggggacgcggcacccucaucugcgucucauccgcauccacccgagcccaccgccuccccccccgcuccgcc

SEQ ID NO: 56430 - RNA, 414 nt, Artificial Sequence
  derived and/or modified sequence opt11 from anti-HIV-1_HeavyChain
caagcgcacuuagaacagagcgggagcggggucaagaaaccgggcgcgagcgugcgcgugagcuguuggacgagcgaggacauauucgagcgcacggaauugauccauugggugcgccaggccccgggccaaggcuuggaauggaucggguggguaaaaacggucacgggcgcggucaauuucgggagcccgaacuuucgccaucgagugagcuugaccagggacagggacuuguucacggcccauauggauaucaggggcuugacccagggcgauaccgcgaccuauuucugugccaggcaaaaguucgcgcgcggagaccagggcugguucuuugacuugugggggcgagggaccuugaucguggucucgagcgcgagcccgcgcgcgcacaggagcucgcccaggagcgcg

SEQ ID NO: 56431 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucagacaagcgcccgggcaagggcucgaguggauaggcugggucaagaccgugaccggggccgugaacuuuggaucgagcgauuucaggcaaagagucucgcucacgcgcgaucgcgaucucuuuaccgcgcacauggacauacgcgggcuaacgcaaggggacacggccacguacuuuugcgcgcgccagaaauuuuacgcgggcgggcaagggugguauuucgaucucuggggcaggggcacacucauagucgugagcucggccucgaccaagggcccgagcguguucccgcacgauagcgcg

SEQ ID NO: 56432 - RNA, 414 nt, Artificial Sequence
  derived and/or modified sequence opt11 from anti-HIV-1_HeavyChain
caagcgcacuugguccagagcgggagcggggucaagaaaccgggcgcgagcgugcgcgugagcuguuggacgagcgaggacauauucaagagcgagcucauacacugggucaggcaagcgcccgggcaagggcucgaguggauaggcugggucaagaccgugaccggggccgugaacuuuggcucaagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggaacgcuaauagucgugagcucggccucgaccaagggcccgagcguguucccgcacgaucucagg

SEQ ID NO: 56433 - RNA, 414 nt, Artificial Sequence
  derived and/or modified sequence opt11 from anti-HIV-1_HeavyChain
caagcgcaacuggaacagagcgggagcggggucaagaaaccgggcgcgagcgugcgcgugagcuguuggacgagcgaggacauauucaagaccgagcucauacacugggucaggcaagcgcccgggcaagggcucgaguggauaggcuggguaaagaccgugaccggggccgugaacuuuggcucgcccaauuucaggcacagggucucgcucacacgcgaucgcgaucuauuuaccgcgcacauggacauacgcgggcucacacaaggggacacggccacguacuuuugcgcgcgacagaaauuugaaaggggcgggcaagggugguauuucgaucucuggggcaggggaacgcucauagucgugagcucggccucgaccaagggcccgagcguguucccgcacgaccuaagg

SEQ ID NO: 56434 - RNA, 417 nt, Artificial Sequence
  derived and/or modified sequence opt11 from anti-HIV-1_HeavyChain
caggcccaucuagagcaaucgggcagggaagugaaaaagcccggggccucggucagggucucgugcuggaccucggaagauaucuuugaaaagagcgagcucauacacugggucaggcaagcgcccgggcaagggcucgaguggauaggcuggguuaagacagugaccggggccguaaacuuuggcucgagcgauuucaggcaaagagucucgcucacgcgcgaucgagaucucuuuaccgcgcacauggacauacgagggcucacgcaaggggacacggccacguacuuuugcgcgcgccagaaauuuuacgcgggcgggcaaggaugguauuucgaucucuggggcaggggaacgcucauagucgugagcucggccucgaccaagggcccgagcguguucccgcacgaucucagg

SEQ ID NO: 56435 - RNA, 384 nt, Artificial Sequence
  derived and/or modified sequence opt11 from anti-HIV-1_HeavyChain
caagcgcaccuggaacagagcgggagcggggucaagaaaccgggcgcgagcgugcgagugagcuguuggacgagcgaggacauauucgagcgaacggaacugauccauugggugcgccaggccccgggccagggccuggaauggaucgggugggugaaaacggucucgggcgcggucaauuucgggagcccgaacuuucgccauagaauaagccugaccagggacagggacuuguucacggcccauauggauaucaggggccugacccagggcgauaccgcgaccuauuacugugccaggcaaaaguucgagagcagguacacgggcgggcaagggugguauuucgaucucuggggcagaggcacgcacauagucgugagcuca

SEQ ID NO: 56436 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgaggggagugaguugauacauugggugaggcaggcgccggggcagggguuagaguggauagggugggugaagacggugacgggggcggugaauuucgggagcgcguacuuuaggcauagggugagcuugacgagggacagggacuuguucacggcgcauauggauauaaggggguugacgcagggggauacggcgacguauuacugugcgaggcagaaguucuauaagggggggcaggggugguacuuugacuugugggggagggggacguugauaguggugaguagc

SEQ ID NO: 56437 - RNA, 381 nt, Artificial Sequence
  derived and/or modified sequence opt11 from anti-HIV-1_HeavyChain
caaguccaacucguccaauccggcgcagaagucaaaaaacccggcgccucagucaaagucuccugcaaagccuccggcuacaccuucaccgacuacuaccuccacuggguccgccaagcccccggccaaggccuagacugggucggcuggaucaaccccaacuccggcggcaccaacuacgcccaaaaauuccaaggccgcgucgccaugacccgcgacaccucccucuccuccguauaccucgaccucaacucccucaccuccgccgacuccggcaccuacuucugcgcccgccaaacauucaaacccgacuucuacuucgccgaccaaggcugguccuucaaccucuggggccgcggcgcccacuucaucguauccucc

SEQ ID NO: 56438 - RNA, 414 nt, Artificial Sequence
  derived and/or modified sequence opt11 from anti-HIV-1_HeavyChain
caggccgaucucgagcaaucgggcucgggcgugaaaaagcccggggccucggucagggucucgugcuggaccucggaagauaucuuugaaaggaccaauuacgugcacugggucaggcaagcgcccgggcgcgggcucgaguggauaggcuggagcaagaccgugaccggggccgugaacuuuggcucgcccaauuucaggcacagagucucgcucacgcgcgaucgcgaucucuuuaccgcgcacauggacauacgagggcucacgcaaggggacacggcaacguacuuuugcgcgcgccagaaauuugaaaggggcggacaagggugguauuucgaucucuggggcaggggcacgcuaauagucgugagcucggccucgaccaagggcccgagcguguucccgcacgaccuc

SEQ ID NO: 56439 - RNA, 381 nt, Artificial Sequence
  derived and/or modified sequence opt11 from anti-HIV-1_HeavyChain
cagguguauauggagcaggcggggggggggaugaagaagccgggggcgagcaugacggugaguuguaagacggcggaugaggauauauuugaugcggcguauaugcauugggugaggcaggcgccggggcagacguuugaguggcugggguggaugaagccggugacgggggcggugaauuaugcgaggcaguuucaggggagggugaguuuuuauaggacgagggaguuggggauagcguauauggaucugagggaucugaaguuugaugauacggcgguguauuuuugugcgaggaagacgaagggggaugugagcggggacgauaggggguuuuuuuuugauuugugggggagagggacgagggugauagugaguagu

SEQ ID NO: 56440 - RNA, 384 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugaaaggaccgagcucauauacugggucaggcaagcgcccgggcgcgggcuagaguggauaggcugggucaagaccgugagcgggaccgugaacuuuggcucgagcgauuucaggaacaggaucucgcucacgcgcgaucgcgaucucucgaccgcgcacauggacauacgcgggcucacgcaagaugacacggccacguacuuuugcgcgcgccagaaauuugaaucgcucuauagcgaugaccagggcucguacuuugacuugugggggcgcgggaccuugaucauagucucgagc

SEQ ID NO: 56441 - RNA, 414 nt, Artificial Sequence
  derived and/or modified sequence opt11 from anti-HIV-1_HeavyChain
caggcccaccuagagcaaucgggcucgggcgucaaaaagcucggggccucgguaaggguaucaugcuggaccucggaagauaucuuugaaaggaccaaccucauacacugggucaggcaagcgcccgggcaagggcucgaguggauaggcugggucaaggccgugagcggggccgugaacuauggcucgcucgacuucaggcacagggucucgcucacgcgagaucgcgaucucucaaccgcgcacauggacauacgcggacucacgcaagaugacacggccacguacuuuugcgcgcgccagaaauuugccaggggcgaucaagggugguuuuucgaucucuggggcaggggcacgcucauagucgugagcucggccucgaccaagggcccgagcguguucccgcacgaucuc

SEQ ID NO: 56442 - RNA, 381 nt, Artificial Sequence
  derived and/or modified sequence opt11 from anti-HIV-1_HeavyChain
cagguguauauggagcaggcgggggggggggugaagaagccgggggcgagugugacguugaguuguaagacggcgggggaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggauuugaggaauuugagguuugaugauacggcgguguauuuuugugcgaggaagacggcgggggaugugaguggggauaagaggggguuuuuuuuugauuugugggggagggggaguagggugauagugaguagc

SEQ ID NO: 56443 - RNA, 384 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugaaaggaccgagcucauauacugggucaggcaagcgcccgggcgcgggcucgaguggauaggcugggucaagaccgugagcgggaccgugaacuuuggcucgagcgauuucaggaacaggaucucgcucacacgcgaucgagaucucucgaccgcgcacauggacauacgcgggcucacgcaagaugacacggccacguacuuuugcgcgcgccagaaauuugaaucgcuauauagcgaugaccagggcucguacuuugacuugugggggcgcgggaccuugaucacggucucgagc

SEQ ID NO: 56444 - RNA, 429 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggucauccgaagacaucuucgaacgcaccgaacucauccacuggguacgccaagcccccggccaaggccucgaauggaucggcugggucaaaaccgucaccggcgccgucaacuucggcucccucgacuuccgccaccgcaucucccuaacccgcgaccgcgaccucuucaccgcccacauggacauccgaggccucacccaaggcgacaccgccaccuacuucugcgcccgccaaaaauucgaaucccgcuacaccggcggccaaggcugguacuucgaccucuggggccgaggcacacacaucgucgucuccuccgccuccaccaaaggccccuccggccucccccccaccaucugccgc

SEQ ID NO: 56445 - RNA, 417 nt, Artificial Sequence
  derived and/or modified sequence opt11 from anti-HIV-1_HeavyChain
caggcccaucucgagcaaucgggcucgggagugaaaaagcccggggccucggucagggucucgugcuggaccucggaagauaucuuugaaaagagcgagcucauacacugggucagacaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggagacacggccacauacuuuugcgcgcgccagaaauuugccaggggcgaucaagggugguuuuucgaucucuggggcaggggcacgcucauagucgugagcucggccucgaccaagggcccgagcguguucccgcacgaucucagg

SEQ ID NO: 56446 - RNA, 417 nt, Artificial Sequence
  derived and/or modified sequence opt11 from anti-HIV-1_HeavyChain
caagcacaccuagaacagagcggaagcggagucaaaaaaccgggcacaagcguacgcguaagcugcuggacaagcgaagacauauucgaacgcacagaacugauacacugggugcgccaggccccgggccagggccuagaauggaucggauggguaaaaacagucacgggcgcgguaaacuucggaagcccgaacuuccgccaccgcguaagccuaaccagagacagggaccuauucacggcccacauggacaucagaggccuaacccagggcgacaccgcaaccuacuucugcgccagacaaaaauucgaacgaggaggccagggcugguacuucgaccuguggggacgcgggacccugaucguagucucaagcgcaagcacaaaagggcccucagucuucccccacgaccugcgc

SEQ ID NO: 56447 - RNA, 417 nt, Artificial Sequence
  derived and/or modified sequence opt11 from anti-HIV-1_HeavyChain
caggcccaucucgagcaaucgggcucgggcgugaaaaagcccggggccucggucaggguaucgugcuggaccucggaagauaucuuugaaaggaccgagcucauacacugggucaggcaagcgcccgggcaagggcucgaguggauaggaugggucaagaccgugaccggggccgugaacuucggcucgcccaauuuccggcacagggucucgcucacgcgcgggcgcgaccucuuuaccgcgcacauggacauacgcgggcucacgcaaggggacacggccacguacuauugcgcgcgccagaaauuugaaaggggcgggcaagggugguauuucgaucuauggggcaggggcacgcucauagucgugagcucggcaucgaccaagggcccgagcguguucccgcacgaucucagg

SEQ ID NO: 56448 - RNA, 411 nt, Artificial Sequence
  derived and/or modified sequence opt11 from anti-HIV-1_HeavyChain
caagcgcacuugggcgcgaacuggagcggggucaagaaauugggcgcgagcgugcgcgugagcuguuggacgagcgaggacauauucgagcgcacggaauugauccauugggugcgccaggcaccgggccagggcuuggaauggaucgggugggugaaagcggucucgggcgcggucaauuacgggagcuuggacuuucgccaucgcgugagcuugaccagggacagggacuuaagcacggcccauauggauaucaggggcuugacccaggacgauaccgcgaccuauuucugugccaggcaaaaguucgcgcgcggggaccagggaugguucuuugacuugugggggcgcgggaccuugaucguggucucgagcgcgagcacgaaagggcccucggucuuuccccagauc

SEQ ID NO: 56449 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgacuucaggcaaagggucucgcucacgcgcgaucgagaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56450 - RNA, 423 nt, Artificial Sequence
  derived and/or modified sequence opt11 from anti-HIV-1_HeavyChain
caagcgcaauuggaacagagcggggucggggucaagaaaccgggcgcgagcgugcgcgugagcugucucgcgagcgaggacauauucaagaccgagcucauacacugggucaggcaagcgcccgggcaagggcucgaguggauaggcugggucaagaccgugaccggggccgugaacuuuggcucgcaaauauucagacacagaaucucgcucacgcgcgaucgcgaucuauuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagcgcgagcacgaaagggcccucggucuuuccccaugacuugcgc

SEQ ID NO: 56451 - RNA, 411 nt, Artificial Sequence
  derived and/or modified sequence opt11 from anti-HIV-1_HeavyChain
caagcgcacuuggaacagagcggaagcggggucaagaaaccgggcgcgagugugcgcgugagcuguuggacgagcgaggacauauucgagaaaucagaauugauccauugggugcgccaggccccgggccagggcuuggaauggaucgggugggugaaaacggucacgggcgcggucaauuucgcgcaccagaucucggacagggucucgcucacgcgcgaucgcgaucucuuuaccgcgcacauggacauacgcgggcucacgcaaggggacacggccacguacuuuugcgcacgacagaaauuuuacgcgggagggcaagggugguauuucgaucucuggggaaggggcacgcucauagucgugagcucggccucgaccaagggcccgagcguauucccgaccauaugc

SEQ ID NO: 56452 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggagcgagcucauacacugggucaggcaagcgcccgggcaagggcuagaguggauaggcugggucaagaccgugaccggggccgugaacuuuggcucgccaaauuucaggcacagagucucgcucacgcgcgaucgcgaucucuuuaccgcgcacauggacauacgagggcucacgcaaggggacacggccacguacuuuugcgcgcgccagaaauauuacgcgggcgggcaagggugguauuucgaccucuggggcaggggaacgcucauaugcgugagcucg

SEQ ID NO: 56453 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggagcugauacauugggugagacaggcgccggggcagggguuggaguggauagggugggugaagacggugaguggggcggugaauuucgggagcccgaacuuuaggcauagggugagcuugacgagggacagggacuuguucacggcgcauauggauauaaggggguugacgcagggggauacggcgacguauuucugugcgaggcagaaguucgagaggggggggcaggggugguacuuugacuugugggggagggggacguugauagugguaaguagc

SEQ ID NO: 56454 - RNA, 375 nt, Artificial Sequence
  derived and/or modified sequence opt11 from anti-HIV-1_HeavyChain
caggcgcacuuggagcagagcgggaguggggugaagaaguugggggcgagcgugagggugagcuguuggacgagcgaggacauauucgagaggacggaguugauacauugggugaggcaggcgccgggaaggggguuggaguggauagggugggugaaggcgguaaguggggcggugaauuacgggagcuuggacuuuaggcauagggugagcuugacgagggacagggacuuguucacggcgcauauggauauaagggggcugacgcaggacgauacggcgacguauuucugugcgaggcagaaguucgcgagaggggaccaggggugguucuuugacuugugggggagggggacguugauaguggugaguagc

SEQ ID NO: 56455 - RNA, 381 nt, Artificial Sequence
  derived and/or modified sequence opt11 from anti-HIV-1_HeavyChain
cagguguauauggagcaggcgggggggggggugaagaagccgggggcgagugugacguugaguuguaagacggcggaugaggggguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggauuugaggaauuugagauuugaugauacggcgguguauuuuugugcgaggaagacggcgggggaugugaguggggauaagaggggguuuuuuuuugauuugugggggagggggaguagggugauagugaguagu

SEQ ID NO: 56456 - RNA, 375 nt, Artificial Sequence
  derived and/or modified sequence opt11 from anti-HIV-1_HeavyChain
caggcgcauuuggagcagagcgggagcggggugaagaagccgggggcgagcgugagggugaguuguuggacgagugaggacauauuugaggggagugaguugauacauugggugaggcaggcgccggggcagggguuggaguggauagggugggugaagacggugacgggggcggugaauuucgggagugcguacuuuaggcauagggugagcuugacgagggacagggacuuguuuacggcgcauauggauauaaggggguugacgcagggggauacggcgacguauuucugugcgaggcagaaguauuaugcgggggggcaggggugguacuuugacuugugggggagggggacguugauaguggugaguagc

SEQ ID NO: 56457 - RNA, 378 nt, Artificial Sequence
  derived and/or modified sequence opt11 from anti-HIV-1_HeavyChain
caaguguacauggaacagcccggggucgaggucacgaaaccgggcgcgagcgugaccuugagcuguaaaacggccgaggacguguucgaugccgcguacaugcacugggucaggcaagcgcccgggcaaacguucgagugguugggcuggaucaagcccgugaccggggccgugaacuaugcaaggaaauuucaagggcgcgugagcuuuuacaggaccagggaauugggcauagccuauauggaucucaggaacuugcgcuuugacgauaccgcggucuauuucugugccaggaaaacggccggggacgugagcggggacaagcgcggguucuuuuucgaucucuggggcaggggcucgcgcgugaucgugagcucg

SEQ ID NO: 56458 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaagagugaguugauacacugggugaggcaggcgccggggcagggguuggaguggauagggugggugaagacggugacgggggcggugaauuucgggagcagugacuuuaggcagagggugaguuugacgagggacagggacuuguucacggcgcauauggauauaaggggguugacgcagggggauacggcgacguauuucugugcgaggcagaaguucgagaggggggggcagggguggauauuugacuugugggggagggggacguugauaauagugaguagc

SEQ ID NO: 56459 - RNA, 384 nt, Artificial Sequence
  derived and/or modified sequence opt11 from anti-HIV-1_HeavyChain
caagcccaccucguccaauccggcuccgaagucaaaaaacccggcgccuucguccgcgucuccugcuggaccucagaagacaucuucgaagaaaccgaacucauccacuggguccgacaagcccccggccaaggccucgaauggaucggcugggucaaaacagucaccggcgccgucaacuucggcucccucgacuuccgccaccgcaucucccucacccgcgaccgcgaccucuucaccgcccacauggacauccgcggccucacccaaggcgacaccgccaccuacuucugcgcccgccaaaaauucgaaucccgcuacaccggcggccaaggcugguacuucgaccucuggggccgcggcacccacaucgucgucuccucc

SEQ ID NO: 56460 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguaaagcgagcgaggacauauucgagcgaacggaauugauccauugggugcgccaggccccgggccagggcuuggaauggaucgggugggugaaaacggucacgggcgcggucaauuucgggagcccgaacuuucgccaucgcgugagccugaccagggacagggacuuguucacggcccauauggauaucaggggcuugacccagggcgauaccgcgaccuauuucugugccaggcaaaaguucgagcgcgggggccagggcugguacuuugacuugugggggcgcgggaccuugaucguggucucgagc

SEQ ID NO: 56461 - RNA, 375 nt, Artificial Sequence
  derived and/or modified sequence opt11 from anti-HIV-1_HeavyChain
caggcgcacuuggagcagagcgggagcgaggugaagaagccgggggcgagcgugagggugagcuguuggacgagcgaggacauauucgagaggacggaguugauacauugggugaggcaggcgccggggcagggguuggaguggauagggugggugaagacggugaguggggcggugaauuucgggagcccgaacuuuaggcauagggugagcuugacgagggacagggaccuguucacggcgcauauggauauaaggggguugacgcagggggauacggcgacguauuucugugcgaggcagaaguucgagaggggagggcaggggugguacuuugacuugugggggagggggacguugauaguggugaguagc

SEQ ID NO: 56462 - RNA, 375 nt, Artificial Sequence
  derived and/or modified sequence opt11 from anti-HIV-1_HeavyChain
caggcccaucucgugcaaucgggaucgggcgugaaaaagcccggggccucggucagggucucgugcuggaccucggaagauauauuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggaacgcucauagucgugagcucg

SEQ ID NO: 56463 - RNA, 375 nt, Artificial Sequence
  derived and/or modified sequence opt11 from anti-HIV-1_HeavyChain
caggcgcacuuggagcagagcgggagcggggugaagaaguugggggcgagcgugagggugagcuguuggacgagcgaggacauauucgagaggacggaguugauacauugggugaggcaggcgccggggcagggguuggaguggauagggugggugaaggcggugaguggggcggugaauuacgggaguuuggacuuuaggcauagggugagcuugacgagggacagggacuugagcacggcgcauauggauauaaggggguugacgcaggacgauacggcgacguauuucugugcgagacagaaguucgagaggggggggcaggggugguacuuugacuugugggggagggggacguugauaugugugaguagc

SEQ ID NO: 56464 - RNA, 375 nt, Artificial Sequence
  derived and/or modified sequence opt11 from anti-HIV-1_HeavyChain
caggcccaucucgagcaaucgggcucgggcgugaaaaagcccagggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacagccacguacuuuugcgcgcgccagaaauuuuacgcgggcgggcaagggugguauuucgaucucuggggcaggggcacgcuuauagucgugagcucg

SEQ ID NO: 56465 - RNA, 381 nt, Artificial Sequence
  derived and/or modified sequence opt11 from anti-HIV-1_HeavyChain
cagguccagcuagagcaagcgggcgcgggcgugaaaaagcccgggcccucggucacgcucucgugcaagaccgcggacgaggacguguucgaugccgcguacaugcacugggucaggcaagcgcccgggcaaacguucgagugguugggcuggaugaagcccgugacaggggccgugagcuaugccaggaaauuucaagggcgcgugagcuuuuacaugaccagggaauugggcauggccuauauggaucucaggaacuugcgcuuugacgauaccgcggucuauuucugugccaggaaaacggccggggacgugagcggggacaaucgaggguacuuuuucgaucucuggggcaggggcucgcgcgugaucgugagcucg

SEQ ID NO: 56466 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagacagugagcggggccgugaacuuuggcucgcccaauuucaggcaaagggucucgcucacgcgcgaucgcgaucucuuuaccgcacacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56467 - RNA, 381 nt, Artificial Sequence
  derived and/or modified sequence opt11 from anti-HIV-1_HeavyChain
caaguguucauggaacaggccggggccgggaugaagaaaccgggcgcgagcaugaccgugagcuguaaaacggccgaugaagaugucuuugacgcggccuauaugcauugggugcgccaggccccgggccagaccuuugaauggcucggguggaugaaaccggucacgggcgcggucaauuacgcgcgcaaguuccagggcagggucucguucuaccgcacgcgcgagcucgggaucgcguacauggacuugcgcaaucucagguucgaugacacggccguguacuuuugcgcgcgcaagaccgcgggcgaugucucgggcgauaaaaggggcuuuuucuuugacuugugggggcgcgggagcagggucauagucucgagc

SEQ ID NO: 56468 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggcgagcuguuggacgagcgaggacauauucgagaggacggaguugauacauugggugaggcaggcgccggggcagggguuggaguggauagggugggugaagauagugaguggggcggugaauuucgggagcccgaacuuuaggcagagggugagcuugacgagggacagggacuuguucacggcgcauauggauauaaggggguugacgcagggggauacggcgacguauuucugugcgaggcagaaguucgagaggggggggcagggguggauauuugacuugugggggagggggacguugauagcgguaucgagc

SEQ ID NO: 56469 - RNA, 381 nt, Artificial Sequence
  derived and/or modified sequence opt11 from anti-HIV-1_HeavyChain
cagguguauauggagcaggcggggggggggaugaagaagccgggggcgagcaugacggugaguuguaagacggcggaugaggauauauuugaugcggcguauaugcauugggugagacaggcgagggggcagacguuugaguggcugggguggaugaagccggugacgggggcggugaauuaugcgaggcaguuucagggaagggugaguuuuuauaggacgagagaguuggggauagcguauauggacuugagagauuugaaguuugaugauacggcgguguauuuuugugcgaggaagacgaagggggaugugaguggggaugacaggggguuuuuuuuugacuugugggggagggggacgagggugauagugaguagc

SEQ ID NO: 56470 - RNA, 384 nt, Artificial Sequence
  derived and/or modified sequence opt11 from anti-HIV-1_HeavyChain
caggcccaucuagagcaaucgggcgcgggcgugaaagagcccggggccucggucagggucucgugcuggagcucggaagauaucuuugaaaggaccgagcucauacacugggucaggcaagcgcccgggcaagggcuagaauggauaggcugggucaagaccgugaccggggccgugaacuuuggcucgcuagauuucaggcacaggaucucgcucacgcgcgaucgcgaucucuugaccgcgcacauggacauacgcgggcuaacgcaaggggacacggccacguacuuuugcgcgcgccagaaauuugaaucacgcuauaccgggggccagggcugguacuuugacuugugggggcgcgggacccauaucguggucucgagc

SEQ ID NO: 56471 - RNA, 384 nt, Artificial Sequence
  derived and/or modified sequence opt11 from anti-HIV-1_HeavyChain
caaguccaacucguccaauccggcuccgccaugaaaaaacccggagccuccgucagagucuccugcuggaccuccgaagacaucuucgaacgcaccgaacucaucuacuggguccgacaagcccccggccgcggccucgaauggaucggcugggucaaaaccgucuccggcaccgucaacuucggcuccuccgacuuccgcaaccgcaucucccucacccgcgaccgcgaccucuccaccgcccacauggacauccgcggccucacccaagacgacaccgccaccuacuucugcgcccgccaaaaauucgaaucccucuacuccgacgaccaaggcuccuacuucgaccucuggggccgcggcacccucaucauagucuccucc

SEQ ID NO: 56472 - RNA, 384 nt, Artificial Sequence
  derived and/or modified sequence opt11 from anti-HIV-1_HeavyChain
caagcgcacuugguccagagcgcgagcggggucaagcgcccgggcgcgagcgugcgcgugagcuguuggacgagcgaggacauauucgagcgcacggaauugaucuauugggugagacaggccccgggccagggcuuggaauggaucgggugggugaaaacggucucgggagcggucaauuucgggagccaggacuuucgccaucgcaucagcuugacaagggacagggacuuguucacggcccauauggauauaaggggcuugacccagggcgauaccgcgaccuauuucugugccaggcaaaaguucgagagcagguacacgggcgggcaagggugguauuucgaucucuggggcagaggcacgcacauagucgugagcucg

SEQ ID NO: 56473 - RNA, 381 nt, Artificial Sequence
  derived and/or modified sequence opt11 from anti-HIV-1_HeavyChain
cagguauauauggagcaggcgggggggggggugaagaagccgggggcgagugugacgcugaguuguaagacagcggacgaggauguguucgaugcggcguauaugcauugggugaggcaggcgccggggcagacguuugagugguugggguggaugaagccggugacgggggcggugaguuaugcgaggaaguuucaggggagggugagcuuuuacaugacgagggaguuggggauggcguauauggaucugaggaauuugagauuugacgauacggcgguguauuuuugugcgaggaagacggcaggggaugugaguggggauaagaggggguuuuuuuuugauuugugggggagggggaguagggugauagugagcagu

SEQ ID NO: 56474 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagggcuauaugauacacugggucaggcaagcgcccgggcaagggcuagaguggauaggcugggucaagaccgugaccggggccgugaacuuuggcucggccuauuucaggcacaggguaucgcucacgcgcgaucgcgaucucuuuaccgcgcacauggacauacgcgggcucacgcaaggggacacggccacguacuuuugcgcgcgccagaaauuuuacaagggcgggcaagggugguauuucgaucucuggggcaggggcacgcucauagucgugagcucg

SEQ ID NO: 56475 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcgcgggcucgaguggauaggcugggucaaggccgugagcggggccgugaacuauggcucgcucgauuucaggcacagggucucgcuaacgcgcgaucgcgaucucuuuaccgcgcacauggacauacgagggcucacgcaagaugacacggccacguacuuuugcgcgcgccagaaauuugccaggggcgaucaagggugguuuuucgaucucuggggcaggggcacgcucauaugcgugagcucg

SEQ ID NO: 56476 - RNA, 375 nt, Artificial Sequence
  derived and/or modified sequence opt11 from anti-HIV-1_HeavyChain
caggcccaucucgugcaaucgggcucgggcgugaaaaagagcggggccucggucagggucucgugcuggaccucggaagauaucuuugaaaagagcgagcucauacacuggguaaggcaagcgcccgggcaagggcucgaguggauaggcugggucaagaccgugaccggggccgugaacuuuggcucgagcgauuucaggcaaagggucucgcucacgcgagauagagaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56477 - RNA, 378 nt, Artificial Sequence
  derived and/or modified sequence opt11 from anti-HIV-1_HeavyChain
caggucuauauggagcgcgcgggcgcgggcgugaaaaagcccggggccucggucacgcucucgugcaagaccgcggacgaggacguguucggggccuauaugcauugggugcgccaggccccgggccagaccuuugaauggcucggguggaugaaaccggucacgggcgcggucucguacgcgcgcaaguuccagggcagggucucguucuauaugacgcgcgagcucgggauggcguacauggacuugcgcaaucucagguucgaugacacggccguguacuuuugcgcgcgcaagaccgcgggcgaugucucgggcgauaacaggggcuauuucuuugacuugugggggcgcgggagcaggguaauagucucgagc

SEQ ID NO: 56478 - RNA, 375 nt, Artificial Sequence
  derived and/or modified sequence opt11 from anti-HIV-1_HeavyChain
caggcgcacuuggagcagagcgggagcggggugaagaagccgggggcgagugugagggugagcuguuggacgagcgaggacauauucgaggggagugaguugauacauugggugaggcaggcgccggggcagggguuggaguggauagggugggugaagacggugacgggggcggugaauuucgggagcgcguacuuuaggcauagagugagccugacgagggacagggacuuguucacggcgcauauggauauaaggggguugacgcagggggauacggcgacguauuucugugcgaggcagaaguucuauaagggggggcaggggugguacuuugacuugugggggagggggacguugauaguggugaguagc

SEQ ID NO: 56479 - RNA, 375 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacgagcgaggacauauucgagcgcacggaauugaucuauugggugcgccaggccccgggcaggggcuuggaauggaucgggugggugaaaacggucucgggcacggucaauuucgggagcucggacuuucgaaaucgcgugagccugacaagggacagggacuuguucacggcccauauggauaucagaggcuugacccaggacgauaccgcgaccuauuucugugccaggcaaaaguucgcgcgcggggaccagggcugguucuuugacuugugggggcgcgggaccuugaucguggucucgagc

SEQ ID NO: 56480 - RNA, 384 nt, Artificial Sequence
  derived and/or modified sequence opt11 from anti-HIV-1_HeavyChain
caagcgcacuugguccagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucgcgggcgcagucaauuucucgagccuggacuuucgccaucgcaucagcuugaccagggacagggacuuguucacggcccauauggauauaaggggcuugacccagggcgauacagcgaccuauuucugugccaggcaaaaguucgagagcagguacacgggcgggcaagggugguauuucgaucucuggggcaggggcacgcacauagucgugaguucg

SEQ ID NO: 56481 - RNA, 384 nt, Artificial Sequence
  derived and/or modified sequence opt11 from anti-HIV-1_HeavyChain
caggcgcaccuggaacagagcgggagcgggguaaagaaaaguggggcgagcgcgagggugagcuguuggucgagcgaggacauauucgagagaacggaacugauacauugggugagacaggcaccaggacagggauuggaauggauagggugggugaaaacgguaacaggcgcgguaaauuucgggagcuuggacuuuagacauagaauaagccugacaagggacagggacuuguucacggcacauauggauaucaggggacugacacagggagauacagcgacauauuucugugcaaggcaaaaguucgagagcagguacacgggagggcaagggugguauuucgaucuauggggaaggggaacgcacauaguagugagcagu

SEQ ID NO: 56482 - RNA, 369 nt, Artificial Sequence
  derived and/or modified sequence opt11 from anti-HIV-1_HeavyChain
uugcuccagcucgugcaaucgggagcggaagugaaaaagcccggggccucggucaaggucacgugcaaggccucgggcuauaccuuuaccggguacauacacugggucaggcaagcgccagggcaagggcucgaguggauaggcuggguaaaggccgugagcggggccguaaacuauggcucgcucgauuucaggcacagggucucgcucacgcacgaucgagaucuaucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56483 - RNA, 369 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcgggugcacguucacgggcuauuacaugcacugggucaggcaagcgcccgggcaagggcucgaguggaugggcuggaucaaucccaauagcgggggcacgaacuaugcccagaaauuucaagggcgcgugaccaugaccagagacacgagcauaagcacggccuauauggagcucucgcgcuugcgcucggacgauaccgcggucuauuacugugccaggcaaaaguucgcgcgcggggaccagggcugguucuuugacuugugggggcgcgggaccuugaucguggucucgagc

SEQ ID NO: 56484 - RNA, 369 nt, Artificial Sequence
  derived and/or modified sequence opt11 from anti-HIV-1_HeavyChain
caaguccaacucguccaaucaggcaccgaacuccgcaaacccggcgccucagucaaagucuccugcaaagccucaggcuacaccuucuccggcagcuacauccacuggguccgccaagcccccggccaaggccuagaaugggucggcuggaucaaccccagcuccggcgccacccaaugcgccaaaaaauuccaagacaaagucaccaugacacgcgacaccacaaacaacaccgucuacauggaagucaaccgacucauaucagacgacaccgccaccuacuucugcgcccgccaaaaauucgcccgcggcgaccaaggcugguucuucgaccucuggggcagaggcacccucaucgucgucuccucc

SEQ ID NO: 56485 - RNA, 372 nt, Artificial Sequence
  derived and/or modified sequence opt11 from anti-HIV-1_HeavyChain
caagugcucuugguccagagcggggccgaggucaagaaaccgggcucgagcgugaaagugagcuguaaaacgagcggggacucgcucacgaaauaugcccugcacugggccaggcaagcgcccgggcaagggcuagaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56486 - RNA, 372 nt, Artificial Sequence
  derived and/or modified sequence opt11 from anti-HIV-1_HeavyChain
caagugcaacugguccagagcgggaccgaggucaagaccccgggcgcgagcgugaaagugagcuguaaagcgagcggguacacguucacgaacuaugacauaaacugggucaggcaagcgcccgggcaagggcucgaguggauaggcuggguaaagaccgugaccggggccgugaacuuuggcucgagcgauuucaggcaaagggucucgcucacgcgagaucgcgaucucuuuaccgcgcacauggacauacgcgggcucacgcaaggggacacggccacguacuuuugcgcgcgccagaaauuuuacgcgggcgggcaagggugguauuucgaucucuggggaaggggcacgcucauagucgugagcucg

SEQ ID NO: 56487 - RNA, 372 nt, Artificial Sequence
  derived and/or modified sequence opt11 from anti-HIV-1_HeavyChain
caagugcaauugguccagagcggggacgaggucaagaaaccgggcgcgagcgugaaagugagcuguaaagcgagcgggaaaggguucccgaccucgcuagugaccuggguaaggcaagcgcccgggcaagggcucgaguggauaggcugggucaaggccgugagcggggccgugaacuauggcucgcucgauuucaggcacagggucucgcucacgcgcgaucgcgaucucuuuaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56488 - RNA, 372 nt, Artificial Sequence
  derived and/or modified sequence opt11 from anti-HIV-1_HeavyChain
caagugcaauugguccagagcggggccgaggucaagaaaccgggcucgagcgugaaagugagcuguaaaacgagcggggacauacucacgaacuauggccugaacugggucaggcaagcgcccgggcaagggcucgaguggauaggcugggucaaggccgugagcggggccgugaacuauggcucgcucgauuucaggcacagggucucgcuaacgcgcgaucgcgaucucucgacagcgcacauggacauacgcgggcucacgcaagaugacacggcaacguacuuuugcgcgcgccagaaauuugccaggggcgaucaagggugguuuuucgaucucuggggcaggggcacgcucauagucgugagcucg

SEQ ID NO: 56489 - RNA, 372 nt, Artificial Sequence
  derived and/or modified sequence opt11 from anti-HIV-1_HeavyChain
caagugcaauugguccagagcggggccgaggucaagaaaccgggcgcgagcgugagagugagcuguaaaacgagcggguacccguucucgcgcuauggcauaagcugggucaggcaagcgcccgggcaagggcucguguggauggccugggucaaggccgugagcggggccgugaacuauggaucgcucgauuucaggcacagggucucgcucacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56490 - RNA, 372 nt, Artificial Sequence
  derived and/or modified sequence opt11 from anti-HIV-1_HeavyChain
cgcgagcaacugguccagagcggggccgaggucaagaaaccgggcgcgagcgugaaagugagcuguaaaacgagcgggaacacguucgggagcuaugacuuuaacugggucaggcaagcgcccgggcaagggcucgaguggauaggcugggucaagaucgugagcggggccgugaacuuuggcucgcccaauuucaggcaaagggucucgcucacgcgcgaucgagaucucuuuaccgcgcacauggacauacgcgggcucacgcaaggggacacggccacguacuuuugcgcgcgccagaaauuugaaaggggcgggcaaggguggauauucgaucucuggggcaggggaacgcucauagccgugagcucg

SEQ ID NO: 56491 - RNA, 372 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacacauucacgagcuauuacaugcacugggucaggcaagcgcccgggcaagggcucgaguggauaggaugggucaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgccagaaauauuacgcgggagggcaagggugguauuucgaucucuggggcaggggcacgcucauagucgugagcucg

SEQ ID NO: 56492 - RNA, 372 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacacguucacgagcuauuacaugcacugggucaggcaagcacccgggcaagggcucgaguggauaggcugggucaagaccgugaccgggaccgugaacuuuggcucgcuaaauuucaggcaaagggucucgcucacgcgcgaucgcgaucucuuuaccgcgcacauggacauacgcgggcuaacgcaaggggacacggccacguacuuuugcgcgcgccagaaauuugaaaggggcgggcaagggugguauuucgaucucuggggcaggggcacgcucauagucgugagcucg

SEQ ID NO: 56493 - RNA, 372 nt, Artificial Sequence
  derived and/or modified sequence opt11 from anti-HIV-1_HeavyChain
caagugcaauugggccagagcggggccgagaugaagaaaccgggaucgagcgugaaagugagcuguaaagcgagcgggggcacguucaggcacucgcccauaagcugggucaggcaagcgcccgggcaagggcucgaguggauaggcugggucaaggccgugagcggggccgugaacuauggcucgcucgauuucaggcacagggucucgcucacgcgcgaucgcgaucucucgacagcgcacauggacauacgcgggcucacgcaagaugacacggccacguacuuuugcgcgcgccagaaauuugccaggggcgaucaagggugguuuuucgaucucuggggcaggggaacgcucauagucgugagcucg

SEQ ID NO: 56494 - RNA, 369 nt, Artificial Sequence
  derived and/or modified sequence opt11 from anti-HIV-1_HeavyChain
caaguccaacucguccaauccggcgccgaaguccgcacccccggcgccuccgucaaagucuccugcaaagccucaggcuacaacuucaucgccuaccacguccacuggguccgccaagcccccggccaaggccucaccuggaugggcuggaucaaccccgacuccggcgacaccgucuacgcccaaaacuucgucgaccgcgucaugaugacccgcaacaccuccauccaaaccgucuaccucgaacucaacguacucacccucgaagacaccgccaccuacuucugcgcccgccaaaaauucgcccgcggcgaccaaggcugguucuucgaccucuggggccgcggcacccucauagucgucuccucc

SEQ ID NO: 56495 - RNA, 372 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacacguucacggucuauuacaugcacuggguaaggcaagcgccagggcgcgggcucgaguggauaggcugggucaaggccguaagcggggccgugaacuauggcucgcucgauuucaggcacagggucucgcucacgcgcgaucgcgaucucuuuaccgcgcacauggacauacgcgggcucacgcaagaugacacggccacguacuuuugcgcgcgacagaaauuugccaggggcgaucaagggugguuuuucgaucucuggggcaggggcacgcucauagucgugagcucg

SEQ ID NO: 56496 - RNA, 375 nt, Artificial Sequence
  derived and/or modified sequence opt11 from anti-HIV-1_HeavyChain
caggcgcacuuggagcagagcgggagcggggugaagaaguugggggcgagugugagggugagcuguuggacgagcgaggacauauucgagaggacggaguugauacauugggugaggcaggcgccggggcagggguuggaguggauagggugggugaaggcggugaguggggcggugaauuacgggagccuggacuuuaggcauagggugagcuugacgagggacagggacuuauucacggcgcauauggauauaagagggcugacgcagggggauacggcgacguauuucugugcgaggcagaaguucgagaggggggggcaggggugguacuuugaccugugggggagggggacguugauaguggugaguagc

SEQ ID NO: 56497 - RNA, 372 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacacguucauaggcuauuacaugcacugggucaggcaagcgcccgggcaagggcuagaguggaugggcugggucaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgccagaaauuugaaaggggcgggcaagggugguauuucgaucucuggggcaggggcacgcucauagucgugagcucg

SEQ ID NO: 56498 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccggggcagggacuggaguggauagggugggugaagacggugaguggggcggugaauuucgggagcuugaacuuuaggcauagggugagcuugacgagggacagggacuuguucacggcgcauauggauauaagggggcugacgcagggggauacggcgacguauuucugugcgaggcagaaguucgcgagaggggaccaggggugguucuuugacuugugggggagggggacguugauaguggugucgagc

SEQ ID NO: 56499 - RNA, 372 nt, Artificial Sequence
  derived and/or modified sequence opt11 from anti-HIV-1_HeavyChain
caagcgcacuuggaacagagcgggaguggggucaagaaauugggcgcgagcgugcgcgugagcuguuggacgagcgaggacauauucaaggacaggaucgaucacugggucaggcaagcgcccgggcaagggcucgaguggauaggcugggucaaggccgugagcggggccgugaacuauggcucgcucgauuucaggcacagggucucgcucacgcgagaucgcgaucucuuuaccgcgcacauggacauacgcgggcuaacgcaagaugacacggccacguacuuuugcgcgcgacagaaauuugccaggggcgaucaagggugguuuuucgaccucuggggcaggggcacgcucauagucgugagcucg

SEQ ID NO: 56500 - RNA, 375 nt, Artificial Sequence
  derived and/or modified sequence opt11 from anti-HIV-1_HeavyChain
cagguccagcucgcgcaaucgggcgcggaagugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucuuuacagcgcacauggacauacgcgggcucacgcaagaugacacggccauauacuuuugcgcgcgccagaaauuugccaggggcgaucaagggugguuuuucgaucucuggggcaggggcacgcucauagucgugagcucg

SEQ ID NO: 56501 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauaagcaaggccgagcucauacacugggucaggcaagcgcccgggcaagggcucgaguggauaggcugggucaagaccgugagcggggccgugaacuuuggcucgcccaauuucaggcacagggucucgcucacgcgcgaucgcgaucucuuuaccgcgcacauggacauacgcgggcuaacgcaaggggacacggccacguacuuuugcgcgcgccagaaauuugaaaggggcgggcaagggugguauuucgaucucuggggcaggggcacgcucauagucgugagcucg

SEQ ID NO: 56502 - RNA, 372 nt, Artificial Sequence
  derived and/or modified sequence opt11 from anti-HIV-1_HeavyChain
accgcgcacuuggaacagagcgggagcggggucaggcgcccgggcgcgagcgugcgcgugagcuguuggacgagcggggacauauucaagagcgagcucauacacugggucaggcaagcgcccgggcaagggcuagaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56503 - RNA, 372 nt, Artificial Sequence
  derived and/or modified sequence opt11 from anti-HIV-1_HeavyChain
caagcgcacuuggaacagagcgggagcggggucaagcgcccgggcgcgagcgugcgcgugagcuguuggacgagcgaggacauauucaauaccgagcucauacacugggucaggcaagcgcccgggcaagggcuagaguggauaggcugggucaagaccgugagcggggccgugaacuuuggcucgcucaauuucaggcacagggucucgcuaacgcgcgaucgcgaucucuuuaccgcgcacauggacauacgcgggcucacgcaaggggacacggcaacguacuuuugcgcgcgccagaaauuugccaggggcgaucaagggugguuuuucgaucucuggggcaggggcacgcucauagucgugagcucg

SEQ ID NO: 56504 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucaagaccgagcucauacacugggucaggcaagcgcccgggcaagggcucgaguggauaggcugggucaaggccgugagcggggccgugaacuauggcucgcucgauuucaggcacagggucucgcuaacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcuaauagucgugagcucg

SEQ ID NO: 56505 - RNA, 372 nt, Artificial Sequence
  derived and/or modified sequence opt11 from anti-HIV-1_HeavyChain
caagugcaauugguccagagcggggcagaggucaagaaaccgggcgcgagcgugcgcgugagcuguaaagcgagcggguacacguucacggccuauuacauacacugggucaggcaagcgccagggcaagggcucgaguggauaggcugggucaagaccgugagcggggcagugaacuuuggcucgcccaauuucaggcacagggucucgcucacgcgagaucgcgaucucuuuacagcgcacauggacauacgcgggcucacgcaaggggacacggccacguacuuuugcgcgcgccagaaauuugaaagaggcgggcaagggugguauuucgaucucuggggcaggggcacgcuaauagucgugagcucg

SEQ ID NO: 56506 - RNA, 372 nt, Artificial Sequence
  derived and/or modified sequence opt11 from anti-HIV-1_HeavyChain
caagcgcacuuggaacagagcgggagcgagagcaagaaaccgggcgcgagcgugcgcgugagcuguuggucgagcgaggacauauucaagaccgagcucauacacugggucaggcaagcgcccgggcaagggcucgaguggauaggcugggucaagaucgugagcggggccgugaacuuuggcucgcccaauuucaggcaaagggucucgcucacgcgcgaucgcgaucucuuuaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucg

SEQ ID NO: 56507 - RNA, 375 nt, Artificial Sequence
  derived and/or modified sequence opt11 from anti-HIV-1_HeavyChain
caggcgcauuuggagcagagcgggagcgaggugaagaagccgggggcgagugugagggugagcuguuggacgagugaggacauauucgagaagagcgaguugauacauugggugaggcaggcgccggggcagggguuggaguggauagggugggugaagacggugacgggggcggugaauuucgggagcagcgacuuuaggcagagggugaguuugacgagggacagagacuuguuuacggcgcauauggauauaaggggguugacgcagggggauacggcgacguauuucugugcgaggcagaaguucuaugcgggggggcaggggugguauuuugacuugugggggagggggacguugauaguggugagcagc

SEQ ID NO: 56508 - RNA, 372 nt, Artificial Sequence
  derived and/or modified sequence opt11 from anti-HIV-1_HeavyChain
caagcgcacuuggaacaggucugggccggggucaagaaauugggcgcgagcgugcgagugagcuguuggacgagcgaggacauauucaagaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucucgaccgcgcacauggacauacgcgggcucacgcaagaugacacggccacguacuuuugcgcgcgccagaaauuugcaaggggcgaucaagggugguuuuucgaucucuggggcaggggcacgcucauagucgugagcucg

SEQ ID NO: 56509 - RNA, 372 nt, Artificial Sequence
  derived and/or modified sequence opt11 from anti-HIV-1_HeavyChain
caagcgcacuuggaacagagcgggagcggggucaagaaaccgggcgcgagugugcgcgugagcuguuggacgagcgaggacauauucgagcgcucggaauugauccauugggugcgccaggccccgggccagggcuuggaauggaucgggugggugaaaacggucacgggcgcggucaauuucgggagcaauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcagaggcacgcucauagucgugagcucg

SEQ ID NO: 56510 - RNA, 375 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcccccggccaaggccuagaauggaucggcugggucaaaaucgucuccggcaccgucaacuucgccucccucgacuuccgccaccgcgucucccucacccgcgaccgcgaccucuccaccgcccacauggacauccgaggccucacccaagacgacaccgccaccuacuucugcgcccgccaaaaauucgcccgcggagaccaaggcugguucuucgaccucuggggccgcggcacccucaucgucgucuccucc

SEQ ID NO: 56511 - RNA, 375 nt, Artificial Sequence
  derived and/or modified sequence opt11 from anti-HIV-1_HeavyChain
caagcgcacuuggaacagagcgggagcggggucaagaaaccgggcacgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccaucgcgugagcuugaccagggacagggacuuguucacggcccauauggauaucaggggcuugacccagggcgauaccgcgaccuauuucugugccaggcaaaaguucgcgcgcggggaccagggcugguucuuugacuugugggggcgcgggacccugaucguggucucgagc

SEQ ID NO: 56512 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcggggggauauucgagaggacggaguugauacauugggugaggcaggcgccggggcagggguuggaguggauagggugggugaagacggugacgggagcggugaauuucgggagcccgaacuuuaggcauagggugagcuugacgagggacagggacuuguucacggcgcauauggauauaaggggguugacgcagggggauacggcgacguauuucugcgcgaggcagaaguucgagaggggggggcaggggugguacuuugacuugugggggagggggacguugauaguggugaguagc

SEQ ID NO: 56513 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggucgagcgaggacauauucgagcgcacggaauugauccauugggugcgccaggcaccgggccagggcuuggaauggaucggaugggugaaaacggucacgggcgcggucaauuucgggagccuggacuuucgccaucgcaucagcuugaccagggacagggacuuguucacggcccauauggauauaaggggcuugacccaggacgauaccgcgaccuauuucugugccaggcaaaaguucgcgcgcggggaccagggcugguucuuugacuugugggggcgcgggacauugaucguggucucgagc

SEQ ID NO: 56514 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucaagagcgagcucauacacugggucaggcaagcgcccgggcaagggcucgaguggauaggcugggucaagaccgugaccggggccgugaacuuuggcucgagcgauuucaggcaaagagucucgcucacgcgcgaucgcgaccuauuuaccgcgcacauggacauacgcggacuaacgcaaggggacacggccacguacuuuugcgcgcgccagaaauuugaaaggggcgggcaaggguggauauucgaucucuggggcaggggcacgcucauagccgugagcucg

SEQ ID NO: 56515 - RNA, 375 nt, Artificial Sequence
  derived and/or modified sequence opt11 from anti-HIV-1_HeavyChain
caggcccaucucgagcaaucgggcucgggcgugaaaaggcccggggccucggucagggucucgugcuggaccucggaagauaucuuugaaacgaccgagcucauacacugggucaggcaagcgcccgggcaagggcucgaguggauaggcugggucaagaccgugagcggggccguaaacuuuggcucgcucaauuucaggcacagggucucgcuaacgcgcgaucgcgaucuauuuaccgcgcacauggacauacgagggcucacgcaaggggacacggccacguacuuuugcgcgcgccagaaauuugccaggggcgaucaagggugguuuuucgaucucuggggcaggggcacgcucauagucgugagcucg

SEQ ID NO: 56516 - RNA, 375 nt, Artificial Sequence
  derived and/or modified sequence opt11 from anti-HIV-1_HeavyChain
caggcccaucucgagcaaucgggcucgggcgugaaaaagcuaggggccucggucagggucucgugcuggaccucggaagauaucuuugaaaggaccgagcuaauacacugggucaggcaagcgcccgggcaagggcuagaguggauaggcugggucaaggccgugagcggggccgugaacuauggcucgcucgauuucaggcaaagggucucgcuaacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauugucgugagcucg

SEQ ID NO: 56517 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccauugggugcgccaggccccgggacagggcuuggaauggaucgggugggugaaaacggucacgggcgcggucaaucuagugcaccagaucucggacagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56518 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgggcgagaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56519 - RNA, 375 nt, Artificial Sequence
  derived and/or modified sequence opt11 from anti-HIV-1_HeavyChain
caagcgcacuuagaacagagcggggccggggucaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccaucgcgugagcuugaccagggacagggacuuguucacggcccauauggauaucaggggcuugacccagggcgauaccgcgaccuauuucugugccaggcaaaaguucgagcgcgggggccagggcugguacuuugacuugugggggcgcgggacauugaucguggucucgagc

SEQ ID NO: 56520 - RNA, 375 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggacauccgaagacaucuucgacaccaccgaacuaauccacuggguccgccaagcccccggccaaggccucgaauggaucggcugggucaaagccgucuccggcgccgucaacuacggcucccucgacuuccgccaccgcgucucccucacccgcgaccgcgaccucuccaccgcccacauggacauccgcggccucacccaagacgacaccgccaccuacuucugcgcccgccaaaaauucgcacgcggcgaccaaggcugguucuucgaccucuggggccgcggcacccucaucgucgucuccucc

SEQ ID NO: 56521 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucaagaccgagcucauacacugggucagacaagcgcccgggcaagggcucgaguggauaggcugggucaagaccgugagcggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgccagaaauucgaaaggggcgggcaagggugguauuucgaucucuggggcaggggcacgcucauagucgugagcucg

SEQ ID NO: 56522 - RNA, 375 nt, Artificial Sequence
  derived and/or modified sequence opt11 from anti-HIV-1_HeavyChain
caagugcacuuggaacagagcgggagcggggucaagaaauugggcgcgagcgugcgcgugagcuguuggacgagcgaggacauauucgagcgcacggaacugauccauugggugcgacaggccccgggccagggcuuggaauggaucgggugggugaaagcagucucgggcgcggucaauuacgggagcuuggacuuucgacaucgcgugagcuugaccagggacagggacuuguucacggcccauauggauaucaggggcuugacacaggacgauaccgcgaccuauuucugugccaggcaaaaguucgcgcgcggggaccagggcugguucuuugacuugugggggcgcgggaccuugaucguggucucgagc

SEQ ID NO: 56523 - RNA, 372 nt, Artificial Sequence
  derived and/or modified sequence opt11 from anti-HIV-1_HeavyChain
caagcgcacuuggaacagagcgcgagcggggucaagcgcccgggcgcgagcgugcgcgugagcuguuggacgagcgaggacauauucgagcgcucggaacugaucuauugggugcgccaggccccgggccagggcuuggaauggaucgggugggugaaaacggucucgggcgcggucaaucucgcgcccaauuucaggcaaagggucucgcucacgcgcgaucgcgaucucuuuaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucg

SEQ ID NO: 56524 - RNA, 372 nt, Artificial Sequence
  derived and/or modified sequence opt11 from anti-HIV-1_HeavyChain
caagcgcacuuggaacagagcgggagcgggguaaagaaaccgggcgcgagcgugcgcgugagcuguuggacgagcgaggacauauucaagagcgagcucauacacugggucaggcaagcgcccgggcaagggcucgaguggauaggcugggucaagaccgugaccggggccgugaacuuuggcucgagugauuucagacaaagggucucgcucacgcgcgauggcgaucucuuuaccgcgcacauggacauacgcgggcucacgcaaggggacacggccacguacuuuugcgcgcgacagaaauuuuacgcgggcgggcaagggugguauuucgaucucuggggcaggggcacgcucauaaucgugagcucg

SEQ ID NO: 56525 - RNA, 375 nt, Artificial Sequence
  derived and/or modified sequence opt11 from anti-HIV-1_HeavyChain
caggcacaccuagagcaaagcggaagcggagugaaaaagcugggggcaagcguaaggguaagcugcuggacgagcgaagacauauucgaaagaacagagcuaauacacuggguaaggcaggcaccagggcaagggcuagaguggauaggauggguaaaggcagugagcggggcagugaacuacggaagccuagacuucaggcacaggguaagccugacgagcgacagagaccuaagcacagcgcacauggacauaagagggcugacgcaagacgacacggcaacguacuucugcgcgagacagaaauucgcaaggggagaccaagggugguucuucgaccuauggggaaggggaacgcuaauaguagugagcagc

SEQ ID NO: 56526 - RNA, 375 nt, Artificial Sequence
  derived and/or modified sequence opt11 from anti-HIV-1_HeavyChain
caggcccaucucgagcaaucgggcucgggcgugaaaaagcccggggccucggucaggguaucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56527 - RNA, 372 nt, Artificial Sequence
  derived and/or modified sequence opt11 from anti-HIV-1_HeavyChain
caagcgcaccuggaacagagcgggagcggggucaagaaaccgggcgcgagcgugcgcgugagcuguuggacgagcgaggacauauucaagagcgagcucauacacugggucaggcaagcgcccgggcaagggcucgaguggauaggcugggucaagaccgugaccggggccgugaacuuuggcucgagcgauuucaggcaaagggucucgcuaacgcgcgaucgcgaucucuuuaccgcgcacauggacauacgcgggcucacgcaaggggacacggccacguacuuuugcgcgcgccagaaauuugaaaggggcgggcaagggugguauuucgaucucuggggcaggggcacgcucauagucgugagcucg

SEQ ID NO: 56528 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauacauugggugcgccaggccccgggccagggcuuggaauggaucgggugggugaaaacggucacgggcgcggucaauuucgggcaccagaucucggacagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56529 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaagagugaguugauacauugggugaggcaggcgccggggcagggguuggaguggauagggugggugaagacggugacgggggcggugaauuucgggagcagugacuuuaggcagagggugagcuugacgagggacagggacuuguucacggcgcauauggauauaaggggguugacgcaggacgauacggcgacguauuucugugcgaggcagaaguuugcgaggggggaccaggggugguucuuugacuugugggggagggggacguugauaguggugaguagc

SEQ ID NO: 56530 - RNA, 372 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauacucaagaccgagcucauacacugggucaggcaagcgcccgggcaagggcucgaguggauaggcugggucaaggccgugagcggggccgugaacuauggcucgcucgauuucaggcacagggucucgcuaacgcgcgaucgagaucucuuuaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56531 - RNA, 372 nt, Artificial Sequence
  derived and/or modified sequence opt11 from anti-HIV-1_HeavyChain
gucaggagcgugguccagugcgaggccggggucaagaaaccgggcgcgagcgugaaaauaagcugugccacgagcggguacgcguucacgcucuauuacuugcacugggucagacaagcgcccgggcaagggcucgaguggauaggcugggucaagaccgugaccggggccgugaacuuuggcucggccuauuucaggcacagggucucgcucacgcccgaucgcgaucucuuuaccgcgcacauggacauacgcgggcucacgcaaggggacacggccacguacuuuugcgcgcgccagaaauuuuacaagggcgggcaagggugguauuucgaucucuggggcaggggcacgcucauagucgugagcucg

SEQ ID NO: 56532 - RNA, 375 nt, Artificial Sequence
  derived and/or modified sequence opt11 from anti-HIV-1_HeavyChain
caagcgcacuuggaacagagcgggagcggggucaagaaauugggcgcgagcgugcgagugagcugucucgauagcgaggacauauucgagcgcacggaauugauccauuggguacgccaggccccgggccagggcuuggaauggaucgggugggugaaagcggucucgggcgcggucaauuacgggagcuuggacuuucgacaucgagugagcuugaccagggacagggacuuguucacggcccauauggauaucaggggcuugacccaggacgauacagcgaccuauuucugugccaggcaaaaguucgcgcgcggggaccagggcugguucuuugacuugugggggcgcgggaccuuaaucguggucucgagc

SEQ ID NO: 56533 - RNA, 375 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcucauauacugggucaggcaagcgcccgggcaagggcucgaguggauaggcugggucaagaucgugagcgggaccgugaacuucgccucgcucgauuucaggaacaggaucucgcucucacgcgaucgcgaccucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56534 - RNA, 375 nt, Artificial Sequence
  derived and/or modified sequence opt11 from anti-HIV-1_HeavyChain
caggcgcacuuggagcagagcgggagcggggugaagaaguugggggcgagcgugaagaguagcuguuggacgagcgaggacauauucgagaggacggaguugauacauugggugaggcaggcgccggggcagggguuggaguggauagggugggugaaggcggugaguggggcggugaauuacgggagcuuggacuuuaggcauagggugagccugacgagggacagggacuugagcacggcgcauauggauauaaggggguugacgcaggacgauacggcgacguauuucugugcgaggcagaaguucgcgaggggagaccaggggugguucuuugacuugugggggagggggacgcugauaguggugaguagc

SEQ ID NO: 56535 - RNA, 375 nt, Artificial Sequence
  derived and/or modified sequence opt11 from anti-HIV-1_HeavyChain
caggcccaucucgagcaaucgggcgcgggcgugaaaaagcccggggccucggucagggucucgugcuggaccucggaagauaucuuugaaaggaccgagcucauacacugggucaggcaagcgcccgggcaagggcucgaguggauaggcugggucaagaucgugagcggggccgugaacuuuggcucgcccaauuucaggcaaagggucucgcucacgcgcgaucgcgaucucuuuaccgcgcacauggacauacgagggcucacgcaaggggacacggccacguacuuuugcgcgcgacagaaauuugaaaggggcgggcaaggguggauauucgaucuauggggcaggggcacgcucauagccgugagcucg

SEQ ID NO: 56536 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugagacaggcgccggggcagggguuggaguggauaggguggaugaagacggugacgggggcggugaauuucgggagcccgaacuuuaggcauagggugagcuugacgagggacagggacuuguucacggcgcauauggauauaagggggcugacgcagggggauacggcgacguauuucugugcgaggcagaaguucgagaggggagggcaggggugguacuuugacuugugggggagggggacguugauaguggugaguagc

SEQ ID NO: 56537 - RNA, 375 nt, Artificial Sequence
  derived and/or modified sequence opt11 from anti-HIV-1_HeavyChain
caagcgcacuuggaacagagcgggagcgaggucaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccaucgcgugagcuugaccagggacagagacuuguucacggcccauauggauaucaggggcuugacccagggcgauaccgcgaccuauuucugugccaggcaaaaguucgagcgcgggggccagggcugguacuuugacuugugggggcgcgggaccuugaucguggucucgagc

SEQ ID NO: 56538 - RNA, 375 nt, Artificial Sequence
  derived and/or modified sequence opt11 from anti-HIV-1_HeavyChain
caggcgcauuuggagcagagcggggcgggggugaagaagcugggggcgagugugagggugagcuguuggacgagcggggacauauucgagaggacggaguugauacauugggugaggcaggcgccggggcagggguuggaguggauagggugggugaaggcggugaguggggcggugaauuacgggagcuuggacuuuaggcagagggugaguuugacgagggacagggacuuguucacggcgcauauagauauaaggggguugacgcagggggauacggcgacguauuucugugcgaggcagaaguucgagaggggggggcagggguggauauuugacuugugggggagggggacguugauagcggugaguagc

SEQ ID NO: 56539 - RNA, 375 nt, Artificial Sequence
  derived and/or modified sequence opt11 from anti-HIV-1_HeavyChain
caagcgcacuuggaacagagcgggagcggggucaagaaacugggcgcgagcgugcgcgugagcuguugggcgagcgaggacauauucgagagaacggaauugauccauugggugcgccaggccccgggccagggccuggaauggaucgggugggugaaagcggucucgggcgcggucaauuacgggagcuuggacuuucgccaucgcgugagcuugaccagggacagggacuugagcacggcccauauggauaucaggggcuugacccaggacgauaccgcgaccuauuucugugccaggcaaaaguucgcgcgcggggaccagggcugguucuuugacuugugggggcgagggaccuugaucguggucucgagc

SEQ ID NO: 56540 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccggggcaggggcuggaguggauaggguggguaaagacggugacggggacggugaauuucgggagccagaacuuuaggcagagggugagcuugacgagggacagggacuuguucacggcgcauauggauauaaggggguugacgcagggggauacggcgacguauuucugugcgaggcagaaguucgagaggggggggcagggguggauauuugacuugugggggagggggacguugauagcggugaguagc

SEQ ID NO: 56541 - RNA, 375 nt, Artificial Sequence
  derived and/or modified sequence opt11 from anti-HIV-1_HeavyChain
caagcacaccuggaacagagcggaagcggaguaaaacgcccgggcgcaagcguacgcgugagcugcuggacgagcgaagacauauucgagaccacagaacuaauccacuggguacgacaggccccgggccaaggccuggaauggaucggauggguaaaaacagucacaggcgcagucaacuucggaagcccgaacuuccgacaccgcgugagccugaccagagacagagaccuauucacagcccacauggacaucagaggccuaacccaaggcgacaccgcgaccuacuucugcgccagacaaaaauucgaacgcgggggccagggcugguacuucgaccugugggggcgcgggacccuaaucguagucucaagc

SEQ ID NO: 56542 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuugcgcaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcuaauagucgugagcucg

SEQ ID NO: 56543 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggacgagcgaggacauauucaagaccgagcucauacacugggucaggcaagcgcccgggcaagggcucgaguggauaggcugggucaagaccgugaccgggaccgugaacuuuggcucgcucaauuucaggcaaagggucucgcucacgcgcgaucgcgaucucuuuaccgcgcacauggacauacgcgggcuaacgcaaggggacacggccacguacuuuugcgcgcgccagaaauuuuacgcgggcgggcaagggugguauuucgaucucuggggcaggggcacgcucauagucgugagcucg

SEQ ID NO: 56544 - RNA, 375 nt, Artificial Sequence
  derived and/or modified sequence opt11 from anti-HIV-1_HeavyChain
caggcacaccuagagcaaagcggaagcggagugaaaaagcuaggggcaagcguaaggguaagcugcuggacaagcgaagacauauucgaaaggacagagcugauacacuggguaaggcaggcgccggggcaagggcuggaguggauaggauggguaaaggcagugagcggggcagugaacuacggaagccuagacuucaggcacaggguaagccugacgagggacagagaccuguucacagcgcacauggacauaagagggcugacgcaagacgacacggcgacguacuucugcgcgagacagaaauucgcaaggggagaccaggggugguucuucgaccuguggggaagggggacgcugauaguagugagcagc

SEQ ID NO: 56545 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaaggacucgaguggauaggcugggucaagaccgugaccggggccgugaacuuuggcucgagcgauuucagacaaagggucucgcucacgcgcgaucgcgaucucuuuaccgcgcacauggacauacgcggacucacgcaaggggacacggccacguacuuuugcgcgcgccagaaauuuuacgcgggagggcaagggugguauuucgaucucuggggcaggggcacgcuaauagucgugagcucg

SEQ ID NO: 56546 - RNA, 375 nt, Artificial Sequence
  derived and/or modified sequence opt11 from anti-HIV-1_HeavyChain
cagguccagcucgugcaaucgggcgcggaagugaaaaagcccggggccucggucagggucucgugcuggaccucggaagauaucuuugaaaggagcgagcucauauacugggucaggcaagcgcccgggcgcgggcucgaguggauaggcuggaucaagcucgugagcggggccgugaacuuuggcucggucgauuucagggacagggucucgcucacgcgcgaucgcgaucucuuuaccgcgcacauggacauacgcgggcuaacgcaagaugacacggccacguacuuuugcgcgcgccagaaauuugccaggggcgaucaagggugguuuuucgaucucuggggcaggggcacgcucauagucgugagcucg

SEQ ID NO: 56547 - RNA, 375 nt, Artificial Sequence
  derived and/or modified sequence opt11 from anti-HIV-1_HeavyChain
caagcgcacuuggaacagagcaggagcggggucaagaaaccgggcgcgagcgugcgcgugagcuguuggacaagcgaggacauauucgagcgcacggaauugauccauugggugcgccaggccccgggccagggcuuggaauggaucgggugggugaaagcggucucgggcgcggucaauuucgggagcccgaacuuucgccaucgcgugagccugaccagggacagggacuugagcacggcccauauggauaucaggggcuugacccaggacgauacagcgaccuauuucugugccaggcaaaaguucgcgcgcggggaccagggcugguucuuugacuugugggggcgcgggaccuugaucguggucucgagc

SEQ ID NO: 56548 - RNA, 375 nt, Artificial Sequence
  derived and/or modified sequence opt11 from anti-HIV-1_HeavyChain
cagagcuaucucgagcaaucgggcucggccaugaaaaagcccggggccucggucagggucucgugcuggaccucggaagauaucuuugacacgaccgagcucauauacugggucaggcaagcgcccgggcaagggcucgaguggauaggcugggucaagaucgugagcgggaccgugaacuuugccucgcucgauuucaggaacaggaucucgcuaucgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56549 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagacagagcucauacacugggucaggcaagcgcccgggcaagggcucgaguggauaggcugggucaaggccgugagcggggccgugaacuauggcucgcucgauuucaggcacagggucucgcucacgcgcgaucgcgaucucuuuacagcgcacauggacauacgcgggcucacgcaagaugacacggccacguacuuuugcgcgcgccagaaauuugccaggggcgaucaagggugguuuuucgaucucuggggcaggggcacgcuaauagucgugagcucg

SEQ ID NO: 56550 - RNA, 372 nt, Artificial Sequence
  derived and/or modified sequence opt11 from anti-HIV-1_HeavyChain
caagcgcacuuggaacagagcgggagcggggucaagaaaccgggagcgagcgugcgcgugagcuguuggacgagcgaggacauauucaagagcgagcucauacacugggucaggcaagcgccagggcaagggcucgaguggauaggcugggucaagaccgugaccggggccgugaacuuuggcucgagcgauuucaggcaaagggucucgcucacgcgcgaucgcgaucucuuuaccgcgcacauggacauacgagggcuaacgcaaggggacacggccacguacuuuugcgcgcgccagaaauuuuacgcgggcgggcaagggugguacuucgaucucuggggcaggggcacgcucauagucgugagcucg

SEQ ID NO: 56551 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccagggcagggguuggaguggauagggugggugaagacggugaguggggcgguaaauuucgggagcccgaacuuuaggcauagggugagcuugacgagggacagggacuuguucacggcgcauauggauauaaggggguugacgcaggacgauacggcgacguauuucugugcgaggcagaaguucgcgaggggggaccaggggugguucuuugacuugugggggagggggacguugauaguggugaguagu

SEQ ID NO: 56552 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaauaguaucgggcgcggucaauuucgggagcccgaacuuucgccagcgagugagcuugaccagggacagggacuuguucacggcccauauggauaucaggggcuugacccagggcgauaccgcgaccuauuucugugccaggcaaaaguucgcgcgcggggaccagggcugguucuuugacuugugggggcgcgggaccuugaucguggucucgagc

SEQ ID NO: 56553 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcuaacgcgcgaucgagaucucuuuaccgcgcacauggacauacgcgggcucacgcaaggggacacggccacguacuuuugcgcgcgccagaaauuuuacgcgggcgggcaagggugguauuucgaucucuggggcaggggcacgcuaauagucgugagcucg

SEQ ID NO: 56554 - RNA, 375 nt, Artificial Sequence
  derived and/or modified sequence opt11 from anti-HIV-1_HeavyChain
cagagccaucuagagcaaucgggcucggccaugaaaaagcccggggccucggucaggguaucaugcuggaccucggaagauaucuuugacacgaccgagcucauauacugggucaggcaagcgcccgggcaagggcuagaguggauaggcugggucaagaucgugagcgggaccgugaacuuugccucgcuagauuucaggaacaggaucucgcucucgcgcgaucgcgaucuaucgaccgcgcacauggacauacgcgggcucacgcaaggggacacggccacguacuuuugcgcgcgccagaaauuugaaaggggcgggcaagggugguauuucgaucucuggggcaggggcacgcucauaguagugagcucg

SEQ ID NO: 56555 - RNA, 375 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcucauauacugggucaggcaagcgcccgggcaagggcucgaguggauaggaugggucaagaucgugagcgggaccgugaacuuugccucgcucgauuucaggcaaaggguaucgcuaacgcgcgaucgcgaucucuuuaccgcgcacauggacauacgcgggcucacgcaaggggacacggccacguacuuuugcgcgcgccagaaauuugaaaggggcgggcaaggguggauauucgaucuauggggcaggggcacgcucauagccgugagcucg

SEQ ID NO: 56556 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgaacggaauugauccauugggugcgccaggcaccgggacagggcuuggaauggaucggguggguaaaaacggucacgggcacggucaauuucgggagcuugaacuuucgccagcgcgugagcuugaccagggacagggacuuguucacggcccauauggauaucaggggauugacccagggcgauaccgcgaccuauuucugugccaggcaaaaguucgagcgcgggggccagggcuggaucuuugacuugugggggcgagggaccuugaucgcggucucgagc

SEQ ID NO: 56557 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacaagcgaggacauauucgagcgcacggaacugauccauugggugcgccaggccccgggccagggcuuggaauggaucgggugggugaaaacggucacgggcgcggucaauuucgggagcccgaacuuucgccaucgcgugagcuugaccagggacagggacuuguucacggcccauauggauaucagaggcuugacccagggcgauaccgcaaccuauuucugugccaggcaaaaguucgagcgcgggggccagggcugguacuuugaccugugggggcgcgggaccuugaucguggucucgagc

SEQ ID NO: 56558 - RNA, 375 nt, Artificial Sequence
  derived and/or modified sequence opt11 from anti-HIV-1_HeavyChain
aggcauacaguggagcagagcgggagcggggugaagaagccgggggcgagcgugagggugagcuguuggacgagcgaggacauauucgagaggacggaguugauacauugggugaggcaggcgccggggcagggguuggaguggauagggugggugaagacggugaguggggcggugaauuucgggagcccgaacuuuaggcauagggugagccugacgagggacagggaccuguucacggcgcauauggauauaaggggguugacgcagggggauacggcgacguauuucugugcgaggcagaaguucgagaggggagggcaggggugguacuuugacuugugggggagggggacguugauaguggugaguagc

SEQ ID NO: 56559 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaagagugaguugauacauugggugaggcaggcgccggggcagggguuggaguggauagggugggugaagacggugacgggggcggugaauuucgggagcagugacuuuaggcagagggugagcuugacgagggacagggaccuguucacggcgcauauggauauaagggggcugacgcagggggauacggcgacguauuucugugcgaggcagaaguucgagaggggggggcaggggugguacuuugacuugugggggagggggacguugauaguggugaguagc

SEQ ID NO: 56560 - RNA, 375 nt, Artificial Sequence
  derived and/or modified sequence opt11 from anti-HIV-1_HeavyChain
aggcauacgugggagcagagcgggagcggggugaagaaguugggggcgagcgugagggugagcuguuggacgagcgaggacauauucgagaggacagaguugauacauugggugaggcaggcgccggggcagggguuggaguggauaggguggaugaaggcggugaguggggcggugaauuacgggagcuuggacuuuaggcauagggugagcuugacgagggacagggacuugagcacggcgcauauagauauaaggggguugacgcaggacgauacggcgacguauuucugugcaaggcagaaguucgcgaggggggaccaggggugguucuuugacuugugggggagggggacguugauaguggugagcagc

SEQ ID NO: 56561 - RNA, 375 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgaacggaauugauccauugggugcgccaggccccgggccagggcuuggaauggaucgggugggugaaaacggucacgggcgcggucaauuucgggagcccgaacuuucgccaucgagugagcuugaccagggacagggacuuguucacggcccauauggauaucaggggcuugacccagggcgauaccgcgaccuauuucugugccaggcaaaaguucgagcgcgggggccagggcugguacuuugacuugugggggcgcgggaccuugaucguggucucgagc

SEQ ID NO: 56562 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccaucgcgugagcuugaccagggacagggacuuguucacggcccauauggauaucaggggcuugacccagggcgauaccgcgaccuauuucugugccaggcaaaaguucgagcgagggggccagggcuggaucuuugacuugugggggcgcgggaccuugaucgcggucucgagc

SEQ ID NO: 56563 - RNA, 375 nt, Artificial Sequence
  derived and/or modified sequence opt11 from anti-HIV-1_HeavyChain
caggcccaucucgagcaaucgggcucgggcgugaaaaagccaggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcacagggucucgcucacgcgcgaucgcgaucucuuuaccgcgcacauggacauacgcgggcuuacgcaaggggacacggccacguacuuuugcgcgcgccagaaauauuacgcgggcgggcaagggugguauuucgaucucuggggcaggggcacgcucauagucgugagcucg

SEQ ID NO: 56564 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcuaacgcgcgaucgcgaucucuuuaccgcgcacaugggcauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56565 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggacaucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucuuucucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggaacgcucauagucgugagcucg

SEQ ID NO: 56566 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcuaacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcucauaguagugagcucg

SEQ ID NO: 56567 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgcaagauuucagggacagguucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcagaggcacgcucauagucgugagcucg

SEQ ID NO: 56568 - RNA, 375 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacgcgaccgggcucauauacugggucaggcaagcgcccgggcaagggcucgaguggauaggcugggucaagaucgugagcgggacagugaacuuugccucgcucgauuucaggcaaagggucucgcucacgcgcgaucgcgaucuauuuaccgcgcacauggacauacgcgggcucacacaaggggacacggccacguacuuuugcgcgcgccagaaauuuuacgcgggcgggcaagggugguauuucgaucucuggggcaggggcacgcucauagucgugagcucg

SEQ ID NO: 56569 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucucgaccgcguacauggacauacgcgggcucacgcaagaugacacggccacguacuuuugcgcgcgccagaaauuugccaggggcgaucaagggugguuuuucgaucucuggggcaggggcacgcuaauagucgugagcucg

SEQ ID NO: 56570 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcaagggcuagaguggauaggcugggucaaggccgugagcggggccgugaacuauggcucgcucgauuucaggcacagggucucacucacgcgcgaucgcgaucucuuuaccgcgcacauggacauacgcgggcuaacgcaagaugacacggccauauaccugugcgcgcgccagaaauuugccaggggcgaucaagggugguuuuucgaucucuggggcaggggcacgcucauagucgugagcucg

SEQ ID NO: 56571 - RNA, 375 nt, Artificial Sequence
  derived and/or modified sequence opt11 from anti-HIV-1_HeavyChain
cagagccaucucgagcaaucgggcucggccaugaaaaagcccggggccucggucagagucucgugcuggaccucggaagauaucuuugacacgaccgagcucauauacugggucaggcaagcgcccgggcaagggcucgaguggauaggcugggucaagaucgugagcgggaccgugaacuuugccucgcucgauuucaggaacaggaucucgcucucgcgcgaucgcgaucucucgaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucg

SEQ ID NO: 56572 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccauugggugcgccaggccccgggccagggccuggaauggaucgggugggugaaaacggucacgggcgcggucaauuucgggagcccgaacuuucgccaucgcgugagcuugaccagggacagggacuuguucacggcccauauggauaucaggggcuugacccagggcgauaccgcgaccuauuucugugccaggcaaaaguucgagcgcgggggccagggcugguacuuugacuugugggggcgcgggaccuugaucguggucucgagc

SEQ ID NO: 56573 - RNA, 375 nt, Artificial Sequence
  derived and/or modified sequence opt11 from anti-HIV-1_HeavyChain
caggcccaucccgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56574 - RNA, 375 nt, Artificial Sequence
  derived and/or modified sequence opt11 from anti-HIV-1_HeavyChain
agggcccaucucgagcaaucgggcucgggcgugcgcaagcccggggccucggucaggguaucgugcuggaccucggaagauaucuuugaaaagagcgagcuaauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuacagcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56575 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaccgugagcggggccgugaacuuuggcucgcccaauuucaggcacagggucucgcuaacgcgcgaucgcgaucucuuuaccgcgcacauggacauacgcgggcuaacgcaaggggacacggccacguacuuuugcgcgcgccagaaauuugaaaggggagggcaaggguggauauucgaucucuggggcaggggcacgcucauagccgugagcucg

SEQ ID NO: 56576 - RNA, 375 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgacagaaauuuuacgcgggcgggcaagggugguauuucgaucucuggggcaggggcacgcucauagucgugagcucg

SEQ ID NO: 56577 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaaggacuagaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcacauaguagugagcucg

SEQ ID NO: 56578 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugaguuguuggacgagcgaggacauauucgagaggacggaguugauacauugggugaggcaggcgccggggcagggguuggaguggauagggugggugaagauagugagcggggcggugaauuucgggagcccgaacuuuaggcagagggugagcuugacgagggacagggacuuguucacggcgcauauggauauaaggggguugacgcagggggauacggcgacguauuucugugcgaggcagaaguucgagaggggggggcagggguggauauuugacuugugggggagggggacgcugauagcgguaaguagc

SEQ ID NO: 56579 - RNA, 375 nt, Artificial Sequence
  derived and/or modified sequence opt11 from anti-HIV-1_HeavyChain
cagagccaucuagagcaaucgggcucggccaugaaaaagcccggggccucggucagggucucgugcuggaccucggaagauaucuucgacacgaccgagcuaauauacugggucaggcaagcgcccgggcaagggcucgaguggauaggcugggucaagaucgugagcgggaccgugaacuuugccucgagcgauuucaggcacagggucucgcucacgcgcgaucgcgaucucucgaccgcgcacauggacauacgcgggcucacgcaagaugacacggccacguacuuuugcgcgcgacagaaauuugccaggggcgaucaagggugguucuucgaccucuggggcaggggcacgcucauagucgugagcucg

SEQ ID NO: 56580 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcuggguaaagaucgugagcggggccgugaacuuuggcucgccaaauuucaggcaaagggucucgcucacgcgcgaucgagaucuauuuaccgcgcacauggacauacgcgggcucacgcaaggggacacggccacguacuuuugcgcgcgccagaaauuuuacgcgggcgggcaagggugguauuucgaucuauggggcaggggaacgcucauagucgugagcucg

SEQ ID NO: 56581 - RNA, 375 nt, Artificial Sequence
  derived and/or modified sequence opt11 from anti-HIV-1_HeavyChain
caggcgcacuuggagcagagcgggagcgggguaaagaagccgggggcgagcgugagggugagcuguuggacgagcgaggacauauucgagaggagugaguugauacauugggugaggcaggcgccggggcagggguuggaguggauagggugggugaagacggugacgggggcggugaauuucgggagcccgaacuuuaggcagagggugagcuugacgagggacagggacuuauucacggcgcauauggauauaaggggguugacggagggggauacggcgacguauuucugugcgaggcagaaguucuaugcgggggggcaggggugguacuuugacuugugggggagggggacguugauaguagugaguagc

SEQ ID NO: 56582 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgcgaacuauggcucgcucgauuucaggcacagggucucgcuaacgcgcgaccgcgaucucuuuaccgcgcacauggacauacgcgggcucacgcaagaugacacggccacguacuuuugcgcgcgccagaaauuugccaggggcgaucaagggugguuuuucgaucucuggggcaggggcacgcuaauagucgugagcucg

SEQ ID NO: 56583 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccauugggugcgccaggccccgggccagggcuuggaauggaucgggugggugaaaacggucucgggcgcggucaauuucgggagcccgaacuuucgccaucgcgugagcuugaccagagacagggacuuguucacggcccauauggauaucaggggccugacccagggcgauaccgcgacauauuucugugccaggcaaaaguucgagcgcgggggccagggcugguacuuugacuugugggggcgcgggaccuugaucguggucucgagc

SEQ ID NO: 56584 - RNA, 375 nt, Artificial Sequence
  derived and/or modified sequence opt11 from anti-HIV-1_HeavyChain
caggcgcacuuggagcagagcgggagcggggugaagaaguugggagcgagcgugagggugagcuguuggacgagcgaggacauauucgagagaacggagcugauacauugggugagacaggcgccggggcagggguuggaguggauagggugggugaaggcggugucgggggcggugaauuucgggagcccgaacuuuaggcauagggugagcuugacgagggacagagacuuguucacggcgcauauggauauaaggggguugacgcagggggauacggcgacguauuucugugcgaggcagaaguucgagagaggagggcaggggugguacuuugacuugugggggagggggacguugauaguggugucgagc

SEQ ID NO: 56585 - RNA, 375 nt, Artificial Sequence
  derived and/or modified sequence opt11 from anti-HIV-1_HeavyChain
caggcccaucucgagcaaucgggcucgggagugaaaaagccaggggcaucggucagggucucgugcuggaccucagaagauaucuuugaaaggaccgagcucauacacugggucagacaagcgcccgggcaagggcucgaguggauaggcugggucaagaucgugagcggggccgugaacuuuggcucgcccaauuucaggcaaagggucucgcucacgcgcgauagagaucucuuuaccgcgcacauggacauacgcgggcuaacgcaaggggacacggccacguacuugugcgcgcgccagaaauuugaaaggggcgggcaaggguggauauucgaucucuggggcaggggcacgcucauagccgugagcucg

SEQ ID NO: 56586 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggagcucggaagauauauuugaaaggaccgagcucauacacuggguaaggcaagcgccagggcaagggcucgaguggauaggcugggucaagacagugagcggggccgugaacuuuggcucgcccaauuucaggcacagggucucgcuaacgcgcgaucgcgaucucuuuaccgcgcacauggacauacgagggcucacgcaaggggacacggccacguacuuuugcgcgcgacagaaauuugaaaggggcgggcaagggugguauuucgaucucuggggcaggggcacgcucauagucgugagcucg

SEQ ID NO: 56587 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggcaccgggccagggcuuggaauggaucgggugggugaaaacggucacgggcacggucaauuucgggagcuugaacuuucgccagcgcgugagccugaccagggacagggacuuguucacggcccacauggauaucaggggcuugacccagggcgauaccgcgaccuauuucugugccaggcaaaaguucuaugccggaggccagggcugguacuuugacuugugggggcgcgggaccuugaucguagucucgagc

SEQ ID NO: 56588 - RNA, 375 nt, Artificial Sequence
  derived and/or modified sequence opt11 from anti-HIV-1_HeavyChain
caggcgcacuuggagcagagcgcgagcggggugaagaggccgggggcgagcgugagggugagcuguuggacgagcgaggacauauucgagaggagugaguugauauauugggugaggcaggcgccggggcagggguuggaguggauagggugggugaagacggugaguggggcggugaauuucgggagcacggacuuuagggagagggugagcuugacgagggacagggacuuguucacggcgcauauggauauaaggggguugacgcagggggauacggcgacguauuucugugcgaggcagaaguucgcgaggggggaccaggggugguucuuugacuugugggggagggggacguugauaguggugaguagc

SEQ ID NO: 56589 - RNA, 375 nt, Artificial Sequence
  derived and/or modified sequence opt11 from anti-HIV-1_HeavyChain
cagguccaucucgagcaaucgggcucgggcgugaaaaagcccggggccucggucagggucucgugcuggaccucggaagauaucuuugaaaggagcgagcucauacacugggucaggcaagcgcccgggcaagggcucgaguggauaggcugggucaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgccagaaauauuacgcgggcgggcaagggugguauuucgaucucuggggcaggggcacgcuaauagucgugagcucg

SEQ ID NO: 56590 - RNA, 375 nt, Artificial Sequence
  derived and/or modified sequence opt11 from anti-HIV-1_HeavyChain
caggcccaucucgagcaaucgggcucgggcgugaaaaagcccggggccucggucagagucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauaugcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56591 - RNA, 375 nt, Artificial Sequence
  derived and/or modified sequence opt11 from anti-HIV-1_HeavyChain
caggcccaucucgagcaaucgggcucgggcgugaaaaagcccgaggccucggucagggucucgugcuggaccucagaagauaucuuugaaaagagugagcucauacacugggucaggcaagcgcccgggcaagggcucgaguggauaggcugggucaagaccgugaccggggccgugaacuuuggcucgagcgauuucaggcaaagggucucgcucacgcgcgaucgagaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56592 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccagcgcgugagccugaccagggacagggacuuguucacggcccauauggauaucaggggcuugacccagggcgauaccgcgaccuauuucugugccaggcaaaaguucgagcgcgggggccagggcuggaucuuugacuugugggggcgcgggaccuugaucgcggucucgagc

SEQ ID NO: 56593 - RNA, 375 nt, Artificial Sequence
  derived and/or modified sequence opt11 from anti-HIV-1_HeavyChain
caagcgcacuuggaacagagcgcgagcggggucaagcgaccgggcgcgagcgugcgcgugagcuguuggacgagcgaggacauauucgagcgcacggaauugaucuauugggugcgccaggcaccgggccagggcuuggaauggaucgggugggugaaaacggucucgggcgcggucaauuucgggagccaggacuuucgcgaucgcuuuagcuugaccagggacagggacuuguucacggcccauauggauaucaggggcuugacccagggcgauaccgcgaccuauuucugugccaggcaaaaguucgagcgcgggggccagggcugguacuuugacuugugggggcgcgggaccuugaucguggucucgagc

SEQ ID NO: 56594 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugaguuguuggacgagcgaggacauauucgagaagagugaguugauacauugggugaggcaggcgccggggcagggguuggaguggauagggugggugaagauagugagcggggcggugaauuucgggagcccgaacuuuaggcagagggugagccugacgagggacagggacuuguucacggcgcauauggauauaaggggguugacgcagggggauacggcgacguauuucugugcgaggcagaaguucgagaggggggggcagggguggauauuugacuugugggggagggggacguugauagcggugaguagc

SEQ ID NO: 56595 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccaucgcgugagcuugaccagagacagggacccguucacggcccauauggauaucaggggcuugacccagggcgauaccgcgaccuauuucugugccagacaaaaguucgagcgcgggggacagggcugguacuuugacuugugggggcgcgggaccuugaucguagucucgagc

SEQ ID NO: 56596 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgggcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcacacauggacauacgcgggcucacgcaaggggacacggccacguacuuuugcgcgcgccagaaauuuuacgcgggcgggcaagggugguauuucgaucuauggggcaggggcacgcucauaguagugagcucg

SEQ ID NO: 56597 - RNA, 375 nt, Artificial Sequence
  derived and/or modified sequence opt11 from anti-HIV-1_HeavyChain
caggcacaccuagagcaaagcggaagcggagugaaaaagccaggggcaagcguaagagugagcugcuggacaagcgaggacauauucgaaaagagcgagcugauacacuggguaaggcaggcgccagggcaagggcuggaguggauaggauggguaaaggcagugagcgggacagugaacuacggaagccuggacuucaggcacaggguaagccugacgagagacagagaccuauucacagcgcacauggacauaagagggcugacgcaagacgacacggcgacguacuucugcgcgagacagaaauucgcgaggggagaccaagggugguucuucgaccuauggggaaggggaacgcuaauaguagugagcagc

SEQ ID NO: 56598 - RNA, 375 nt, Artificial Sequence
  derived and/or modified sequence opt11 from anti-HIV-1_HeavyChain
caggcccaucucgagcaaucgggcucgggcgugaaaaagcccggggccucggucaggguaucgugcuggaccucggaagauaucuuugaagggagcgagcuaauacacugggucaggcaagcgcccgggcaagggcucgaguggauaggaugggucaagaccgugaccggggccgugaacuuuggcucggccuauuucaggcacagggucucgcucacgcgcgaucgcgaucucuuuaccgcgcacauggacauacgcgggcucacgcaaggggacacggcaacguacuuuugcgcgcgccagaaauuuuacgcgggcgggcaagggugguauuucgaucucuggggcaggggcacgcucauagucgugagcucg

SEQ ID NO: 56599 - RNA, 375 nt, Artificial Sequence
  derived and/or modified sequence opt11 from anti-HIV-1_HeavyChain
caggcacaucucgagcaaucgggcucgggcgugaaaaagcccggggccucggucagggucucgugcuggagcucggaagauaucuuugaaaggaccgagcucauacacugggucaggcaagcgcccgggcaagggcucgaguggauaggcugggucaagaccgugaccggggccgugaacuuuggcucgcucgauuucaggcacaggaucucgcucacgcgcgaucgagaucuauuuaccgcgcacauggacauacgagggcucacgcaaggggacacagccacguacuuuugcgcgcgccagaaauuuuacgcgggcgggcaagggugguauuucgaucucuggggcaggggcacgcucauagucgugagcucg

SEQ ID NO: 56600 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggagcucggaagauaucuuugaaagaaccgagcuaauacacugggucaggcaagcgcccgggcaagggcucgaguggauaggcugggucaaggccgugagcggggccgugaacuauggcucgcucgauuucaggcacagggucucgcucacgcgcgaucgagaucucucgaccgcgcacauggacauacgcgggcucacgcaagaugacacggccacgcacuuuugcgcgcgccagaaauuugccaggggcgaucaagggugguuuuucgaucucuggggcagaggcacgcucauagucgugagcucg

SEQ ID NO: 56601 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaagggaccgagcucauacacugggucaggcaagcgcccgggcaagggcucgaguggauaggaugggucaagaucgugagcggggccgugaacuuuggcucgcccaauuucaggcaaagggucucgcucacgcgcgaucgagaucuauuuaccgcgcacauggacauacgcgggcucacgcaaggggacacggccacguacuuuugcgcgcgccagaaauuugaaaggggagggcaaggguggauauucgaucuauggggaaggggaacgcucauagccgugagcucg

SEQ ID NO: 56602 - RNA, 375 nt, Artificial Sequence
  derived and/or modified sequence opt11 from anti-HIV-1_HeavyChain
caggcccaucucgagcaaucaggcucgggcgugaaaaagcccggggccucggucagggucucgugcuggaccucggaagauaucuuugaaaggaccgagcucauacacugggucaggcaagcgcccgggcaagggcucgaguggauaggcugggucaagacagugaccggggccgugaacuuuggcucgcccaauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacacucauagucgugagcucg

SEQ ID NO: 56603 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgaggggagugaguugauacauugggugaggcaggcgccggggcagggguuggaguggauagggugggugaagacggugacgggggcgguaaauuucgggagcccaaacuuuaggcauagggugagcuugacgagggacagagaccuguucacggcgcauauggauauaaggggguugacgcagggggauacggcgacguauuucugugcgaggcagaaguucgagaggggggggcaggggugguacuuugacuugugggggagggggacguugauaguggugaguagc

SEQ ID NO: 56604 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcacccgggcaagggcucgaguggauaggcugggucaagaccgugagcggggccgugaacuuuggcucgcccaauuucaggcacagggucucgcucacgcgcgaucgcgaucucuuuaccgcgcacauggacauacgagggcucacgcaaggggacacggccacguacuucugcgcgcgccagaaauuugccaggggcgaucaagggugguuuuucgaccucuggggcaggggcacgcucauagucgugagcucg

SEQ ID NO: 56605 - RNA, 375 nt, Artificial Sequence
  derived and/or modified sequence opt11 from anti-HIV-1_HeavyChain
caggcccaucucgagcaaucgggcucgggcgugaaaaagcccggggccucgguaagggucucgugcuggaccucggaagggaucuuugaaaggaccgagcucauacacugggucaggcaagcgcccgggcaagggcucgaguggauaggcugggucaagaucgugagcggggccgugaacuuuggcucgcccaauuucaggcaaagggucucgcucacgcgcgaucgcgaucucuuugcagcgcacauggacauacgcgggcuaacgcaaggggacacggccacguacuuuugcgcgcgccagaaauuugaaaggggcgggcaaggguggauauucgaucuauggggcaggggcacgcucauagcagugagcucg

SEQ ID NO: 56606 - RNA, 375 nt, Artificial Sequence
  derived and/or modified sequence opt11 from anti-HIV-1_HeavyChain
caggcgcacuuggagcagagcgggagcggggugaagaaguugggggcgagcgugagggugagcuguuggacgagcgaggacauauucgagagggcggaguugauacauugggugaggcaggcgccggggcagggguuggaguggauagggugggugaaggcggugaguggggcggugaauuacgggagcuuggacuuuaggcauagggugagcuugacgagggacagggacuuguucacggcgcauauggauauaagggggcugacgcaggacgauacggcgauauauuucugugcgaggcagaaguucuaugcgggggggcaggggugguacuuugacuugugggggagagggacguugauaguggugaguagc

SEQ ID NO: 56607 - RNA, 375 nt, Artificial Sequence
  derived and/or modified sequence opt11 from anti-HIV-1_HeavyChain
caggcgcaccuggagcagagcgggagcggggugaagaaguugggggcgagcgugagggugagcuguuggacgagcgaggacauauucgagaggacggagcugauacauugggugaggcaggcgccggggcagggguuggaguggauagggugggugaaggcggugaguggggcggugaauuacgggagcccgaacuuuaggcagagggugagcuugacgagagacagggacuuguucacggcgcauauggauauaaggggguugacgcagggggauacggcgacguauuucugugcgaggcagaaguucgagaggggagggcagggguggauauuugaccugugggggagggggacguugauagcggugagcagc

SEQ ID NO: 56608 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccggggcaggggcuggaguggauagggugggugaagacggugacgggggcggugaauuacgggagcuugaacuuuaggucgaggauaagcuugacgagggacagggacuuguucacggcgcauauggauauaaggggguugacggagggggauacggcgacguauuucugugcgaggcagaaguucuaugcgggggggcaggggugguacuuugacuugugggggagggggacguugauaguggugaguagc

SEQ ID NO: 56609 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugagcggggccgugaacuuuggcucgcccaauuucaggcaaagggucucgcucacgcgcgaucgcgaucucuuuaccgcgcacauggacauacgcgggcucacgcaaggggacacggccacguacuuuugcgcgcgccagaaauuugaaaggggcgggcaaggguggauauucgaucuauggggcaggggcacgcucauagccgugagcucg

SEQ ID NO: 56610 - RNA, 375 nt, Artificial Sequence
  derived and/or modified sequence opt11 from anti-HIV-1_HeavyChain
caggcgcacuuggagcagagcgggagcggggugaagaaguugggggcgagcgugagggugagcuguuggacgagcgaggacauauucgagaggacggagcugauacauugggugaggcaggcgccggggcagggguuggaguggauaaggugggugaaggcggugaguggggcggugaauuacgggagcuuggacuuuaggcauagggugagcuugacgagggacagggacuugagcacggcacauauggauauaaggggguugacgcaggacgauacggcgacguauuucugugcaaggcagaaguucgcgaggggggaccaggggugguucuuugacuugugggggagggggacguugauaguggugaguagc

SEQ ID NO: 56611 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauauauuugaaaggaccgagcucauacacugggucaggcaagcgcccgggcaagggcucgaguggauaggcuggguaaagaccgugaccggggccgugaacuuuggcucgagcgauuucaggcaaagggucucgcucacgcgcgaucgcgaucucuuuaccgcgcaaauggacauacgcgggcucacgcaaggggacacggccacguacuuuugcgcgcgccagaaauuuuacgcgggcgggcaagggugguauuucgaucuauggggcaggggcacgcucauagucgugagcucg

SEQ ID NO: 56612 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccauugggugcgccaggccccgggccagggcuuggaauggaucgggugggugaaaacggucacgggcgcggucaauuucgcgcaccagaucucggacagggucucgcucacgcgcgaucgcgaucucuuuaccgcgcacauggacauacgcgggcucacgcaaggggacacggcaacguacuuuugcgcgcgccagaaauuuuacgcgggcgggcaagggugguauuucgaucucuggggcaggggcacgcucauagucgugagcucg

SEQ ID NO: 56613 - RNA, 375 nt, Artificial Sequence
  derived and/or modified sequence opt11 from anti-HIV-1_HeavyChain
caggcgcacuuagagcagagcgggagcggggugaagaagccgggggcgagcgugagggugagcuguuggacgagcgaggacauauucgagaggacggaguugauacauugggugaggcaggcgccggggcagggguuggaguggauagggugggugaagguggugaguggggcgguaaauuucgggagcccgaacuuuaggcagagggugagcuugacgagggacagggacuuguucacggcgcauauggauauaaggggguugacgcagggggauacggcgacguauuucugugcgaggcagaaguucgagaggggggggcagggguggauauuugacuugugggggagggggacguugauagcggugaguagc

SEQ ID NO: 56614 - RNA, 375 nt, Artificial Sequence
  derived and/or modified sequence opt11 from anti-HIV-1_HeavyChain
caggugcauuuggagcagagcgggagcggggugaagaagccgggggcgagcgugagggugagcuguuggacgagcgaggacauauucgagaagagugaguugauacauugggugaggcaggcgccggggcagggguuggaguggauagggugggugaagacggugacgggggcggugaauuucgggagcagugacuuuaggcagagggugagcuugacgagggacagggacuuguuuacggcgcauauggauauaaggggguugacgcagggggauacggcgacguauuucugugcgaggcagaaguucuaugcgggggggcaggggugguauuuugacuugugggggagggggacgcugauagugguaaguagc

SEQ ID NO: 56615 - RNA, 375 nt, Artificial Sequence
  derived and/or modified sequence opt11 from anti-HIV-1_HeavyChain
caggcgcacuuggagcagagugggagcggggugaagaagccgggggcgagcgugagggugagcuguuggaguagcgaggacauauucgagaggacggaguugauacauugggugaggcaggcgccggggcagggguuggaguggauagggugggugaagacggugacgggggcggugaauuucgggagcuuggacuuuaggcauaggauaagcuugacgagggacagggacuuguucacggcgcauauggauauaaggggguugacgcagggggauacggcgacguauuucugugcgaggcagaaguucgagaggggggggcagggguggauauuugaccugugggggagggggacguugauagcggugaguagc

SEQ ID NO: 56616 - RNA, 375 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucgucuccggcaccgucaacuucgccucccucgacuuccgcaaccgcaucucccucucccgcgaccgcgaccuaucaaccgccuacauggacauccgcggccuaacccaagacgacaccgccaccuacuucugcgcccgccaaaaauucgcccgcggcgaccaaggcugguucuucgaccucuggggccgcggcacccucaucgucgucuccucc

SEQ ID NO: 56617 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacaagcgaggacauauucgagcgcacggaacugauccauugggugcgccaggccccgggccagggcuuggaauggaucgggugggugaaaacggucacgggcgcggucaauuucgggagcccgaacuuucgccaucgcgugagcuugaccagggacagggacuuguucacggcccauauggauaucaggggcuugacccagggcgauaccgcgaccuaucucugugccaggcaaaaguucgagcgcgggggccagggcugguacuuugacuugugggggcgagggaccuugaucguggucucgagc

SEQ ID NO: 56618 - RNA, 372 nt, Artificial Sequence
  derived and/or modified sequence opt11 from anti-HIV-1_HeavyChain
cgccauaccugggaacagagcgggagcggggucaagaaaccgggcgcgagcgugcgcgugagcuguuggacgagcgaggacauauucaagagcgagcucauacacugggucaggcaagcgcccgggcaagggcucgaguggauaggcugggucaagaccgugaccggggccgugaacuuuggcucgagcgauuucaggcaaagggucucgcuaacgcgcgaucgcgaucuauuuaccgcacacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56619 - RNA, 375 nt, Artificial Sequence
  derived and/or modified sequence opt11 from anti-HIV-1_HeavyChain
caggcgcaccuggagcagagcgggagcggggugaagaagccgggggcgagcgugagggugagcuguuggacgagcgaggacauauucgagaggacggagcugauacauugggugaggcaggcgccggggcagggauuggaguggauagggugggugaagacggugacgggggcggugaauuucggaagcccgaacuuuaggcauagggugagcuugacaagagacagggacuuguucacggcgcauauggauauaaggggguugacggagggggauacggcgacguauuucugugcgaggcagaaguucuaugcgggagggcaggggugguacuuugacuugugggggagggggacguugauaguggugaguagc

SEQ ID NO: 56620 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaagaacagagcucauacacugggucaggcaagcgcccgggcaagggcucgaguggauaggaugggucaagacagugaccggagccgugaacuuuggcucggccuauuucaggcacagggucucgcucacgcgcgaucgcgaucucuuuaccgcgcacauggacauacgcgggcucacgcaaggggacacggccacguacuuuugcgcgcgccagaaauuuuacaagggcgggcaagggugguauuucgaccucuggggcaggggcacgcuaauagucgugagcucg

SEQ ID NO: 56621 - RNA, 375 nt, Artificial Sequence
  derived and/or modified sequence opt11 from anti-HIV-1_HeavyChain
caggcccaucucgagcaaucgggcccgggcgugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucuuuaccgcgcacauggacauacgcgggcucacgcaagaugacacggccacguacuucugcgcgcgccagaaauuugccaggggcgaucaagggugguuuuucgaucucuggggcaggggcacgcucauagucgugagcucg

SEQ ID NO: 56622 - RNA, 375 nt, Artificial Sequence
  derived and/or modified sequence opt11 from anti-HIV-1_HeavyChain
agggcgcacuuggagcagagcgggagcggggugaagaagccgggggcgagcgugagggugagcuguuggacgagcgaggacauauucgagaggacggaguugauacauugggugaggcaggcgccggggcagggguuggaguggauagggugggugaagauagugaguggggcggugaauuucgggagcccgaacuuuaggcagagggugagcuugacgagggacagggacuuguucacggcgcauauggauauaaggggguugacgcagggggauacggcgacguauuucugugcgaggcagaaguucgagagaggggggcagggguggauauuugaccugugggggagggggacguugauagcggugaguagc

SEQ ID NO: 56623 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcaagggcucgaguggauaggcugggucaagaccgugacaggggccgugaacuuuggcucgagcgauuucaggcaaagggucucgcucacgcgcgaucgcgaucucuuuaccgcgcacauggacauacgcgggcuaacgcaaggggacacggccacguacuuuugcgcgcgccagaaauuuuacgcgggcgggcaagggugguauuucgaucucuggggcaggggcacgcucauagucgugagcucg

SEQ ID NO: 56624 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggaguagcgaggacauauucgagaggacggagcugauacauugggugaggcaggcgccggggcagggguuggaguggauagggugggugaaggcggugaguggggcggugaauuacgggagcuuggacuuuaggcauagggugagcuugacgagggacagggacuuguucacggcgcauauggauauaaggggguugacgcaggacgauacggcgauauauuucugugcgaggcagaaguucgcgaggggagaccaggggugguucuuugacuugugggggagggggacguugauaguggugaguagc

SEQ ID NO: 56625 - RNA, 375 nt, Artificial Sequence
  derived and/or modified sequence opt11 from anti-HIV-1_HeavyChain
caggcccaucuagagcaaucgggcucaggcgugaaaaaggucggggccucggucagggucucgugcuggaccucagaagauaucuuugaaaggaccgagcucauacacugggucaggcaagcgcccgggcaagggcucgaguggauaggcugggucaaggccgugagcggggccgugaacuauggcucgcucgacuucaggcacagggucucgcucacgcgcgaucgagaucucuuuaccgcgcacauggacauacgagggcucacgcaagaugacacggccauauacuuuugcgcgcgccagaaauucgccaggggcgaccaagggugguuuuucgaucucuggggcaggggcacgcucauagucgugagcucg

SEQ ID NO: 56626 - RNA, 375 nt, Artificial Sequence
  derived and/or modified sequence opt11 from anti-HIV-1_HeavyChain
cagguccagcucgugcaaucgggcgcggaauugaaaaagcccgggagcucggucagggucucgugcuggaccucggaagauaucuuugaagggagcgagcucauacacugggucaggcaagcgcccgggcaagggcuagaguggauaggcugggucaagaccgugaccggggccgugaacuuuggcucggccuauuucaggcacagggucucgcucacgcgcgaucgagaucucuuuaccgcgcacauggacauacgcgggcucacgcaaggggacacggccacguacuuuugcgcgcgccagaaauuuuacaagggcgggcaagggugguauuucgaucucuggggcaggggcacgcucauagucgugagcucg

SEQ ID NO: 56627 - RNA, 375 nt, Artificial Sequence
  derived and/or modified sequence opt11 from anti-HIV-1_HeavyChain
caggcccaucucgagcaaucgggcucgggcgugaaaaagcccggggucucggucagggucucgugcuggaccucggaagauaucuuugaaaggaccgagcucauacacugggucaggcaagcgcccgggcaagggcucgaguggauaggcugggucaagaucgugagcggggccgugaacuuuggcucgcccaauuucaggcaaagggucucgcucacgcgcgaucgcgaucucuuuaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucg

SEQ ID NO: 56628 - RNA, 375 nt, Artificial Sequence
  derived and/or modified sequence opt11 from anti-HIV-1_HeavyChain
caggcgcaccuggagcagagcgggagcggggugaagaaguugggggcgagugugagggugagcuguuggacgagcgaggacauauucgagaggacggaguugauacauugggugaggcaggcgccggggcagggguuggaguggauagggugggugaagguggugaguggggcggugaauuacgggagcuuggacuuuagacauagggugagccugacgagggacagggacuuguucacggcgcauauggauauaaggggguugacgcaggacgauacggcgacguauuucugugcgaggcagaaguucgcgagaggggaccaggggugguucuuugacuugugggggagggggacguugauaguggugucgagc

SEQ ID NO: 56629 - RNA, 375 nt, Artificial Sequence
  derived and/or modified sequence opt11 from anti-HIV-1_HeavyChain
caggcgcacuuggagcagagcgggagcggggugaagaaguugggggcgagcgugagggugagcuguuggacgagcgaggacauauucgagaggacggaguugauacauugggugagacaggcgccggggcagggguuggaguggauagggugggugaaggcggugucgggggcggugaauuacgggagcuuggacuuuaggcauagggugagcuugacgagggacagggaccuguucacggcgcauauggauauaaggggguugacacaggacgauacggcggcguauuucugugcgaggcagaaguucgcgagaggggaccaggggugguucuuugacuugugggggagggggacguugauaguggugaguagc

SEQ ID NO: 56630 - RNA, 375 nt, Artificial Sequence
  derived and/or modified sequence opt11 from anti-HIV-1_HeavyChain
caggcccaucucgagcaaucgggcucgggcgugcgcaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcuaacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56631 - RNA, 375 nt, Artificial Sequence
  derived and/or modified sequence opt11 from anti-HIV-1_HeavyChain
caggcccaucucgagcaaucgggcucaggcgugaaaaagcccggggccucggucagggucucgugcuggaccucggaagauaucuuugaaaggaccgagcucauacacugggucaggcaagcgcccgggcaagggcucgaguggauaggcugggucaagaccgugaccgggaccgugaacuuuggcucgcuaaauuucaggcaaagggucucgcucacgcgcgaucgcgaucucuuuaccgcgcacauggacauacgagggcucacgcaaggggacacggccacguacuuuugcgcgcgccagaaauuuuacaagggcgggcaagggugguauuucgaucucuggggcaggggcacgcuaauagucgugagcucg

SEQ ID NO: 56632 - RNA, 375 nt, Artificial Sequence
  derived and/or modified sequence opt11 from anti-HIV-1_HeavyChain
caaucgcacuuggaacagagcgggagcgcgaugaagaaaccgggcgcgagcgugcgcgugaguuguuggacgagcgaggacauauucgagcgcacggaauugauccauugggugcgccaggccccgggccagggcuuggaauggaucgggugggugaaagcggucucgggcgcggucaauuacgggagcuuggacuuucgccaucgcgugagcuugaccagggacagagacuuguucacggcccauauggauaucaggggcuugacccaggacgauaccgcgaccuauuucugugccaggcaaaaguucgcgcgcggggaccagggcugguucuuugaccugugggggcgcgggaccuugaucguggucucgagc

SEQ ID NO: 56633 - RNA, 375 nt, Artificial Sequence
  derived and/or modified sequence opt11 from anti-HIV-1_HeavyChain
caggcccaucuagagcaaucaggaucgggcgugaaaaagcccggggccucggucagggucucgugcuggagcucggaagauaucuuugaaaggaccgagcucauacacugggucaggcaagcgcccgggcaagggcucgaguggauaggcugggucaagaccgugaccggggccgugaacuuuggcucacucgauuucaggcacagggucucgcucacgcgcgaucgcgaucucuuuaccgcgcacauggacauacgcgggcucacgcaaggggacacggccacguacuuuugcgcgcgccagaaauuugccaggggcgaucaagggugguuuuucgaucucuggggcaggggcacgcucauagucgugagcucg

SEQ ID NO: 56634 - RNA, 375 nt, Artificial Sequence
  derived and/or modified sequence opt11 from anti-HIV-1_HeavyChain
caggcccaucucgagcaaucgggcucgggcgugaaaaggcccggggccucggucagggucucgugcuggaccucggaagauaucuuugaaacgaccgagcucauacacugggucaggcaagcgcccgggcaagggcucgaguggauaggcugggucaagaccgugagcggggccgugaacuuuggcucgcucaauuucaggcacagggucucgcucacgcgcgaucgagaucucuuuaccgcgcacauggacauacgcgggcucacgcaaggggacacggccacguacuuuugcgcgcgccagaaauuuuacaagggcgggcaagggugguauuucgaucuauggggcaggggcacgcucauagucgugagcucg

SEQ ID NO: 56635 - RNA, 375 nt, Artificial Sequence
  derived and/or modified sequence opt11 from anti-HIV-1_HeavyChain
caggcgcauuuggagcagagugcgaguggggugaggaggccgggggcgagugugagggugaguuguuggacgagugaggauauauuugagaggagugaguugauauauuggguaaggcaggcgccggggaggggguuggaguggauaggguggauaaagcuggugagcggggcggugaauuuugggaguguggauuuuagggauagggugagcuugacgagggacagggauuuguuuacggcgcauauggauauaaggggguugacgcagggggauacggcgacguacuuuugugcgaggcagaaguuuuaugcgggggggcaggggugguauuuugauuugugggggagggggacguugauaguggugaguagu

SEQ ID NO: 56636 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggagcucggaagauaucuuugaaaggaccgagcucauacacugggucaggcaagcgcccgggcaagggcucgaguggauaggcugggucaagaucgugagcggggccgugaacuuuggcucgcccaauuucaggcaaagggucucgcucacgcgagaucgagaucucuuuaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucg

SEQ ID NO: 56637 - RNA, 375 nt, Artificial Sequence
  derived and/or modified sequence opt11 from anti-HIV-1_HeavyChain
caggcccaucucgagcaaucgggcucgggagugaaaaagcuaggggccucggucagggucucgugcuggaccagugaagauauauuugaaaggacagagcuaauacacugggucaggcaagcgccagggcaagggcucgaguggauaggcuggguaaagacagugagcggggcagugaacuuuggcucgccaaauuucaggcacagggucucgcuaacgcgcgauagagaucucuuuacagcgcacauggacauaagagggcucacgcaaggggacacggcaacguacuuuugcgcgcgccagaaauuugaaaggggcgggcaagggugguauuucgaucucuggggcagaggaacgcucauaguagugagcucg

SEQ ID NO: 56638 - RNA, 375 nt, Artificial Sequence
  derived and/or modified sequence opt11 from anti-HIV-1_HeavyChain
caggcccaucucgagcaaucgggcucgggcgugaaaaggccaggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagagucucgcucacgcgcgaucgcgaucucuuuaccgcgcacaugggcauacgcgggcucacgcaaggggacacggccacguacuuuugcgcgcgccagaaauuuuacgcgggcgggcaagggugguauuucgaucucuggggcaggggaacgcucauagucgugagcucg

SEQ ID NO: 56639 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcuagauuucaggcacagggucucgcucacgcgcgaucgcgaucucuuuaccgcgcacauggacauacgcgggcucacgcaagaugacacggccauauacuuuugcgcgcgccagaaauuugccaggggcgaucaagggugguuuuucgaucucuggggcaggggcacgcucauagucgugagcuca

SEQ ID NO: 56640 - RNA, 375 nt, Artificial Sequence
  derived and/or modified sequence opt11 from anti-HIV-1_HeavyChain
cagagccaucucgagcaaucgggcucggccaugaaaaagcucggggccucgguaagggucccgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucuuuaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56641 - RNA, 375 nt, Artificial Sequence
  derived and/or modified sequence opt11 from anti-HIV-1_HeavyChain
caggugcacuuggagcagagugggagcggggugaagaagccgggggcgagcgugagggugagcuguuggacgagcgaggacauauucgagaggacggaguugauacauugggugaggcaggcgccggggcaggggcuggaguggauagggugggugaagauagugaguggggcggugaauuucgggagcccgaacuuuaggcagagggugagccugacgagggacagggacuuguucacggcgcauauggauauaaggggguugacgcagggggauacggcgacguauuucugugcgaggcagaaguucgagaggggggggcagggguggauauuugacuugugggggagggggacguugauagcggugaguagc

SEQ ID NO: 56642 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaagaaccgagcucauacacugggucaggcaagcgcccgggcaaggacucgaguggauaggcugggucaaggccgugagcggggccgugaacuauggcucacucgauuucaggcacagggucucgcucacgcgagaucgcgaucucuuuaccgcgcacauggacauacgcgggcucacgcaagaugacacggccacguacuuuugcgcgcgacagaaauuugccaggggcgaucaagggugguucuucgaucucuggggcaggggcacgcucauagucgugagcucg

SEQ ID NO: 56643 - RNA, 375 nt, Artificial Sequence
  derived and/or modified sequence opt11 from anti-HIV-1_HeavyChain
caggcccaucuagagcaaucggccucgggcgugcgcaggcccggggccucggucagggucucgugcuggaccucggaagauaucuuugaaaggagcgagcucauauacugggucaggcaagcgcccgggagagggcuagaguggauaggcugggucaagaccgugagcggggccgugaacuuuggcucgcccaauuucaggcacagggucucgcucacgcgcgaucgcgaucucuuuaccgcgcacauggacauacgagggcucacgcaaggggacacggccacguacuuuugcgcgcgccagaaauuugaaaggggcgggcaagggugguauuucgaucucuggggcaggggcacgcucauagucgugagcucg

SEQ ID NO: 56644 - RNA, 375 nt, Artificial Sequence
  derived and/or modified sequence opt11 from anti-HIV-1_HeavyChain
caagcgcacuuagaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccagcgcgugagcuugaccagggacagggaccuguucacggcccauauggauaucaggggcuugacccagggcgauaccgcgaccuauuucugugccaggcaaaaauucgagcgcgggggccagggcugguacuuugacuugugggggcgcgggaccuugaucguggucucgagc

SEQ ID NO: 56645 - RNA, 375 nt, Artificial Sequence
  derived and/or modified sequence opt11 from anti-HIV-1_HeavyChain
cagagccaucucgagcaaucaggcucggccaugaaaaagcccggggccucggucagggucucgugcuggaccucggaagauaucuuugaaaggaccgagcucauauacugggucagacaagcgcccgggcgcgggcucgaguggauaggcuggguaaagaccgugagcgggaccgugaacuuuggcucgagcgauuucaggaacaggaucucgcucacgcgagaucgcgaucucucgaccgcgcacauggacauacgcgggcucacgcaagaugacacggcaacguacuuuugcgcgcgccagaaauuuuacgcgggcgggcaagggugguauuucgaucucuggggcaggggcacgcucauagucgugagcucg

SEQ ID NO: 56646 - RNA, 375 nt, Artificial Sequence
  derived and/or modified sequence opt11 from anti-HIV-1_HeavyChain
cagguccagcucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcuaacgcaaggggacacggccacguacuuuugcgcgcgccagaaauuuuacgcgggcgggcaagggugguauuucgaucucuggggcaggggcacgcucauagucgugagcucg

SEQ ID NO: 56647 - RNA, 375 nt, Artificial Sequence
  derived and/or modified sequence opt11 from anti-HIV-1_HeavyChain
caagcccaccucgaacaauccggcuccggcgucaaaaaacccggcgccuccguacgcgucagcugcuggaccuccgaagacaucuucgaacgcaccgaacucauccacuggguccgccaagcccccggccgcggccucgaauggaucggcuggguaaaagccgucuccggcgccgucaacuacggcucccucgacuuccgacaccgcgucucccuaacccgagaccgcgaccuauucaccgcccacauggacaucagaggccuaacacaagacgacaccgccaccuacuucugcgcccgccaaaaauucgcccgcggcgaccaaggcugguucuucgaccucuggggccgcggcacccucaucgucgucuccucc

SEQ ID NO: 56648 - RNA, 375 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacgagcgaggacauauucgagcgcacggaauugauccauugggugcgccaggccccgggacagggcuuggaauggaucgggugggugaaaacggucacgggcgcggucaauuucgggagcccgaacuuucgccaucgcgugagccugaccagggacagggacuuguucacggcccauauggauaucaggggcuugacccagggcgauaccgcgaccuauuucugugccaggcaaaaguucgagcgcgggggccagggcugguacuuugacuugugggggcgagggaccuugaucguggucucgagc

SEQ ID NO: 56649 - RNA, 375 nt, Artificial Sequence
  derived and/or modified sequence opt11 from anti-HIV-1_HeavyChain
caagcgcacuuggaacagagcgcgagcggggucaagcgcccgggcgcgagcgugcgcgugagcuguuggacgagcgaggacauauucgagcgcucggaauugaucuauugggugcgccaggccccgggccagggcuuggaauggaccgggugggugaaaacggucucgggcgcggucaauuucgggagcacggacuuucgcgagcgcgugagcuugaccagggacagggacuuguucacggcccauauggauaucaggggcuugacccagggcgauaccgcgaccuauuucugugccaggcaaaaguucgcgcgcggggaccagggcugguucuuugacuugugggggcgcgggaccuugaucgugguaucgagc

SEQ ID NO: 56650 - RNA, 375 nt, Artificial Sequence
  derived and/or modified sequence opt11 from anti-HIV-1_HeavyChain
caggugcacuuggagcagagcgggagcggggugaagaaguugggggcgagcgugagggugagcuguuggacgagcgaggacauauucgagaggacggaguugauacauugggugaggcaggcgccgggaaggggguuggaguggauagggugggugaaggcggugaguggggcggugaauuacgggagcuuggacuuuaggcauagggugagcuugacgagggacagggacuuguucacggcgcauauggauauaaggggauugacgcaggacgauacggcgacguauuucugugcgaggcagaaguucgcgagaggggaccaggggugguucuuugacuugugggggagggggacguugauaguggugaguagc

SEQ ID NO: 56651 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggagcgagcucauacacugggucaggcaagcgcccgggcaagggcucgaguggauaggcugggucaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgccagaaauauuacgcgggcgggcaagggugguauuucgaucucuggggcaggggcacgcucauagucgugagcucg

SEQ ID NO: 56652 - RNA, 375 nt, Artificial Sequence
  derived and/or modified sequence opt11 from anti-HIV-1_HeavyChain
caggcacaccuagagcaaagcggaagcggagugaaaaagccaggggcaagcguaaggguaagcugcuggacaagcgaagacauauucgaaaggacagagcuaauacacuggguaaggcaggcgccagggcaagggcuagaguggauaggauggguaaagacagugacaggggcagugaacuucggaagcccaaacuucaggcacaggguaagccugacgagggacagggaccuauucacagcgcacauggacauaagagggcugacgcaaggggacacggcaacguacuucugcgcgagacagaaauucuacgcgggagggcaagggugguacuucgaccuauggggaaggggaacgcuaauaguagugagcagc

SEQ ID NO: 56653 - RNA, 375 nt, Artificial Sequence
  derived and/or modified sequence opt11 from anti-HIV-1_HeavyChain
caggcgcauuuggagcagagcgggagcggggugaagaagccgggggcgagugugaggguaagcuguuggacgagcgaggauauauuugagaagagugaguugauacauugggugaggcaggcgccggggcaggggcuggaguggauagggugggugaaaacggugacgggggcggugaauuuugggagcagcgacuuuaggcagagggugaguuugacgagggacagggacuuguuuacggcgcauauggauauaaggggguugacgcagggggggacggcgacguauuucugugcgaggcagaaguuuuaugcgggggggcaggggugguauuuugacuugugggggagggggacguugauaguggugaguagc

SEQ ID NO: 56654 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaccgugagcggggccgugaacuuuggcucgcccaauuucaggcacagggucucgcucacgcgcgaucgcgaucucuuuacagcgcacauggacauaugcgggcucacgcaaggggacacggccacguacuuuugcgcgcgccagaaauuugaaaggggcgggcaagggugguauuucgaucucuggggcaggggcacgcucauagucgugagcucg

SEQ ID NO: 56655 - RNA, 375 nt, Artificial Sequence
  derived and/or modified sequence opt11 from anti-HIV-1_HeavyChain
caagcgcacuuggaacagagcgggagcggggucaggaaagugggcgcgagcgugcgcgugagcuguuggacgagcgaggacauauucgagcgcacggaacugauccauugggugcgccaggccccgggacagggcuuggaauggaucgggugggugaaagcggucucgggcgcggucaauuacgggagcuuggacuuucgccaucgcgugagcuugaccagggacagggacuuguucacggcccauauggauaucaggggcuugacccaggacgauaccgcgaucuauuucugugccaggcaaaaguucgcgcgcggggaccagggcugguucuuugaccugugggggcgcgggaccuugaucguggucucgagc

SEQ ID NO: 56656 - RNA, 375 nt, Artificial Sequence
  derived and/or modified sequence opt11 from anti-HIV-1_HeavyChain
caggcccaucucgagcaaucgggaucgggcgugaaaaagcccggggccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucgcccaauuucaggcacagggucucgcucacgcgagaucgcgaucucuuuaccgcgcacauggacauacgcgggcucacgcaaggggacacggccacguacuuuugcgcgcgacagaaauauuacgcgggcgggcaagggugguauuucgaucucuggggcaggggcacgcucauagucgugagcucg

SEQ ID NO: 56657 - RNA, 375 nt, Artificial Sequence
  derived and/or modified sequence opt11 from anti-HIV-1_HeavyChain
cagguccagcucgugcaaucgggagcggaagugaaaaagcccggggccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucgccaaauuucaggcacagggucucgcuaacgcgcgaucgcgaucucuuuaccgcgcacauggacauacgcgggcucacgcaaggggacacggccacguacuuuugcgcgcgccagaaauuugaaaggggcgggcaagggugguauuucgaucucuggggcaggggcacgcucauagucgugagcucg

SEQ ID NO: 56658 - RNA, 375 nt, Artificial Sequence
  derived and/or modified sequence opt11 from anti-HIV-1_HeavyChain
caggcgcauuuggagcagagugggagcggggugaagaagccgggggcgagcgugagggugagcuguuggacgagcgaggauauauucgagaagagugaauugauacauugggugaggcaggcgccggggcagggguuggaguggauagggugggugaagacggugacgggggcggugaauuucggguugagugauuuuaggcagagggugagcuugacgagggacaggggguuguucacggcgcauauggauauaaggggguugacgcagggggauacggcgacguauuuuugugcgaggcagaaguuuuaugcgggggggcaggggugguauuuugacuugugggggagggggacguugauaguggugaguagc

SEQ ID NO: 56659 - RNA, 375 nt, Artificial Sequence
  derived and/or modified sequence opt11 from anti-HIV-1_HeavyChain
caggcccaucucgagcaaucgggaucgggcgugaaaaagcccgggaccucgguaaggguaucgugcuggaccucggaagauaucuuugaaaggaccgagcucauacacugggucaggcaagcgcccgggcaagggcucgaguggauaggcugggucaagaccgugaccggggccgugaacuuuggcucgcccaauuucaggcaaagggucucgcucacgagagaucgcgaucucuuuaccgcgcacauggacauacgagggcucacgcaaggggacacggcaacguacuuuugcgcgcgccagaaauuugaaaggggcgggcaaggguggauauucgaucucuggggcaggggcacgcuaauagccgugagcuca

SEQ ID NO: 56660 - RNA, 375 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucagaagauaucuuugacacgaccgagcucauauacugggucaggcaagcgcccgggcaagggcucgaguggauaggcugggucaagaucgugagcgggaccgugaacuuugccucgcuagauuucaggaacaggaucucgcucucgcgcgaucgcgaucucucgaccgcgcacauggacauacgcgggcuaacgcaagaugacacggccacguacuuuugcgcgcgccagaaauuugaaaggggcgggcaagggugguauuucgaucucuggggcaggggcacgcucauagucgugagcucg

SEQ ID NO: 56661 - RNA, 375 nt, Artificial Sequence
  derived and/or modified sequence opt11 from anti-HIV-1_HeavyChain
cagguccagcuagugcaaucgggcgcggaagugaaaaagcccggggccucgguaagggucucgugcuggaccucggaagauaucuuugaagggagcgagcucauacacugggucaggcaagcgcccgggcaagggcucgaguggauaggcugggucaagaccgugaccggggccgugaacuuuggcucggccuauuucaggcacagggucucgcucacgcgcgaucgagaucucuuuaccgcgcacauggacauacgagggcuaacgcaaggggacacggccacguacuuuugcgcgcgccagaaauuuuacaagggcgggcaagggugguauuucgaucucuggggcagaggcacgcucauagucgugagcucg

SEQ ID NO: 56662 - RNA, 375 nt, Artificial Sequence
  derived and/or modified sequence opt11 from anti-HIV-1_HeavyChain
cagagucacuuggagcagagcgggagcgcgaugaagaagccgggggcgagcgugagggugagcuguuggacgagcgaggacauauucgauacgacggaguugauauauugggugaggcaggcgccggggcaggggcuggaguggauagggugggugaagauagugagugggacggugaauuucgcgagcagugacuuuaggaauagaauaaguuugagcagggacagggacuugagcacggcgcauauggauauaaggggguugacgcaggacgauacggcgacguauuucugugcgaggcagaaguucgagaggggagggcagggguggauauuugacuugugggggagggggacguugauagcggugagcagc

SEQ ID NO: 56663 - RNA, 375 nt, Artificial Sequence
  derived and/or modified sequence opt11 from anti-HIV-1_HeavyChain
cagguacagcucgugcaaucgggcacggaagugaaaaagcccggggccucggucagagucucgugcaaggccucgggcuauacauuugaaaagagcgagcucauacacugggucaggcaagcgcccgggcaagggcucgaguggauaggcugggucaagaccgugaccggggccgugaacuuuggcucgagcgauuucaggcaaagggucucgcuaacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56664 - RNA, 375 nt, Artificial Sequence
  derived and/or modified sequence opt11 from anti-HIV-1_HeavyChain
cagagucaccuggagcagagcgggagugcgaugaagaagccgggggcgagcgugagggugagcuguuggacgagcgaggacauauucgagagaacggaguugauauauugggugaggcaggcgccggggaggggguuggaguggauagggugggugaagacggugagugggacggugaauuucgggagcagugacuuuaggaauaggauaagcuugacgagggacagggacuugagcacggcgcauauggauauaaggggguugacgcaggacgauacggcgacguauuucugugcgaggcagaaguucgagaggggggggcagggguggauauuugaccugugggggagggggacguugauagcggugaguagc

SEQ ID NO: 56665 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggaguagcgaggacauauucgagaggacggaguugauacauugggugaggcaggcaccggggcagggguuggaguggauagggugggugaaggcggugaguggggcggugaauuacgggagcuuggacuuuaggcauagggugagcuugacgagggacagggacuugagcacggcacauauggauauaaggggguugacgcaggacgauacagcgacguauuucugugcgaggcagaaguucgcgaggggggaccaggggugguucuuugacuugugggggagggggacguugauaguggugucgagc

SEQ ID NO: 56666 - RNA, 375 nt, Artificial Sequence
  derived and/or modified sequence opt11 from anti-HIV-1_HeavyChain
caagcgcacuuggaacagagcgggagcggggucaagaaaccgggagcgagcgugcgagugagcuguuggacgagcgaggacauauucgagaaaucggaacugauccauugggugcgccaggccccgggccagggcuuggaauggaucgggugggugaaaacggucacgggcgcggucaauuucgggagcucggacuuucgccagcgcgugagcuugaccagggacagggacuuguucacggcccauauggauaucaggggcuugacacaggacgauaccgcgaucuauuucugugccaggcaaaaguucgcgcgcggggaccagggcugguucuuugacuugugggggcgcgggaccuugaucguggucucgagc

SEQ ID NO: 56667 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauacgcgggcuaacgcaaggggacacggccacguacuuuugcgcacgccagaaauuuuacgcgggcgggcaagggugguauuucgaucucuggggcaggggcacgcucauaguagugagcucg

SEQ ID NO: 56668 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucgugcacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcuaacgcaaggggacacggccacguacuuuugcgcgcgccagaaauuugaaaggggcgggcaaggguggauauucgaucucuggggcaggggcacgcucauagccgugagcucg

SEQ ID NO: 56669 - RNA, 375 nt, Artificial Sequence
  derived and/or modified sequence opt11 from anti-HIV-1_HeavyChain
caggcgcacuuggagcagagcgggagcggggugaagaaguugggggcgagcgugagggugagcuguuggacgagcgaggacauauucgagaggacggaguugauacauugggugaggcaggcgccggggcagggguuagaguggauagggugggugaaggcggugucgggggcggugaauuacgggagcuuggacuuuaggcauagggugagcuugacgagggacagggacuuguucacggcgcauauggauauaaggggguugacgcagggggauacggcgacguauuucugugcgaggcagaaguucgcgagaggggaccaggggugguucuuugaccugugggggagggggacguugauagugguaaguagc

SEQ ID NO: 56670 - RNA, 375 nt, Artificial Sequence
  derived and/or modified sequence opt11 from anti-HIV-1_HeavyChain
caggcgcauagggagcagagcgggagcggggugaagaagccgggggcgagugugagggugaguuguuggacgagcgaggauauauuugagaggacggaguugauacauugggugaggcaggcgccggggcaggggcuggaguggauagggugggugaagacggugacgggggcggugaauuuugggagcagugacuuuaggcagagggugaguuugacgagggacagggacuuguuuacggcgcauauggauauaaggggguugacgcagggggauacggcgacguauuucugugcgaggcagaaguuuuaugcgggagggcaggggugguauuuugacuugugggggagggggacguugauaguggugaguagc

SEQ ID NO: 56671 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgagugagcugucucgcgagcgaggacauauucaagaccgagcucauacacugggucaggcaagcgcccgggcaagggcucgaguggauaggcugggucaagaucgugagcggggccgugaacuuuggcucgccaaauuucaggcaaagggucucgcuaacgcgcgaucgcgaucucuuuaccgcgcacauggacauacgcgggcucacgcaaggggacacggccacguacuuuugcgcgcgccagaaauuugaaagaggcgggcaaggguggauauucgaucucuggggcaggggcacgcucauagccgugagcucg

SEQ ID NO: 56672 - RNA, 375 nt, Artificial Sequence
  derived and/or modified sequence opt11 from anti-HIV-1_HeavyChain
caggcgcacuuggagcagagcgggagcggggugaagaaggugggggcgagcgugagggugagcuguuggacgagcgaggacauauucgagaggacggaguugauacauugggugaggcaggcgccggggcagggguuggaguggauagggugggugaaggcggugaguggggcgguaaauuacgggagcuuggacuuuaggcauagggugagcuugacgagggacagggacuuguucacggcgcauauggauauaaggggguugacgcaggacgauacggcaauauauuucugugcgaggcagaaguucgagaggggagggcagggguggauauuugacuugugggggagggggacguugauagcggugaguagc

SEQ ID NO: 56673 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcuaauacacugggucaggcaagcgcccgggcaagggcucgaguggauaggaugggucaagaccgugacaggggccgugaacuuuggcucgagcgauuucaggcaaagggucucgcucacgcgcgaucgagaucucuuuaccgcgcacauggacauacgcgggcuaacgcaaggggacacggccacguacuuuugcgcgcgccagaaauuugccaggggcgaucaagggugguuuuucgaucucuggggcaggggcacgcucauagucgugagcucg

SEQ ID NO: 56674 - RNA, 375 nt, Artificial Sequence
  derived and/or modified sequence opt11 from anti-HIV-1_HeavyChain
caggcgcacuuggagcagagcgcgagcggggugaagaggccgggggcgagcgugagggugagcuguuggacgagcgaggacauauucgagaggagugaguugauauauugggugaggcaggcgccggggcagggguuggaguggauagggugggugaagacggugacgggggcggugaauuucgggagcagugacuuuaggcagagggugagcuugacgagggacagggacuuguucacggcgcauauggauauaagaggguugacgcagggggauacggcgacguauuucugugcgaggcagaaguucuaugcgggggggcaggggugguacuuugacuugugggggagggggacguugauaguggugaguagu

SEQ ID NO: 56675 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgacagaaauauuacgcgggcgggcaagggugguauuucgaucucuggggcaggggcacgcucauagucgugagcucg

SEQ ID NO: 56676 - RNA, 375 nt, Artificial Sequence
  derived and/or modified sequence opt11 from anti-HIV-1_HeavyChain
cagguccagcuagugcaaucgggcucgggcgugaaaaagcccggggccucggucagggucucgugcuggaccucggaagauaucuuugaaaggaccgagcucauacacugggucagacaagcgcccgggcaagggcucgaguggauaggcuggguaaagaucgugagcggggccgugaacuuuggcucgccaaauuucaggcaaagggucucgcuaacgcgcgaucgcgaucucuuuaccgcgcacauggacauacgcgggcucacgcaaggggacacggccacauacuuuugcgcgcgccagaaauuugaaaggggcgggcaaggguggauauucgaucucuggggcaggggcacgcucauagccgugaguucg

SEQ ID NO: 56677 - RNA, 375 nt, Artificial Sequence
  derived and/or modified sequence opt11 from anti-HIV-1_HeavyChain
aggcacacgugggagcaaucgggaucgggagugaaaaagccaggggccagugucaggguaucgugcuggacaagcgaagauauauuugaaaggacagagcuaauacacugggucaggcaagcgccagggcaagggcuagaguggauaggcuggguaaagauagugagcggggccgugaacuuuggcucgccaaauuucaggcaaaggguaagucuaacgagagauagagaucuauuuacagcgcacauggacauaagagggcuaacgcaaggggacacggccacguacuucugcgcgagacagaaauuugaaaggggcgggcaaggguggauauucgaccuauggggcaggggaacgcuaauagccgugagcucg

SEQ ID NO: 56678 - RNA, 372 nt, Artificial Sequence
  derived and/or modified sequence opt11 from anti-HIV-1_HeavyChain
cgccauaccugggaacagagcgggagcggggucaagaaaccgggcgcgagcgugcgagugagcuguuggacgagcgaggacauauucgagcgcacggaauugauccauugggugcgccaggccccgggccagggcuuggaauggaucgggugggugaaaacggucacgggcgcggucaaucuagcgcccaauuucaggcacagggucucgcucacgcgcgaucgcgaucucuuuaccgcgcacauggacauacgcgggcucacgcaaggggacacggccacguacuuuugcgcgcgccagaaauuugaaaggggcgggcaagggugguauuucgaucucuggggcaggggcacgcucauaguagugagcucg

SEQ ID NO: 56679 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaagggagcgagcuaauacacugggucaggcaagcgcccgggcaagggcucgaguggauaggcugggucaagaccgugaccggggccgugaacuuuggcucgagcgauuucaggcaaagggucucgcucacgcgagaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56680 - RNA, 375 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcucauauacugggucaggcaagcgcccgggcaagggcucgaguggauaggcugggucaagaucgugagcgggaccgugaacuuugccucgagcgauuucaggaacaggaucucgcucucgcgagaucgcgaucucucgaccgcgcacauggacauacgcgggcucacgcaaggggacacggccacguacuuuugcgcgcgccagaaauauuacgcgggagggcaagggugguauuucgaucucuggggcaggggcacgcucauagucgugagcucg

SEQ ID NO: 56681 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuucgaaaggaccgagcucauacacugggucaggcaagcgcccgggcaagggcucgaguggauaggcugggucaagaucgugagcggggccgugaacuuuggcucacccaauuucagacaaagggucucgcucacgcgcgaucgcgaucucuuuaccgcgcacauggacauacgcgggcucacgcaaggggacacggccacguacuucugcgcgcgacagaaauuugaaaggggcgggcaaggguggauauucgaucucuggggcaggggaacgcucauagccgugagcucg

SEQ ID NO: 56682 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggaugggucaagaccgugaccggggccguaaacuuuggcucgagcgauuucaggcaaagggucucacucacgcgcgaucgcgaucucuuuaccgcgcacauggacauacgcgggcucacgcaaggggacacggccacguacuuuugcgcgcgccagaaauuuuacaagggcgggcaagggugguauuucgaucucuggggcaggggcacgcucauagucgugagcucg

SEQ ID NO: 56683 - RNA, 375 nt, Artificial Sequence
  derived and/or modified sequence opt11 from anti-HIV-1_HeavyChain
caggcccaucucgagcaaucgggcucgggcgugaaaaagcccggggccucggucagagucucgugcuggaccucggaagauaucuuugaaaggaccgagcucauacacugggucaggcaagcgcccgggcaagggcucgaguggauaggcugggucaagaccgugaccggggccgugaacuuuggcucgcccaauuucaggcacagggucucgcucacacgcgaucgcgaucucuuuaccgcgcacauggacauacgagggcucacgcaaggggacacggccacguacuuuugcgcgcgacagaaauuugccaggggcgaucaagggugguuuuucgaucucuggggcaggggcacgcucauagucgugagcucg

SEQ ID NO: 56684 - RNA, 375 nt, Artificial Sequence
  derived and/or modified sequence opt11 from anti-HIV-1_HeavyChain
caggcgcacuuggagcagagcgggagcggggugaagaagcugggggcgagcgugagggugagcuguuggacgagcgaggacauauucgagaggacggaguugauacauugggugaggcaggcgccggggaggggguuggaguggauagggugggugaaggcggugaguggggcggugaauuacgggagcuuggacuuuaggcauagggugagcuugacgagggacagagacuuguucacggcgcauauggauauaaggggguugacgcagggggauacggcgacguauuucugugcgaggcagaaguucgagaggggagggcaggggugguacuuugacuugugggggagagggacguugauagugguaucgagc

SEQ ID NO: 56685 - RNA, 375 nt, Artificial Sequence
  derived and/or modified sequence opt11 from anti-HIV-1_HeavyChain
caggcgaggccggggacgagcgggagcggggugaagaagccgggggcgagugugagggugagcuguuggaguagcgaggacauauucgagaggacggaguugauacauuggguaaggcaggcgccggggcagggguuggaguggauagggugggugaagacggugacgggggcggugaauuucgggagcuuggacuuuaggcagagggugaguuugacgagggacagggacuuguucacggcgcauauggauauaaggggguugacgcagggggauacggcgacguauuucugugcgaggcagaaguucgagaggggggggcagggguggauauuugacuugugggggagagggacguugauagcggugaguagc

SEQ ID NO: 56686 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugagacaggcgccggggcagggguuggaguggauagggugggugaagacgguaacgggggcggugaauuucgggagcccgaacuuuaggcauagggugagcuugacgagggacagggacuuguucacggcgcauauggauauaaggggguugacggagggggauacggcgacguauuucugugcgaggcagaaguucgagaggggggggcagggguggauauuugacuugugggggagggggacguugauagcgguaaguagc

SEQ ID NO: 56687 - RNA, 375 nt, Artificial Sequence
  derived and/or modified sequence opt11 from anti-HIV-1_HeavyChain
caagcgcaccuggaacagagcgggagcggggucaagaaaccgggcgcgagcgugcgcguaagcuguuggacgagcgaggacauauucgagcgcacggaacugauccauugggugcgccaggccccgggccagggccuggaauggaucgggugggugaaagcgauaucgggcgcggucaauuacgggagccuggacuuucgccaucgcgugagcuugaccagggacagggacuuguucacagcccauauggauaucaggggccugacccaggacgauaccgcgaccuauuucugugccaggcaaaaguucgcgcgcggggaccagggcugguucuuugacuugugggggcgcgggacccuaaucguggucucgagc

SEQ ID NO: 56688 - RNA, 375 nt, Artificial Sequence
  derived and/or modified sequence opt11 from anti-HIV-1_HeavyChain
caggcacaccuggagcaaagcggaagcggagugaaaaagccgggggcaagcguaaggguaagcugcuggacaagcgaagacauauucgaaaagagcgagcuaauacacuggguaaggcaggcgccggggcaagggcuggaguggauaggauggguaaagacagugacaggggcggugaacagcggaagcccgaacuucaggcacaggguaagccugacgagagacagagaccuguucacagcgcacauggacauaagagggcugacgcaaggggacacggcgacguacuucugcgcgagacagaaauucgaaaggggagggcaggggugguacuucgaccuauggggaagggggacgcuaauaguagugagcagc

SEQ ID NO: 56689 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagagggcggaguugauacauugggugagacaggcgccgggacagggguuggaguggauagggugggugaagacggugaguggggcgguaaauuucgggagccugaacuuuaggcauagggugaguuugacgagggacagggacuuguucacggcgcauauggauauaaggggguugacgcagggggauacggcaacguauuucugugcgaggcagaaguucgcgagaggggaccaggggugguucuuugaccugugggggagggggacguugauagugguaaguagc

SEQ ID NO: 56690 - RNA, 375 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaauugauccauugggugcgccaggccccgggccagggcuuggaauggaucgggugggugaaagcggucucgggcgcggucaauuacgggagcuuggacuuucgacaucgcgugagccugaccagggacagagacuugagcacggcccauauggauaucaggggcuugacccaggacgauacagcgaccuauuucugugccaggcaaaaguucgcgcgcggggaccagggcugguucuuugacuugugggggcgagggaccuuggucacggucucgagc

SEQ ID NO: 56691 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcuugaacuuuaggcauagggugagcuugacgagggacagggacuuguucacggcgcauauggauauaaggggguugacgcagggggauacggcgacguauuucugugcgaggcagaaguucgagagaggagggcaggggugguacuuugacuugugggggagggggacguugauaguggugucgagc

SEQ ID NO: 56692 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauacauugggugcgacaggccccgggccagggcuuggaauggaucgggugggugaaaacggucacgggcgcagucaauuucgggaguccgaacuuucgccaucgcgugagcuugaccagggacagggacuugagcacggcccauauggauaucaggggcuugacccaggacgauaccgcgaccuauuucugugccaggcaaaaguucgcgcgcggggaccagggcugguucuuugacuugugggggcgcgggaccuugaucguggucucgagc

SEQ ID NO: 56693 - RNA, 375 nt, Artificial Sequence
  derived and/or modified sequence opt11 from anti-HIV-1_HeavyChain
caaucacaccucgaacaauccggcucagccaugaaaaaacccggcgccuccguccgcgucuccugcuggaccuccgaagacaucuucgacaccaccgaacucaucuacuggguccgccaagcccccggccaaggccucgaauggaucggaugggucaaaaccgucaccggcgccgucaacuucggcucacccaacuuccgccaccgcgucucccucacccgcgaccgcgaccucuucaccgcccacauggacauccgcggccucacccaaggcgacaccgccaccuacuucugcgcccgccaaaaauacuacgccggcggacaaggcugguacuucgaccucuggggccgcggcacccucaucgucgucuccucc

SEQ ID NO: 56694 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagagaacggaguugauacauugggugaggcaggcgccggggcagggguuggaauggauagggugggugaagacggcgucgggggcggugaauuucgggagcccgaacuuuaggcauagagugagcuugacgagggacagggacuuguucacggcgcauauggauauaaggggguugacgcagggggauacggcgacguauuucugugcgagacagaaguucgagaggggggggcaggggugguacuuugacuugugggggagggggacguugauaguggugaguagc

SEQ ID NO: 56695 - RNA, 375 nt, Artificial Sequence
  derived and/or modified sequence opt11 from anti-HIV-1_HeavyChain
caggcgcacuuggagcagagcgggagcggggugaagaaguugggggcgagcgugagggugagcuguuggacgagugaggacauauucgagaggacggaguugauacauugggugaggcaggcgccggggcagggguuggaguggauagggugggugaaggcggugaguggggcggugaauuacgggagcuuggacuuuaggcauagggugagcuugacgagagacagggacuuguucacggcgcauauggauauaaggggguugacgcaggacgauacggcgacguauuucugugcgaggcagaaguucgagaggggggggcaggggugguacuuugacuugugggggagggggacguugauaguggugaguagc

SEQ ID NO: 56696 - RNA, 375 nt, Artificial Sequence
  derived and/or modified sequence opt11 from anti-HIV-1_HeavyChain
caagcgcacuuggaacagagcgcgagcggggucaagcgaccgggcgcgagcgugcgcgugagcuguuggacgagcgaggacauauucgagcgcucggaauugaucuauugggugcgacaggccccgggccagggcuuggaauggaucgggugggugaaaacggucucgggcgcggucaauuucgggagcacggacuuucgcgagcgcgugagcuugaccagggacagggacuuguucacggcccauauggauaucaggggauugacccagggcgauaccgcgaccuauuucugugccaggcaaaaguucgagcgcgggggccagggcugguacuuugacuugugggggcgagggaccuugaucguggucucgagc

SEQ ID NO: 56697 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggacaucggaagauaucuuugaaaggaccgagcucauacacugggucaggcaagcgcccgggcaagggcucgaguggauaggcugggucaaggccgugagcggggucgugaacuauggcucgcucgauuucaggcacagggucucgcucacgcgagaucgcgaucucucgaccgcgcacauggacauacgagggcucacgcaagaugacacggccacguacuuuugcgcgcgacagaaauuugccaggggcgaucaagggugguuuuucgaucucuggggcaggggcacgcucauagucgugagcucg

SEQ ID NO: 56698 - RNA, 375 nt, Artificial Sequence
  derived and/or modified sequence opt11 from anti-HIV-1_HeavyChain
caggcgcacuuggagcagagcgggagcggggugaagaaggugggggcgagcgugagagugagcuguuggacgagcgaggacauauucgagaggacggaguugauacauugggugaggcaggcgccggggcagggguuggaguggauagggugggugaagacggugaguggggcggugaauuucgggagcccgaacuuuaggcauagggugagcuugacgagggacagggacuuguucacggcgcauauggauauaaggggguugacgcagggggauacggcgacguauuucugugcgaggcagaaguucgagaggggggggcaggggugguacuuugacuugugggggagggggacguugauaguggugaguagc

SEQ ID NO: 56699 - RNA, 375 nt, Artificial Sequence
  derived and/or modified sequence opt11 from anti-HIV-1_HeavyChain
caggccuaucucgagcaaucgggcucgaucaugaaaaagcccggggccucggucagggucucgugcuggaccucggaagauaucuuugacaggaccgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucuauuuaccgcgcacauggacauacgcgggcucacgcaaggggacacggccacguacuuuugcgcgcgccagaaauuuuacgcgggcgggcaagggugguauuucgaucuauggggcaggggcacgcucauagucgugagcucg

SEQ ID NO: 56700 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcucgcgcccgggcaagggcuagaguggauaggcugggucaagaccgugaccggggccgugaacuuuggaucgagcgauuucaggcaaagggucucgcucacgcgcgaccgcgaucucuuuacagcgcacauggacauacgcgggcuaacgcaaggggacacggccacguacuuuugcgcgcgccagaaauuuuacgcgggcgggcaagggugguauuucgaucucuggggcaggggcacgcucauagucgugagcucg

SEQ ID NO: 56701 - RNA, 375 nt, Artificial Sequence
  derived and/or modified sequence opt11 from anti-HIV-1_HeavyChain
gaggcccaucuagagcaaucgggcucgggcgugaaaaagcccggggccucgguaagggucucgugcuggaccucggaagauaucuuugaaaggaccgaacucacgcacugggucaggcaagcacccgggcaagggcucgaguggauaggcugggucaagaccgugaccggggccgugaacuuuggcucgcccaauuucaggcaaagggucucgcucacgcgcgaucgcgaucucuuuaccgcgcacauggacauacgcgggcucacgcaaggggacacggccacguacuuuugcgcgcgccagaaauuugaaaggggcgggcaaggguggauauucgaucucuggggcaggggaacgcucauagccgugagcucg

SEQ ID NO: 56702 - RNA, 375 nt, Artificial Sequence
  derived and/or modified sequence opt11 from anti-HIV-1_HeavyChain
caggcgcacuuggagcagagcgggagcgggguaaagaagccgggggcgagcgugagagugagcuguuggacgagcgaggacauauacgagaggacggaguugauacauugggugaggcaggcgccggggcagggguuggaguggauagggugggugaaggcggugucgggggcggugaauuacgggagcuuggacuuuaggcauagggugagccugacgagggacagggacuuguucacggcgcauauggauauaaggggauugacgcaggacgauacggcgauauauuucugugcgaggcagaaguucgcgagaggggaccagggaugguucuuugacuugugggggcgagggacguugauaguggugucgagc

SEQ ID NO: 56703 - RNA, 375 nt, Artificial Sequence
  derived and/or modified sequence opt11 from anti-HIV-1_HeavyChain
caagugcacuuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcgguaaauuucgggagcccgaacuuucgccaucgcgugagcuugaccagggacagagacuuguucacggcccauauggauaucaggggcuugacccagggcgauaccgcaaccuauuucugugccagacaaaaguucgagcgcgggggccagggcugguacuuugacuugugggggcgcgggaccuugaucguggucucgagc

SEQ ID NO: 56704 - RNA, 375 nt, Artificial Sequence
  derived and/or modified sequence opt11 from anti-HIV-1_HeavyChain
caggcgcacuuggagcagagcgggagcggggugaagaaggugggggcgagcgugagggugagcuguuggacgagcgaggacauauucgagaggacggaguugauacauugggugaggcaggcgccggggcagggguuggaguggauagggugggugaaggcggugaguggggcggugaauuacgggagcuuggacuuuaggcauagggugagcuugacgagggacagggacuugagcacggcgcauauggauauaaggggguugacacaggacgauacggcgacguauuucugugcgaggcagaaguucgcgagaggggaccaggggugguucuuugacuugugggggagggggacguugauaguggugaguagc

SEQ ID NO: 56705 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggacagagcucauacacugggucaggcaagcgcccgggcaagggcucgaguggauaggcugggucaagaccgugagcggggccgugaacuuuggcccgcccaauuucagacacaggguaucgcucacgcgcgaucgcgaucucuuuaccgcgcacauggacauacgcgggcuaacgcaaggggacacggccacguacuuuugcgcgcgccagaaauuugaaaggggcgggcaagggugguauuucgaucucuggggcaggggcacgcucauagucgugagcucg

SEQ ID NO: 56706 - RNA, 375 nt, Artificial Sequence
  derived and/or modified sequence opt11 from anti-HIV-1_HeavyChain
caggcgcacuuggagcagagcgggagcggggugaagaaguugggggcgagugugagggugaguuguuggacgagcgaggacauauucgagaggacggaguugauacauugggugaggcaggcgccggggcagggguuggaguggauagggugggugaaggcggugaguggggcggugaauuacgggagcuuagacuuuaggcauagggugaguuugacgagggacagggacuugagcacggcgcauauggauauaaggggguugacgcaggacgauacggcgacguauuucugugcgaggcagaaguucgagaggggggggcagggguggauauuugacuugugggggagggggacguugauagcggugaguagc

SEQ ID NO: 56707 - RNA, 375 nt, Artificial Sequence
  derived and/or modified sequence opt11 from anti-HIV-1_HeavyChain
caggcccaucucgagcaaucgggcucgggagugcgcaagcccggggcaucggucagggucucgugcuggaccucggaagauaucuuugaaaggacagagcucauacacugggucaggcaagcgcccgggcaagggcucgaguggauaggcuggguaaagacagugaccggggccgugaacuuuggcucgagcgauuucaggcaaaggguaucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56708 - RNA, 375 nt, Artificial Sequence
  derived and/or modified sequence opt11 from anti-HIV-1_HeavyChain
caggcgcacuuggagcagagcgggagcggggugaagaaguugggggcgagcgugagggugagcuguuggacgagcgaggacauauucgagaggacggaguugauacauugggugaggcaggcgccggggaggggguuggaguggauagggugggugaaggcggugaguggggcggugaauuacgggagcccgaacuuuagacauagggugagcuugacgagggacagggacuuguucacggcgcauauggauauaaggggguugacgcagggggauacggcgacguauuucugugcgaggcagaaguucgagaggggagggcaggggugguacuuugacuugugggggagggggacguugauaguggugaguagc

SEQ ID NO: 56709 - RNA, 375 nt, Artificial Sequence
  derived and/or modified sequence opt11 from anti-HIV-1_HeavyChain
caggcccaucucgagcaaucgggcucaggcgugaaaaagcccggggccucggucagggucucgugcuggaccucggaagauaucuuugaaaggaccgagcucauacacugggucaggcaagcgcccgggcaagggcucgaguggauaggcugggucaagaccgugagcggggccgugaacuuuggcucgcccaauuucaggcacagggucucgcuaacgcgcgaucgcgaucucuuuaccgcgcacauggacauacgcgggcucacgcaaggggacacggccacguacuuuugcgcgcgccagaaauuugaaaggggcgggcaagggugguauuucgaucucuggggcaggggcgcgcucauagucgugagcucg

SEQ ID NO: 56710 - RNA, 375 nt, Artificial Sequence
  derived and/or modified sequence opt11 from anti-HIV-1_HeavyChain
caggcacaccuggagcaaagcggaagcggagugaaaaagccgggggcaagcguaaggguaagcugcuggacaagcgaagacauauucgaaaagagcgagcugauacacuggguaaggcaggcgccggggcaagggcuggaguggauaggauggguaaagacagugacaggggcagugaacuucggaagcgcauacuucaggcacaggguaagccugacgagagacagagaccuauucacagcgcacauggacauaagagggcugacgcaaggggacacggcaacguacuucugcgcgagacagaaauucuacaagggagggcaggggugguacuucgaccuguggggaagggggacgcuaauaguagugagcagc

SEQ ID NO: 56711 - RNA, 375 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacgagcgaggacauauucgagcgcacggaauugaucuauugggugcgacaggccccgggcaggggcuuggaauggaucgggugggugaaaacggucucgggcacagucaauuucgggagcuuggacuuucgccaucgcgugagcuugaccagggacagggacuugagcacggcccauauggauaucaggggcuugacccaggacgauaccgcgaccuauuucugugccaggcaaaaguucgcgcgcggggaccagggcugguucuuugacuugugggggcgcgggaccuugaucguggucucgagc

SEQ ID NO: 56712 - RNA, 375 nt, Artificial Sequence
  derived and/or modified sequence opt11 from anti-HIV-1_HeavyChain
cagagccaucucgagcaaucgggcucggccaugaaaaagcccggggccucggucagagucucgugcuggaccucggaagauaucuuugacacgaccgagcucauauacugggucaggcaagcgcccgggcaagggcucgaguggauaggcuggguaaagaucgugagcgggaccgugaacuuugcaucaagcgauuucaggaacaggaucucgcucucgcgcgaucgcgaucucucgaccgcgcacauggacauacgcgggcucacgcaagaugacacggccacguacuuuugcgcgcgacagaaauuuuacgcgggcgggcaagggugguauuucgaucuauggggaaggggcacgcucauagucgugagcucg

SEQ ID NO: 56713 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcaagggcucgaguggauaggcugggucaaggccgugaccggggccgugaacuuuggcucgagcgauuucaggcaaagggucucgcucacgcgcgaucgcgaucucuuuacagcgcacauggacauacgagggcucacgcaaggggacacggccacguacuuuugcgcgcgccagaaauuuuacgcgggcgggcaagggugguauuucgaucucuggggcaggggcacgcucauagucguaagcuca

SEQ ID NO: 56714 - RNA, 375 nt, Artificial Sequence
  derived and/or modified sequence opt11 from anti-HIV-1_HeavyChain
cagagccaucucgagcaaucgggcucggccaugaaaaagcccggggccucggucagggucucgugcuggacaucggaagauaucuuugaaaggaccgagcucauauacugggucaggcaagcgcccgggcgcgggcucgaguggauaggcugggucaagaccgugagcggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcuaauagucgugagcucg

SEQ ID NO: 56715 - RNA, 375 nt, Artificial Sequence
  derived and/or modified sequence opt11 from anti-HIV-1_HeavyChain
caggcgcacuuggagcagagcgggaguggggugaaaaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccgaacuuuagacauagggugagcuugacgagggacagggacuuguucacggcgcauauggauauaaggggguugacgcagggggacgcggcgacguauuucugugcgaggcagaaguucgagagaggggggcaggggugguacuuugacuugugggggagagggacguugauaguggugaguagc

SEQ ID NO: 56716 - RNA, 375 nt, Artificial Sequence
  derived and/or modified sequence opt11 from anti-HIV-1_HeavyChain
caggcccaucucgagcaaucgggcucgggcgugaaaaagcuaggggccucggucagggucucgugcuggaccucggaagauaucuuugaaaggaccgagcucauacacugggucaggcaagcgcccgggcgcgggcucgaguggauaggaugggucaaggccgugagcggggccgugaacuauggcucgcucgauuucaggcacagggucucgcuaacgcgcgaucgcgaucucuuuaccgcgcacauggacauacgagggcucacgcaagaugacacggccacguacuuuugcgcgcgccagaaauuuuacgcgggcgggcaagggugguauuucgaucucuggggcaggggcacgcucauugucgugagcucg

SEQ ID NO: 56717 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccggggcagggguuggaguggauagggugggugaagauagugaguggggcggugaauuucgggagcccgaacuuuaggcagagggugagcuugacgagggacagggacuuguucgcggcgcauauggauauaaggggguugacgcagggggauacggcgacguauuucugugcgaggcagaaguucgagaggggagggcagggguggauauuugacuugugggggagggggacgcugauagcggugaguagc

SEQ ID NO: 56718 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucgcccaauuucaggcacagggucucgcucacgcgcgaucgagaucucuuuaccgcgcacauggacauacgcgggcucgcgcaaggggacacggccacguacuuuugcgcgcgccagaaauuugaaaggggcgggcaagggugguauuucgaucucuggggcaggggcacgcucauagucgugagcucg

SEQ ID NO: 56719 - RNA, 375 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacgagcgaggacauauucgauaccacggaauugaucuauugggugcgccaggccccgggccagggcuuggaauggaucgggugggugaaaauagucucgggcacggucaauuucgcgagcucggacuuucgcaaucgcauaagccugagcagggacagggacuugagcacggcccauauggauaucaggggcuugacccaggacgauaccgcgaccuauuucugugccaggcaaaaguucgagcgcgggggccagggcugguacuuugacuugugggggcgcgggaccuugaucguggucucgagc

SEQ ID NO: 56720 - RNA, 375 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcucauauacugggucaggcaagcgcccgggcaagggcucgaguggauaggcugggucaagaucguaagcgggaccgugaacuuugccucgcucgauuucaggaacagggucucgcucacgcgcgaucgcgaucucuuuaccgcgcacauggacauacgcgggcucacgcaaggggacacggccacguacuuuugcgcacgacagaaauuuuacgcgggcgggcaagggugguauuucgaucucuggggcaggggcacgcucauagucgugagcuca

SEQ ID NO: 56721 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccggggcaggggcuggaguggauagggugggugaagauagugaguggggcggugaauuucgggagcccgaacuuuaggcauagggugagcuugacgagggacagggacuuguucacggcgcauauggauauaaggggguugacgcagggggauacggcgacguauuucugugcgaggcagaaguucgagaggggggggcaggggugguacuuugacuugugggggagggggacguugauaguggugaguagc

SEQ ID NO: 56722 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcgcgcgcccgggcaagggcucgaguggauaggcugggucaagaccgugaccggggccgugaacuuuggcucgagcgauuucaggcaaagggucucgcuaacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56723 - RNA, 375 nt, Artificial Sequence
  derived and/or modified sequence opt11 from anti-HIV-1_HeavyChain
caggcgcacuuggagcagagcgggagcggggugaagaaguugggggcgagcgugagggugagcuguuggacgagcgaggacauauucgagaggacggaguugauacauugggugaggcaggcgccggggcagggguuggaguggauagggugggugaaggcggugaguggggcggugaauuacgggagcuuggacuuuaggcagagggugagcuugacgagggacagggacuuguucacggcgcauauggauauaaggggguugacgcagggggauacagcgacguauuucugugcgaggcagaaguucgagaggggagggcagggguggauauuugacuugugggggagagggacguugauagcggugaguagc

SEQ ID NO: 56724 - RNA, 375 nt, Artificial Sequence
  derived and/or modified sequence opt11 from anti-HIV-1_HeavyChain
caggcccaucucgagcaaucgggcucgggcgugaaaaagcccggggccucagucagggucucgugcuggagcucggaagauaucuuugaaaggaccgagcucauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuuuacaagggcgggcaagggugguauuucgaucucuggggcaggggcacgcuaauagucgugagcucg

SEQ ID NO: 56725 - RNA, 375 nt, Artificial Sequence
  derived and/or modified sequence opt11 from anti-HIV-1_HeavyChain
caggcccaucucgagcaaucgggcucgggcgugaaaaagcccgggaccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaccucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56726 - RNA, 375 nt, Artificial Sequence
  derived and/or modified sequence opt11 from anti-HIV-1_HeavyChain
cagagccaucucgagcaaucgggaucggccaugaaaaagcccggggccucggucagggucucgugcuggaccucggaagauaucuuugacacgaccgagcucauauacugggucaggcaagcgcccggacaagggcucgaguggauaggcugggucaagaucgugagcgggaccgugaacuuugccucgcucgauuucaggaacaggaucucgcucucgcgcgaucgcgaucucucgaccgcgcacauggacauacgcgggcucacgcaagaugacacggccacguacuuuugcgcgcgacagaaauuuuacgcgggcggacaagggugguauuucgaucucuggggcaggggcacgcucauagucgugagcuca

SEQ ID NO: 56727 - RNA, 375 nt, Artificial Sequence
  derived and/or modified sequence opt11 from anti-HIV-1_HeavyChain
caagcgcacuuggaacagagcgggagcggggucaagaaauugggcgcgagcgugcgagugagcuguuggacgagcgaggacauauucgagcgcacgggcuugauccauugggugcgccaggccccgggacagggcuuggaauggaucgggugggugaaagcggucucgggcgcggucaauuacgggagcuuggacuuucgccaucgcgugagcuugaccagggacagggacuuguucacggcccauauggauaucaggggcuugacccaggacgauaccgcgaccuauuucugugccaggcaaaaguucgcgcgcggggaccagggcugguucuuugacuugugggggcgcgggaccuugaucguggucucgagc

SEQ ID NO: 56728 - RNA, 375 nt, Artificial Sequence
  derived and/or modified sequence opt11 from anti-HIV-1_HeavyChain
caggcgcacuuggagcagagcgggagcggggugaagaagccggggacgagcgugagggugagcuguuggacgagcgaggacguguucgagaggacggaguugauacauugggugaggcaggcgccggggcagggguuggaguggauagggugggugaagacggugauaggggcggugaauuucgggagcccgaacuuuaggcauagggugagcuugacgagggacagggacuuguucacggcgcauauggauauaaggggguugacgcagggggauacggcgacguauuucugugcgagacagaaguucgagaggggagggcaggggugguacuuugaccugugggggagggggacguugauaguggugaguagc

SEQ ID NO: 56729 - RNA, 372 nt, Artificial Sequence
  derived and/or modified sequence opt11 from anti-HIV-1_HeavyChain
caagcgcacuuggaacagagcggggccggggucaagaaaccgggcgcgagcgugcgcgugagcuguuggacgagcgaggacauauucaagaccgagcucauacacugggucaggcaagcgcccgggcaagggcucgaguggauaggcugggucaagaucgugagcggggccgugaacuuuggcucacccaauuucaggcaaagggucucgcuaacgcgcgaucgcgaucucuuuaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucg

SEQ ID NO: 56730 - RNA, 375 nt, Artificial Sequence
  derived and/or modified sequence opt11 from anti-HIV-1_HeavyChain
caagcgcacuuggaacaaagcggaagcggggucaagaaaccgggcgcgagcgugagagugagcuguuggacgagcgaggacauauucgagcgcacagaauugauccacuggguacgccaggccccaggccagggcuuggaauggaucggguggguaaaaacggucucgggcgcagucaauuucgggagcccggacuuucgacaucgcgugagccugaccagagacagggaccuguucacagcccauauggauaucagaggccugacccagggcgauaccgcgaccuauuucugugcaaggcaaaaguucgcgcgcggggaccagggcugguucuuugaccugugggggcgcgggaccuuaaucguggucucgagc

SEQ ID NO: 56731 - RNA, 375 nt, Artificial Sequence
  derived and/or modified sequence opt11 from anti-HIV-1_HeavyChain
caggcacaucucgagcaaucgggcucgggcguaaaaaggcccggggccucgguaagggucucgugcuggaccucggaagauaucuucgaaacgaccgagcuaauacacugggucaggcaagcgcccgggcaagggcucgaguggauaggcugggucaagaccgugagcggggccgugaacuuuggcucgcuaaauuucaggcacaggaucucgcuaacgcgcgaccgcgaucucuuuaccgcgcacauggacauacgcgggcucacgcaaggggacacggccacguacuucugcgcgcgccagaaauuugccaggggcgaucaaggaugguuuuucgaucucuggggcagaggcacgcucauagucgugagcucg

SEQ ID NO: 56732 - RNA, 375 nt, Artificial Sequence
  derived and/or modified sequence opt11 from anti-HIV-1_HeavyChain
caggcgcacuuggagcagagcgggagcggggugaagaagcugggggcgagcgugagggugagcuguuggacgagcgaggacauauucgagaggacggaguugauacauugggugaggcaggcgccggggcagggguuggaguggauagggugggugaaggcggugaguggggcggugaauuacgggaguuuggacuuuaggcauagggugagucugacgagggacagggacuugagcacggcgcauauggauauaaggggguugacgcaggacgauacggcgauauauuucugugcgaggcagaaguucgcgaggggggaccaggggugguucuuugacuugugggggagggggacauugauaguggugaguagc

SEQ ID NO: 56733 - RNA, 375 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacaagcgaggacauauucgagcgaacggaauugauccauugggugcgccaggccccgggccagggauuggaauggaccgggugggugaaagcggucucgggcgcggucaauuacgggagccuggacuuucgccaucgcgugagcuugaccagggacagagacuugagcacggcccauauggauauaaggggcuugacccaggacgauaccgcgaccuauuucugugccaggcaaaaguucgcgcgcggggaccagggcugguucuuugacuugugggggcgcgggaccuugaucguggucucgagc

SEQ ID NO: 56734 - RNA, 375 nt, Artificial Sequence
  derived and/or modified sequence opt11 from anti-HIV-1_HeavyChain
caggcccaucucgagcaaucgggcucgggcgugaaaaagcuaggggccucggucagggucucgugcuggaccucagaagauaucuuugaaaggaccgagcucauacacugggucagacaagcgcccgggcaagggcucgaguggauaggcugggucaaggccgugagcggggccgugaacuauggcucgcucgauuucaggcacagggucucgcucacgcgcgaucgcgaucuauuuaccgcgcacauggacauacgcgggcccacgcaagaugacacggccacguacuuuugcgcgcgccagaaauuugccaggggcgaucaagggugguuuuucgaucucuggggcaggggcacgcucauagucgugagcucg

SEQ ID NO: 56735 - RNA, 375 nt, Artificial Sequence
  derived and/or modified sequence opt11 from anti-HIV-1_HeavyChain
caggcccaucuagagcaaucgggcucgggcgugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucucgaccgcgcacauggacauacgcgggcucacgcaaggggacacggccacguacuuuugcgcgcgccagaaauuugaaaggggcgggcaagggugguauuucgaucucuggggcaggggcacgcucauagucgugagcucg

SEQ ID NO: 56736 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggucgagcgaggacauauucgagaggacggaguugauacauugggugaggcaggcgccggggcagggguuggaguggauagggugggugaagacggugacgggggcggugaauuucgggagcccgaacuuuaggcauagggugagcuugacgagggacagggacuuguucacggcacauauggauauaaggggguugacgcagggggauacggcgacguauuucugugcaaggcagaaguucgagaggggagggcaggggugguacuuugacuugugggggagagggacguugauaguggugaguagc

SEQ ID NO: 56737 - RNA, 375 nt, Artificial Sequence
  derived and/or modified sequence opt11 from anti-HIV-1_HeavyChain
aggcacacguggaaugaaucgggcucgggcgugaaaaagcccggggccucggucagggucucaugcuggaccucggaagauaucuuugaaaggaccgagcucauacacugggucaggcaagcgcccgggcaagggcucgaguggauaggcugggucaagaccgugaccgggaccgugaacuuuggcucgcucaauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcuaauagucgugagcucg

SEQ ID NO: 56738 - RNA, 375 nt, Artificial Sequence
  derived and/or modified sequence opt11 from anti-HIV-1_HeavyChain
caagcacaccuagaacaaagcggagccggagucaaacgcccaggcgcaagcguacgcguaagcugcuggacaagcgaagacauauucgagaccacagaacugauccacuggguacgacaggccccgggccaaggccuggaauggaucggauggguaaaaacagucucaggcgcagucaacuucggaagcccaaacuuccgccaccgcguaagccugaccagagacagagaccuauucacagcccacauggacaucagaggccugacccaaggcgacaccgcgaccuacuucugcgccagacaaaaauucgaacgcggaggccagggcugguacuucgaccuguggggacgcgggacccuaaucguagucucaagc

SEQ ID NO: 56739 - RNA, 375 nt, Artificial Sequence
  derived and/or modified sequence opt11 from anti-HIV-1_HeavyChain
caggcgcacuuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaagcggucucgggcgcggucaauuucggaagcccgaacuuucgccaucgcgugagcuugacaagggacagggacuuguucacggcccauauggauaucaggggcuugacccagggcgauaccgcgaccuauuucugugccaggcaaaaguucgagcgcgggggccagggcugguacuuugacuugugggggcgcgggaccuugaucguggucucgagc

SEQ ID NO: 56740 - RNA, 375 nt, Artificial Sequence
  derived and/or modified sequence opt11 from anti-HIV-1_HeavyChain
caggcccaucucgggaccauacucgggcucgagagcaagaaaccgggcgcgagcgugcgcgugagcuguuggacgagcgaggacauauucgagcgcacggaauugauccauugggugcgccaggccccgggccagggccuggaauggaucgggugggugaaaacggucacgggcgcgagcauacucgcgcccaauuucaggcacagggucucgcucacgcgagaucgcgaucucuuuaccgcgcacauggacauacgcgggcucacgcaaggggacacggccacguacuuuugcgcgcgccagaaauuugaaaggggagggcaagggugguauuucgaucucuggggcaggggcacgcucauaguagugagcucg

SEQ ID NO: 56741 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggcuuagaauggaucgggugggugaaaacggucacgggcgcggucaauuucgggagcccgaacuuucgccaucgagugagcuugaccagggacagggccuuguucacggcccauauggauaucaggggcuugacccagggcgauaccgcgaccuauuucugugccaggcaaaaguucgcgcgcggggaccagggcugguucuuugacuugugggggcgcgggaccuugaucguggucucgagc

SEQ ID NO: 56742 - RNA, 375 nt, Artificial Sequence
  derived and/or modified sequence opt11 from anti-HIV-1_HeavyChain
cgagugcacuuggaacagagcgggagcggggucaagaaaccgggcgcgagcgugcgcgugagcugcuggacgagcgaggacauauucgagcgcacggaauugauccauugggugcgccaggccccgggccagggcuuggaauggaucgggugggugaaaacggucacgggcgcggucaauuucgggagcccgaacuuucgacaucgcgugagcuugaccagggacagggacuuguucacggcccauauggauaucaggggcuugacccagggcgauaccgcgaccuauuucugugccaggcaaaaguucgagcgcgggggccagggcugguacuuugacuugugggggcgcgggaccuugaucgugguaucgagc

SEQ ID NO: 56743 - RNA, 375 nt, Artificial Sequence
  derived and/or modified sequence opt11 from anti-HIV-1_HeavyChain
caggcgcacuuggagcagagcggggcgggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccgaacuuuaggcagagggugagcuugacaagggacagggacuugagcacggcgcauauggauauaaggggguugacgcaggacgauacggcgacguauuucugugcgaggcagaaguucgcgaggggggaccaggggugguucuuugacuugugggggagggggacguugauaguggugaguagc

SEQ ID NO: 56744 - RNA, 375 nt, Artificial Sequence
  derived and/or modified sequence opt11 from anti-HIV-1_HeavyChain
caagugcaauugguccagagcggggccgaggucaagcgaccgggcgcgagcgugaaagugagcuguuggacgagcgaggacauauucgagcgcacggaauugauccauugggugcgccaggccccgggccagggcuuggaauggaucgggugggugaaaacggucucgggcgcggucaauuucgggagcccgaacuuucgccaucgcgugagcuugacaagggacagggacuuguucacggcccauauggauaucaggggcuugacccagggcgauaccgcgaccuauuucugugccaggcaaaaguucgagcgcgggggccagggcugguacuuugacuugugggggcgcgggaccuugaucguggucucgagc

SEQ ID NO: 56745 - RNA, 375 nt, Artificial Sequence
  derived and/or modified sequence opt11 from anti-HIV-1_HeavyChain
aggcacgaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcuggguaaagaucgugagcggggccgugaacuuuggcucgcccaauuucaggcaaagggucucgcucacgcgcgaccgagaccucuuuaccgcgcacauggacauacgcgggcucacgcaaggggacacggccacguacuuuugcgcgcgacagaaauuugaaaggggcgggcaaggguggauauucgaucucuggggcaggggcacgcuaauagccgugagcucg

SEQ ID NO: 56746 - RNA, 375 nt, Artificial Sequence
  derived and/or modified sequence opt11 from anti-HIV-1_HeavyChain
aggcacacgugggagcaaguguggucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgagaucucuuuaccgcgcacauggacauacgcgggcucacgcaaggggacacggccacguacuuuugcgcgcgccagaaauuuuacgcgggcgggcaagggugguauuucgaucuauggggaaggggcacgcucauagucgugagcucg

SEQ ID NO: 56747 - RNA, 375 nt, Artificial Sequence
  derived and/or modified sequence opt11 from anti-HIV-1_HeavyChain
cgacauaccuggaacaagagcggaagcggggucaagaaaccgggcgcgagcgugcgcgugagcuguuggacgagcgaggacauauucgagcgcacggaauugauccauugggugcgccaggccccgggccagggcuuggaauggaucgggugggugaaagcggucucgggcgcgguaaauuacgggagcuuggacuuucgccaucgcgugagcuugaccagggacagggacuugagcacggcccauauggauaucaggggcuugacccaggacgauaccgcgaccuauuucugugccaggcaaaaguucgcgcgcggggaccagggcugguucuuugacuugugggggcgcgggacccugaucguggucucgagc

SEQ ID NO: 56748 - RNA, 375 nt, Artificial Sequence
  derived and/or modified sequence opt11 from anti-HIV-1_HeavyChain
aggcacacgugggagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucg

SEQ ID NO: 56749 - RNA, 375 nt, Artificial Sequence
  derived and/or modified sequence opt11 from anti-HIV-1_HeavyChain
caggcccaucucgagcaaucgggcucgggcgugaaaaggcccggggccucggucagggucucgugcuggaccucggaagauaucuuugaaacgaccgagcucauacacugggucaggcaagcgcccgggcaagggcucgaguggauaggcugggucaaggccgugagcggggccgugaacuauggcucgcucgauuucaggcacagggucucgcucacgcgagaucgcgaucucucgaccgcgcacauggacauacgcggacucacgcaagaugacacggccacguacuuuugcgcgcgacagaaauuugccaggggcgaucaagggugguucuucgaucucuggggcaggggcacgcucauagucgugagcucg

SEQ ID NO: 56750 - RNA, 375 nt, Artificial Sequence
  derived and/or modified sequence opt11 from anti-HIV-1_HeavyChain
aggcaugacuuggagcagagcgggagcggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccgaacuuuaggcauagggugagcuugacgagggacagggacuuguucacggcgcauauggauauaaggggguugacgcagggggauacggcgacguauuucugugcgaggcagaaguucgagaggggggggcaggggugguacuuugacuugugggggagggggacguugauaguggugaguagu

SEQ ID NO: 56751 - RNA, 375 nt, Artificial Sequence
  derived and/or modified sequence opt11 from anti-HIV-1_HeavyChain
aggcacacgugggagcaaucgggcucgggcgugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucucgaccgcgcacauggacauacgcgggcuaacgcaagaugacacggccacguacuuuugcgcgcgacagaaauuugccaggggcgaucaagggugguuuuucgaucucuggggcaggggcacgcucauagucgugagcucg

SEQ ID NO: 56752 - RNA, 375 nt, Artificial Sequence
  derived and/or modified sequence opt11 from anti-HIV-1_HeavyChain
caggcccaucucgagcaaucgggcucgggcgugaaaaagcccggggccucgguaagggucucgugcuuggccucggaagauaucuuugaaaagagcgagcucauacacugggucaggcaagcgcccgggcaagggcucgaguggauaggcugggucaagaccgugaccggggcagugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcuaauagucgugagcucg

SEQ ID NO: 56753 - RNA, 375 nt, Artificial Sequence
  derived and/or modified sequence opt11 from anti-HIV-1_HeavyChain
caggcccaucucgagcaaucgggcgcgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacacgcgaucgcgaucucuuuaccgcgcacauggacauacgcgggcuaacgcaaggggacacggccacguacuuuugcgcgcgccagaaauuuuacgcgggcgggcaagggugguauuucgaucucuggggcaggggcacgcucauagucgugagcucg

SEQ ID NO: 56754 - RNA, 375 nt, Artificial Sequence
  derived and/or modified sequence opt11 from anti-HIV-1_HeavyChain
aggcacacgugggagcaaucgggcucgggcgugaaaaagcccggggccucggucagggucucgugcuggacaucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcuaacgcaaggggacacggccacguacuuuugcgcgcgccagaaauuuuacgcgggcgggcaagggugguauuucgaucucuggggcaggggcacgcucauagucgugagcucg

SEQ ID NO: 56755 - RNA, 375 nt, Artificial Sequence
  derived and/or modified sequence opt11 from anti-HIV-1_HeavyChain
aggcauacgugggagcagagcgggagcggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccaaacuuuaggcauagggugagcuugacgagggacagggacuuguucacggcgcauauggauauaaggggguugacgcauggggauacggcgacguauuucugugcgaggcagaaguucgagaggggagggcaggggugguacuuugacuugugggggagggggacguugauaguggugaguagc

SEQ ID NO: 56756 - RNA, 375 nt, Artificial Sequence
  derived and/or modified sequence opt11 from anti-HIV-1_HeavyChain
aggcacacgugggagcaaucgggcucgggcgugaaaaagcuaggggccucggucagggucucgugcuggaccucggaagauaucuuugaaaggaccgagcucauacacugggucaggcaagcgcccgggcaagggcucgaguggauaggaugggucaaggccgugagcggggccgugaacuauggcucgcucgauuucaggcacagggucucgcucacgcgcgaucgcgaucucuuuaccgcgcacauggacauacgcgggcuaacgcaaggggacacggccacguacuuuugcgcgcgccagaaauuuuacgcgggcgggcaagggugguauuucgaucucuggggcaggggcacgcucauagucgugagcucg

SEQ ID NO: 56757 - RNA, 375 nt, Artificial Sequence
  derived and/or modified sequence opt11 from anti-HIV-1_HeavyChain
caggcccaucucgagcaaucgggcgcgggcgugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucuuuaccgcgcacauggacauacgcgggcucacgcaagaugacacggccacguacuuuugcgcgcgacagaaauuugccaggggcgaucaagggugguuuuucgaucucuggggcaggggcacgcucauagucgugagcucg

SEQ ID NO: 56758 - RNA, 375 nt, Artificial Sequence
  derived and/or modified sequence opt11 from anti-HIV-1_HeavyChain
caagcgcacuuggaacagagcgggagcggggucaagaaaccgggcgcgagcguggaagugagcuguuggacgagcgaggacauauucgagcgcacggaauugauccauugggugcgacaggccccgggccagggcuuggaauggaucgggugggugaaaacgguaucgggcgcggucaauuucgggagcccgaacuuucgccaucgcgugagcuugaccagggacagagaccuguucacggcacauauggauaucaggggcuugacccagggagauaccgcgaccuauuucugugccaggcaaaaguucgcgcgcggggaccagggcugguucuuugacuugugggggcgcgggacccugaucguggucucgagc

SEQ ID NO: 56759 - RNA, 372 nt, Artificial Sequence
  derived and/or modified sequence opt11 from anti-HIV-1_HeavyChain
caagcgcacuuggaacagagcggggccggggucaagaaauugggcgcgagcgugcgcgugagcuguuggacgagcgaggacauauucaagaccgagcucauacacuggguaaggcaagcgcccgggcaagggcucgaguggauaggcugggucaaggccgugagcggggccgugaacuauggcucgcucgauuucaggcacaggguaucgcucacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56760 - RNA, 375 nt, Artificial Sequence
  derived and/or modified sequence opt11 from anti-HIV-1_HeavyChain
aggcacacgugggagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgacagaaauuuuacgcgggcgggcaagggugguauuucgaucucuggggcaggggcacgcucauagucgugagcucg

SEQ ID NO: 56761 - RNA, 375 nt, Artificial Sequence
  derived and/or modified sequence opt11 from anti-HIV-1_HeavyChain
aggcacacgugggagcgcauauggucgggcgugaaaaagcccggggccucggucaggguaucgugcuggaccucggaagauaucuuugaaaggaccgagcucauacacugggucaggcaagcgcccgggcaagggcucgaguggauaggcugggucaagaucgugagcggggccgugaacuuuggcucgcccaauuucaggcaaagggucucgcuaacgcgcgaucgcgaucucuuuaccgcgcacauggacauacgcgggcucacgcaaggggacacggccacguacuuuugcgcgcgacagaaauuugaaaggggcgggcaaggguggauauucgaucucuggggcaggggcacgcuaauagccgugagcucg

SEQ ID NO: 56762 - RNA, 375 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaauugauccauugggugcgccaggccccgggccagggcuuggaauggaucgggugggugaaagcggucucgggcgcggucaauuacgggagcuuggacuuucgccaucgcgugagcuugaccagggacagggacuugagcacggcccauauggauaucaggcgcuugacccaggacgauaccgcgaccuauuucugugccaggcaaaaguucgcgcgcggggaccagggcugguucuuugaccugugggggcgcgggaccuugaucguggucucgagc

SEQ ID NO: 56763 - RNA, 375 nt, Artificial Sequence
  derived and/or modified sequence opt11 from anti-HIV-1_HeavyChain
aggcauacgguggagcagagcgggagcggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccgaacuuuaggcauagggugagcuugacaagggacagggacuuguucacggcgcauauggauauaaggggguugacgcagggggauacggcgacguauuucugugcaaggcagaaguucgagaggggggggcaggggugguacuuugacuugugggggagggggacguugauaguggugaguagc

SEQ ID NO: 56764 - RNA, 375 nt, Artificial Sequence
  derived and/or modified sequence opt11 from anti-HIV-1_HeavyChain
caggcgcaccuggagcagagcgggagcggggugaagaagccgggggcgagcgugagggugagcuguuggacgagcgaggacauauucgagaagagugaguugauacauugggugaggcaggcaccggggcagggguuggaguggauagggugggugaagacggugacgggggcggugaauuucgggagcagugacuuuagacagagggugagcuugacgccggacagggacuuguucacggcacauauggauauaaggggguugacgcagggggauacggcgacguauuucugugcgaggcagaaguucuaugcgggggggcaggggugguacuucgacuugugggggagggggacguugauaguggugaguagc

SEQ ID NO: 56765 - RNA, 375 nt, Artificial Sequence
  derived and/or modified sequence opt11 from anti-HIV-1_HeavyChain
aggcauacgguggagcagagcgggagcggggugaagaaggugggggcgagcgugagggugagcuguuggacgagcgaggacauauucgagaggacggaguugauacauugggugaggcaggcgccggggcagggguuggaguggauagggugggugaaggcggugaguggggcggugaauuacgggaguuuggacuuuaggcauagggugagcuugacaagggacagggacuuguucacggcgcauauggauauaaggggguugacgcaggacgauacggcgauauauuucugugcgaggcagaaguucgcgaggggggaccaggggugguucuuugacuugugggggagggggacguugauaguggugucgagc

SEQ ID NO: 56766 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguugggcgagcgaggacauauucgagaggacggaguugauacauugggugaggcaggcgccggggcagggguuggaguggauagggugggugaagacggugaguggggcggugaauuucgggagcccgaacuuuagacauagagugagcuugacgagggacagggaccuguucacggcgcauauggauauaaggggguugacgcagggggauacggcgacguauuucugugcgaggcagaaguucgagaggggggggcaggggugguacuuugacuugugggggagggggacguugauaguggugucgagc

SEQ ID NO: 56767 - RNA, 375 nt, Artificial Sequence
  derived and/or modified sequence opt11 from anti-HIV-1_HeavyChain
aggcacacgugggagcaaguguggucgggcgugaaaaagcccggggccucggucagggucucgugcuggaccucggaagauaucuuugaaaggaccgagcucauacacugggucaggcaagcgcccgggcaagggcucgaguggauaggcugggucaagacagugaccggggccgugaacuuuggcucgcccaauuucaggcacagggucucgcucacgcgcgaucgcgaucucuuuaccgcgcacauggacauacgcgggcuaacgcaaggggacacggccacguacuuuugcgcgcgccagaaauuugaaaggggcgggcaagggugguauuucgaucucuggggcaggggcacgcucauagucgugagcucg

SEQ ID NO: 56768 - RNA, 375 nt, Artificial Sequence
  derived and/or modified sequence opt11 from anti-HIV-1_HeavyChain
aggcacacguggaggcaaucgggcucgggagugaaaaagcucggggccucggucagggucucgugcuggaccucggaagauaucuuugaaaggaccgagcucauacacugggucaggcaagcgcccgggcaagggcucgaguggauaggcugggucaaggccgugagcggggucgugaacuauggcucgcucgauuucaggcacagggucucgcuaacgcgcgaucgagaucucucgaccgcgcacauggacauacgcgggcucacgcaagaugacacggccacguacuuuugcgcgcgccagaaauuugccaggggagaucaagggugguuuuucgaucucuggggcaggggcacgcucauagucgugaguucg

SEQ ID NO: 56769 - RNA, 375 nt, Artificial Sequence
  derived and/or modified sequence opt11 from anti-HIV-1_HeavyChain
caggcgcacuuggagcagagcgggaguggggugaagaagccgggggcgagcgugagggugagcuguuggacaagcggggacauauucgagaggacggaguugauacauugggugaggcaggcgccggggcagggguuggaguggauagggugggugaagauagugucgggggcggugaauuucgggaguccgaacuuuaggcagagggugagcuugacgagggacagggacuuguucacggcgcauauggauauaaggggguugacgcagggggauacagcgacguauuucugugcgaggcagaaguucgagaggggggggcagggguggauauuugacuugugggggagggggacauugauagcggugaguagc

SEQ ID NO: 56770 - RNA, 375 nt, Artificial Sequence
  derived and/or modified sequence opt11 from anti-HIV-1_HeavyChain
aggcacacggucgagcaaucgggcucgggcgugaaaaagcccggggccucggucagggucucgugcuggacaucggaagauaucuuugaaaagagcgagcucauacacugggucaggcaagcgcccgggcaagggcucgaguggauaggcugggucaagaccgugaccggggccgugaacuuuggcucgagcgauuucagacaaaggguaucgcucacgagagaucgagaucucuuuaccgcgcacauggacauacgcgggcuaacgcaaggggacacggccacguacuuuugcgcgcgccagaaauuuuacgcgggcgggcaagggugguauuucgaucucuggggcaggggcacgcucauagucgugagcucg

SEQ ID NO: 56771 - RNA, 375 nt, Artificial Sequence
  derived and/or modified sequence opt11 from anti-HIV-1_HeavyChain
caggcgcaccuggagcagagcgggagcggggugaagaagaggugggcgagcgugagggugagcuguuggacgagcgaggacauauucgagaggacggaguugauacauugggugaggcaggcgccggggcagggguuggaguggauagggugggugaaggcggugucgggggcggugaauuacgggagcuuggacuuuaggcauagggugagcuugacgagggacagggacuuguucacggcgcauauggauauaaggggguugacgcaggacgauacggcgacguauuucugugcgaggcagaaguucgcgaggggggaccaggggugguucuuugacuugugggggagggggacguugauaguggugaguagc

SEQ ID NO: 56772 - RNA, 375 nt, Artificial Sequence
  derived and/or modified sequence opt11 from anti-HIV-1_HeavyChain
agacauacgguggagcagagcgggagcggggugaagaggccgggggcgagcgugagggugagcuguuggacgagcgaggacauauucgagacgacggaguugauacauugggugaggcaggcgccggggcagggguuggaguggauagggugggugaagacggugacgggggcggugaauuucgggagcagcgacuuuaggcagagggugagcuugacgagggacagggacuuguucacagcgcauauggauauaaggggguugacgcagggggauacggcgacguauuucugugcgaggcagaaguucuaugcgggggggcaggggugguacuuugacuugugggggagggggacguugauaguggugaguagc

SEQ ID NO: 56773 - RNA, 375 nt, Artificial Sequence
  derived and/or modified sequence opt11 from anti-HIV-1_HeavyChain
caggcgcacuuggagcagagcgggagcggggugaagaaauugggggcgagcgugagggugagcuguuggacgagcgaggacauauucgagaggacggaguugauacauugggugaggcaggcgccgggacagggguuggaguggauagggugggugaaggcggugaguggggcggugaauuacgggagcuuggacuuuaggcauagggugagccugacgagggacagggggcuguucacggcgcauauggauauaaggggguugacgcaggacgauacggcgacauauuucugugcgaggcagaaguucgcgagaggggaccaggggugguucuuugacuugugggggagggggacguugauaguggugaguagc

SEQ ID NO: 56774 - RNA, 375 nt, Artificial Sequence
  derived and/or modified sequence opt11 from anti-HIV-1_HeavyChain
caggugcacuuggagcagagcgggagcggggugaagaagccgggggcgagcgugagggugagcuguuggacgagcgaggacauauucgagaagagugaguugauacauugggugagacaggcgccggggcagggguuggaguggauagggugggugaagacggugacgggggcggcgaauuucgggagcagugacuuuaggcagagggugagcuugacgccggacagagaccuguucacggcgcauauggauauaaggggguugacgcagggggauacggcgacguauuucugugcgaggcagaaguucuauaagggagggcaggggugguacuuugacuugugggggagggggacguugauaguggugaguagc

SEQ ID NO: 56775 - RNA, 375 nt, Artificial Sequence
  derived and/or modified sequence opt11 from anti-HIV-1_HeavyChain
caggcccaucucgagcaaucgggcgcgggcgugaaaaagcccggggccucggucagggucucgugcuggaccucggaagauaucuuugacacgaccgagcucauacacugggucaggcaagcgcccgggcaagggcucgaguggauaggcugggucaagaucgugagcggggccgugaacuuuggcucgcccaauuucaggcaaagggucucgcucacgcgcgaucgcgaucucuuuacagcgcacauggacauacgcgggcucacgcaaggggacacggcaacguacuuuugcgcgcgccagaaauuugaaaggggcgggcaaggguggauauucgaucucuggggcaggggcacgcucauagccgugaguucg

SEQ ID NO: 56776 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucaugcuggaccucgcgcgauaucuuugaaaggaccgagcucauacacugggucaggcaagcgcccgggcaagggcuagaguggauaggcugggucaaggccgugagcggggccgugaacuauggcucgcucgauuucaggcacagggucucgcucacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56777 - RNA, 375 nt, Artificial Sequence
  derived and/or modified sequence opt11 from anti-HIV-1_HeavyChain
caagcgcacuuggaacagagcgggagcggggucaagaaauugggcgcgagcgugcgcgugagcugucucgcgagcgaggacauauucgagcgcacggaauugauccauugggugcgccaggccccgggccagggcuuggaauggaucgggugggugaaagcggucucgggcgcggucaauuacgggagcuuggacuuucgacaucgcgugagcuugaccagggacagggacuugagcacggcccauauggauaucaggggccugacccaggacgauaccgcgaccuauuucugugccaggcaaaaguucgcgcgcggggaccagggcugguucuuugacuugugggggcgcgggaccuugaucguggucucgagc

SEQ ID NO: 56778 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggccgagcgaggacauauucgagaggacggaguugauacauugggugaggcaggcgccggggcagggguuggaguggauagggugggugaagacggugacggggacggugaauuucgggaguuugaacuuuaggcagagggugagcuugacgagggacagggaccuguucacggcgcauauggauauaaggggguugacgcagggggauacggcgacguauuucugugcgaggcagaaguucgagaggggggggcaggggugguacuuugacuugugggggagggggacguugauaguggugaguagc

SEQ ID NO: 56779 - RNA, 375 nt, Artificial Sequence
  derived and/or modified sequence opt11 from anti-HIV-1_HeavyChain
cgcgcgcacuuggaacagagcgggagugaguggaagaaauugggagcgagcgugcgcgugagcuguuggacgagcggggacauauucgagcgcacggaauugauccauugggugcgacaggccccgggccagggcuuggaauggaucgggugggugaaagcggucucgggcgcggucaauuacgggagcuuggacuuucgccaucgcgugagcuugaccagggacagggacuuguucacggcccauauggauaucaggggcuugacccaggacgauaccgcgaccuauuucugugccaggcaaaaguucgcgcgaggggaccagggcugguucuuugacuugugggggcgcgggaccuugaucguggucucgagc

SEQ ID NO: 56780 - RNA, 375 nt, Artificial Sequence
  derived and/or modified sequence opt11 from anti-HIV-1_HeavyChain
aggcacacgguagagcaaucgggcucgggcgugaaaaagcucggggccucggucaaugucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucuuuaccgcgcacauggacauacgcgggcucacgcaagaugacacggccacguacuuuugcgcgcgccagaaauuugccaggggcgaucaagggugguuuuucgaucucuggggaaggggcacgcucauagucgugagcucg

SEQ ID NO: 56781 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagcccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56782 - RNA, 375 nt, Artificial Sequence
  derived and/or modified sequence opt11 from anti-HIV-1_HeavyChain
aggcauacguggaacaagagcgggagcggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccgaacuuuagacauagggugagcuugacgagggacagggacuuguucacggcgcauauggauauaaggggguugacgcagggggauacggcgacguauuucugugcgaggcagaaguucgagaggggagggcaggggugguacuuugacuugugggggagggggacguugauaguggugaguagc

SEQ ID NO: 56783 - RNA, 375 nt, Artificial Sequence
  derived and/or modified sequence opt11 from anti-HIV-1_HeavyChain
caggcccauagcgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaucgugagcggggccgugaacuuuggcucgcccaauuucaggcaaagggucucgcucacgcgagaucgcgaucucuuuaccgcgcacauggacauacgcgggcucacgcaaggggacacggccacguacuuuugcgcgcgccagaaauuugaaaggggcgggcaaggguggauauucgaccucuggggcaggggcacgcucauagccgugagcucg

SEQ ID NO: 56784 - RNA, 375 nt, Artificial Sequence
  derived and/or modified sequence opt11 from anti-HIV-1_HeavyChain
caagcgcacuuggaacagagcggggccggggucaagcgcccgggcgcgagcgugcgcgugagcuguuggacgagcgaggacauauucgagaccacggaauugauccauugggugcgccaggccccgggccagggcuuggaauggaucgggugggugaaaacggucacgggcgcggucaauuucgggagcccgaacuuucgccaucgcgugagcuugaccagggacagggaccuguucacggcccauauggauaucaggggcuugacccagggcgauaccgcgaccuauuucugugccaggcaaaaguucgagcgcgggggccagggcugguacuuugacuugugggggcgcgggaccuugaucguggucucaagc

SEQ ID NO: 56785 - RNA, 375 nt, Artificial Sequence
  derived and/or modified sequence opt11 from anti-HIV-1_HeavyChain
gggcacacgugggagcaaucaggagcgggcgugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucuuuaccgcgcacauggacauacgcgggcucacgcaagaugacacggccauauacuuuugcgcgcgccagaaauuugccaggggcgaucaagggugguuuuucgaucucuggggcaggggcacgcucauagucgugagcucg

SEQ ID NO: 56786 - RNA, 375 nt, Artificial Sequence
  derived and/or modified sequence opt11 from anti-HIV-1_HeavyChain
gggacgccggggagcgagagcgggagcggggugaagaaguugggggcgagcgugagggugagcuguuggacgagcgaggacauauucgagaggacggaguugauacauugggugaggcaggcgccggggcagggguuggaguggauagggugggugaaggcggugaguggggcggugaauuacgggagcuuggacuuuaggcauagggugagcuugacgagggacagggacuugagcacggcgcauauggauauaaggggguugacgcaggacgauacggcgacguauuucugugcgaggcagaaguucgcgagaggggaccaggggugguucuuugacuugugggggagggggacguugauaguggugaguagc

SEQ ID NO: 56787 - RNA, 375 nt, Artificial Sequence
  derived and/or modified sequence opt11 from anti-HIV-1_HeavyChain
ggcacgccagggagcgagagcgggagcggggucaagaugccgggcgcgagcgugcgcgugagcuguuggacgagcgaggacauauucgagcgcacggaauugauccauugggugcgccaggccccgggccagggcuuggaauggaucgggugggugaaaacggucucgggcgcggucaauuucgggagcccgaacuuucgccaucgcgugagcuugaccagggacagggacuuauucacggcccauauggauaucaggggcuugacccagggcgauaccgcgaccuauuucugugccaggcaaaaguucgagcgcgggggccagggcugguacuuugacuugugggggcgagggaccuugauaguggucucgagc

SEQ ID NO: 56788 - RNA, 375 nt, Artificial Sequence
  derived and/or modified sequence opt11 from anti-HIV-1_HeavyChain
aggcacacgugggagcaaucgggcgcgggcgugaaaaagcccggggccucggucagggucucgugcuggaccucagaagauaucuuugaaaggacagagcuaauacacugggucaggcaagcgcccgggcaagggcuagaguggauaggcuggguaaagaccgugagcggggcagugaacuuuggcucgcccaauuucaggcacagggucucgcucacgcgcgaucgcgaucucuuuaccgcgcacauggacauacgcgggcucacgcaaggggacacagccacguacuuuugcgcgcgccagaaauuugaaaggggcgggcaagggugguauuucgaucucuggggcaggggcacgcucauagucgugagcucg

SEQ ID NO: 56789 - RNA, 375 nt, Artificial Sequence
  derived and/or modified sequence opt11 from anti-HIV-1_HeavyChain
gggacaccgggaaauaaaagcggaucaggagugaaaaagccaggggcaucgguaaggguaaguugcuggacaagugaagauauauucgaaaagagcgagcuaauacacuggguaaggcaagcgccagggcaagggcuggaguggauaggauggguaaagacagugacaggggcagugaacuuuggaaguagcgauuucaggcaaagggugucgcugacgagagacagagaucuauuuacagcgcacauggacauaagagggcuaacgcaaggggacacggcaacguacuuuugcgcgagacagaaauuuuacgcgggagggcaagggugguauuucgaucuauggggaaggggaacgcuaauaguagugagcucg

SEQ ID NO: 56790 - RNA, 375 nt, Artificial Sequence
  derived and/or modified sequence opt11 from anti-HIV-1_HeavyChain
caggcgcacuuggagcagagcggggcgggggugaagaagccgggggcgagugugagggugaguuguuggaguagcgaggacauauucgagaggacggaguugauacauugggugaggcaggcgccggggcagggguuggaguggauagggugggugaagacggugacgggggcggugaauuucgggagcccgaacuuuaggcauagggugagcuugacgagggacagggacuuguucacggcgcauauggauauaaggggguugacgcagggggauacggcgacguauuucugugcgaggcagaaguucgagaggggggggcaggggugguacuuugacuugugggggagggggacguugauaguggugaguagc

SEQ ID NO: 56791 - RNA, 375 nt, Artificial Sequence
  derived and/or modified sequence opt11 from anti-HIV-1_HeavyChain
gggacgccggggaacaagagcgggagcggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccgaacuuuaggcauagagugagcuugacgagggacagggacuuguucacggcgcauauggauauaagggggcugacgcagggggauacggcgacguauuucugugcgaggcagaaguucgagaggggggggcagggguggauauuugacuugugggggagggggacguugauagcggugaguagc

SEQ ID NO: 56792 - RNA, 375 nt, Artificial Sequence
  derived and/or modified sequence opt11 from anti-HIV-1_HeavyChain
gggaccccgggcaauaaaucgggcucgggagugaaaaagcccggggccucggucagggucucgugcuggagcucggaagauaucuuugaaaggaccgagcuaauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuugaaaggggcgggcaaggguggauauucgaucucuggggaaggggcacgcucauagccgugagcucg

SEQ ID NO: 56793 - RNA, 375 nt, Artificial Sequence
  derived and/or modified sequence opt11 from anti-HIV-1_HeavyChain
caagcgcacuuggagcagagcgcgagcggggugaagaggccgggggggugggugagggugagcuguuggacgagcgaggacauauucgagaggagugaguugauauauugggugaggcaggcgccggggcagggguuggaguggauagggugggugaagacgguaacgggggcggugaauuucgggagcccgaacuuuaggcauagggugagcuugacgagggacagggaccuguucacggcgcauauggauauaaggggguugacgcagggggauacggcgacguauuucugugcgaggcagaaguucgagaggggggggcaggggugguacuuugacuugugggggagggggacguugauaguggugaguagc

SEQ ID NO: 56794 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagagaacggaguugauacauugggugaggcaggcgccggggcagggguuggaguggauagggugggugaagacgagcaguggggcgguaaauuucgggagcccgaacuuuaggacgagggugagcuugacgagggacagggacuuguucacggcgcauauggauauaaggggguugacgcagggggauacggcgacauauuucugugcgaggcagaaguucgagaggggggggcaggggugguacuuugacuugugggggagggggacguugauaguggugaguagc

SEQ ID NO: 56795 - RNA, 375 nt, Artificial Sequence
  derived and/or modified sequence opt11 from anti-HIV-1_HeavyChain
caggcgcacuuggagcagagcggggcgggggugaagaagccgggggcgagugugagggugagcuguuggacgagcgaggacauauucgagaggacggaguugauacauugggugaggcaggcgccggggcagggguuggaguggauagggugggugaagacggugaguggggcggugaauuucgggagcccgaacuuuaggcauagggugagcuugacgagggacagggacuuguucacggcgcauauggauauaagggggcugacgcagggggauacggcgacguauuucugugcgagacagaaguucgagaggggggggcaggggugguacuuugacuugugggggagggggacguugauaguggugaguagc

SEQ ID NO: 56796 - RNA, 375 nt, Artificial Sequence
  derived and/or modified sequence opt11 from anti-HIV-1_HeavyChain
aggcauacgugggagcagagcgggagcggggugaagaagccgggggcgagcgugagggugaguuguuggacgagcgaggacauauucgagaggacggaguugauacauugggugaggcaggcgccggggcagggguuggaguggauagggugggugaagacggugacgggggcggugaauuucgggagcccgaacuuuaggcauagggugagccugacgagggacagggacuuguucacggcgcauauggauauaaggggguugacgcagggggauacggcgacguauuucugugcgaggcagaaguucgagaggggggggcaggggugguacuuugacuugugggggagggggacguugauaguggugaguagc

SEQ ID NO: 56797 - RNA, 375 nt, Artificial Sequence
  derived and/or modified sequence opt11 from anti-HIV-1_HeavyChain
gggacgacguggaacaagagcgggagcggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccgaacuuuaggcauagggugagcuugacgagggacagggacuuguucacggcgcauauggacauaaggggguugacgcagggggauacggcgacguauuucugugcgaggcagaaguucgagaggggggggcaggggugguacuuugacuugugggggagggggacguugauaguggugaguagc

SEQ ID NO: 56798 - RNA, 375 nt, Artificial Sequence
  derived and/or modified sequence opt11 from anti-HIV-1_HeavyChain
aggcacacguggaaugaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucg

SEQ ID NO: 56799 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucgggcaauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucuaucgacagcgcacauggacauacgcgggcucacgcaagaugacacggccacguacuuuugcgcgcgccagaaauuugccaggggcgaucaagggugguuuuucgaucucuggggcaggggaacgcucauagucgugagcucg

SEQ ID NO: 56800 - RNA, 378 nt, Artificial Sequence
  derived and/or modified sequence opt11 from anti-HIV-1_HeavyChain
aggugcucgauggagcaaccgggcuggagcgagaaaccgggcgcgagcgugaccuugagcuguaaaacggccgaugaagaugucuuugacgcggccuauaugcauugggugcgccaggccccgggccagaccuuugaauggcucggguggaugaaaccggucacgggcgcggucucguacgcgcgcaaguuccagggcagggucucguucuauaugacgcgcgagcuagggauggcguacauggacuugcgcaaucucagguucgaugacacggccguguacuuuugcgcgcgcaagaccgcgggcgauguaucgggcgauaacaggggcuauuucuuugacuugugggggcgagggagcagggucauagucucgagc

SEQ ID NO: 56801 - RNA, 375 nt, Artificial Sequence
  derived and/or modified sequence opt11 from anti-HIV-1_HeavyChain
aggcacacgagcgagcaaucgggcucgggcgugaaaaagcccggggccucggucagggucucgugcuggaccucggaagauaucuuugaaaggagcgagcucauacacugggucaggcaagcgcccgggcaagggcucgaguggauaggcugggucaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgccagaaauauuacgcgggcgggcaagggugguauuucgaucuauggggcaggggcacgcucauagucgugagcucg

SEQ ID NO: 56802 - RNA, 375 nt, Artificial Sequence
  derived and/or modified sequence opt11 from anti-HIV-1_HeavyChain
aggcacacggucgagcaaucgggcgcgggagugaaaaagcccggggccucgguaagggucucgugcuggacaucggaagacaucuuugaaaggaccgagcuaauacacugggucaggcaagcgcccgggcaagggcuagaguggauaggcugggucaagacagugagcggggccgugaacuuuggaagcccaaauuucaggcacagggucucgcucacgcgagaucgagaucuauuuacagcgcacauggacauacgcgggcucacgcaaggggacacggcaacguacuuuugcgcgagacagaaauucgaaaggggcgggcaagggugguauuucgaucucuggggaaggggaacgcuaauagucgugagcucg

SEQ ID NO: 56803 - RNA, 375 nt, Artificial Sequence
  derived and/or modified sequence opt11 from anti-HIV-1_HeavyChain
gggacgccguggaacgagagcgggagcggggugaagaagccgggggcgagcgugagggugagcuguuggacgagcgaggacauauucgagaagagugaguugauacauugggugaggcaggcgccggggcagggguuggaguggauagggugggugaagacggugacgggggcggugaauuucgggagcccgaacuuuaggcauagagugagcuugacgagggacagggacuuguucacggcgcauauggauauaaggggguugacgcagggggauacggcgacguauuucugugcgaggcagaaguucgagaggggagggcaggggugguacuuugacuugugggggagggggacguugauaguggugaguagc

SEQ ID NO: 56804 - RNA, 375 nt, Artificial Sequence
  derived and/or modified sequence opt11 from anti-HIV-1_HeavyChain
aggcacgaucucgagcccucgggcucgggcgugaaaaagcccggggccucggucagggucucgugcuggaccucggaagauaucuuugaaaggaccgagcucauacacugggucaggcaagcgcccgggcaagggcucgaguggauuggcugggucaagaccgugaccggggccgugaacuuuggcucgcucgauuucaggcacagaaucucgcucacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucgug

SEQ ID NO: 56805 - RNA, 375 nt, Artificial Sequence
  derived and/or modified sequence opt11 from anti-HIV-1_HeavyChain
aggcacacggucgagcaaucgggcucgggcgugaaaaagcucggggccucggucagggucucgugcuuggccucggaagauaucuuugaaaggaccgagcuaauacacugggucaggcaagcgcccgggcaagggcucgaguggauaggcugggucaaggccgugagcggggccgugaacuauggcucacucgacuucaggcacagggucucgcucacgcgagaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56806 - RNA, 375 nt, Artificial Sequence
  derived and/or modified sequence opt11 from anti-HIV-1_HeavyChain
caagcgcacuuggaacagagcgggagcgagagcaagaaaccgggcgcgagcgugcgcgugagcuguuggacgagcgaggacauauucgagaaaucggaauuaauccauugggugcgccaggccccgggccagggcuuggaauggaucgggugggugaaaacggucacgggcgcggucaauuucgggagcucggacuuucgccagcgcgugagcuugaccagggacagggaccuguucacggcccauauggacaucagaggcuugacccagggcgauaccgcgaccuauuucugugccaggcaaaaguucuacgccgggggccagggcugguacuuugaccugugggggcgcgggacccugaucguggucucgagc

SEQ ID NO: 56807 - RNA, 375 nt, Artificial Sequence
  derived and/or modified sequence opt11 from anti-HIV-1_HeavyChain
gggacgccggggagcgagagugcgagcggggugaggaggccgggggcgagcgugagggugagcuguuggacgagcgaggauauauucgagaggagugaguugauauauugggugaggcaggcgccggggaggggguuggaguggauaggguggauaaagcuggugaguggggcggugaauuuugggagcguggacuuuagggauagggugaguuugacgagggacagggacuuguuuacggcgcauauggauauaaggggguugacgcagggggauacggcgacguauuucugugcgaggcagaaguuugagaggggggggcaggggugguauuuugacuugugggggagggggacguugauaguggugaguagu

SEQ ID NO: 56808 - RNA, 375 nt, Artificial Sequence
  derived and/or modified sequence opt11 from anti-HIV-1_HeavyChain
caggugcauuuggagcagagcgggagcggggugaagaagccgggggcgagcgugagggugagcuguuggacgagugaggauauauucgagaagagugaguugauacagugggugaggcaggcgccggggcagggguuggaguggauagggugggugaagacggugacgggggcggugaauuucgggagcagugacuuuaggcagagggugaguuugacgagggacagggacuuguuuacggcgcauauggauauaaggggguugacgcagggggacacggcgacguauuucugugcgaggcagaaguucuaugcgggggggcaggggugguauuuugacuugugggggagggggacguugauaguggugaguagc

SEQ ID NO: 56809 - RNA, 375 nt, Artificial Sequence
  derived and/or modified sequence opt11 from anti-HIV-1_HeavyChain
gggacgccggggagcgagagcgggaguggggugaagaaggugggggcgagcgugagggugagcuguuggacgagcgaggacauauucgagaggacggaguugauacauugggugaggcaggcgccggggcagggguuggaguggauagggugggugaaagcggugucgggggcggugaauuacgggagcuuggacuuuaggcauagggugagcuugacgagggacagggacuuguucacggcgaggauggauauaaggggguugacgcaggacgauacggcgauauauuucugugcgaggcagaaguucgcgaggggggaccaggggugguucuuugacuugugggggagggggacgcugauaguggugaguagc

SEQ ID NO: 56810 - RNA, 375 nt, Artificial Sequence
  derived and/or modified sequence opt11 from anti-HIV-1_HeavyChain
gggaccccgggcucggaaucgggcucgggcgugaaaaggcccggggccucggucagggucucgugcuggaccucggaagauaucuuugaaacgaccgagcuaauacacugggucaggcaagcgcccgggcaagggcucgaguggauaggcuggguaaagaccgugagcggggcagugaacuuuggcucgcucaauuucaggcacagggucucgcucacgcgcgaucgcgaucuaucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 56811 - RNA, 372 nt, Artificial Sequence
  derived and/or modified sequence opt11 from anti-HIV-1_HeavyChain
cgcgcgcaccuggaacagagcggggccggggucaagaaaccgggcgggugggugcgcgugagcuguuggacgagcgaggacauauucaagaccgagcucauacacugggucaggcaagcgcccgggcaagggcucgaguggauaggcuggguaaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgccagaaauuugaaaggggcgggcaagggugguauuucgaucucuggggcaggggcacgcucauagucgugagcucg

SEQ ID NO: 56812 - RNA, 378 nt, Artificial Sequence
  derived and/or modified sequence opt11 from anti-HIV-1_HeavyChain
caaguccaacucaugcaauccggcgcagaagucaaacgccccggcgccuccgucaaaaucucaugcaccgccuccggcuucacccucaccgaccacuacaugcacuggguccgccaagccccaggccaaaccuucgaauggcucggcuggaugaaacccgucaccggcgccgucaacuacgcccgcaaauuccaaggccgcgucuccuucuaccgcacccgcgaacucggcaucgcauacauggaccuccgaaaccuccgcuucgacgacaccgccgucuacuucugcgcccgcaaaaccgccggcgacgucuccggcgacaaacgcggcuucuucuucgaccuauggggccgcggcucccgcgucaucgucucaucc

SEQ ID NO: 56813 - RNA, 378 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacaauuucacgggcuauuacuugcacugggucaggcaagcgcccgggcaaacguucgagugguugggcuggaugaagcccgugaccggggccgugagcuaugccaggaaauuucaagggcgcgugagcuuuuacaugaccagggaauugggcauggccuauauggaucucaggaacuugcgcuuugacgauaccgcggucuauuucugugccaggaaaacggccggggacgugagcggggacaaucgcggguacuuuuucgaucucuggggcaggggcucgcgcgugaucgugagcucg

SEQ ID NO: 56814 - RNA, 375 nt, Artificial Sequence
  derived and/or modified sequence opt11 from anti-HIV-1_HeavyChain
gggacgccggggagcaagagcgggagcggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccgaacuuuagacauagggugagcuugacgagggacagggacuuguucacggcgcauauggauauaaggggguugacacagggggauacggcgacguauuucugugcgaggcagaaguucgagaggggagggcaggggugguacuuugacuugugggggagggggacguugauaguggugaguagc

SEQ ID NO: 56815 - RNA, 378 nt, Artificial Sequence
  derived and/or modified sequence opt11 from anti-HIV-1_HeavyChain
caagugcaauugguccagagcggggcagagcucaagaaaccgggcgcgagcgugaaagugagcugugaagcgagcggguacucguucacggaccaucacauacacugggucaggcaagcgcccgggcaagggcucgaguggcugggcuggaugaaucccaauaacggggacacggccuaugcccagaccuuucucgggcgcgugaccaugaccagggacacgagcauaaacacggccuauauggagcucucgcgcuugaccucggacgauaccgcggucuauuucugugccaggaaaacggccggggacgugagcggagacaagcgaggguucuuuuucgaucucuggggaaggggcucgcgagugaucgugagcucg

SEQ ID NO: 56816 - RNA, 378 nt, Artificial Sequence
  derived and/or modified sequence opt11 from anti-HIV-1_HeavyChain
caaguguacaugagcucgcgagggggcaugaaaaagcccggggccucgaugacggucucgugcaagaccgcggacgaggacauauucgaugccgcguacaugcacugggucaggcaagcgccagggcaaacguucgaguggcugggcuggaugaagcccgugaccggggccgugaacuaugccaggcaauuucaagggcgcgugagcuuuuacaggaccagggaauugggcauagccuauauggaucucagggacuugaaauuugacgauacagcggucuauuucugugccaggaaaacgaaaggggacgugagcggggacgaucgcggguucuuuuucgaucucuggggcaggggcacgcgcgugaucgugagcucg

SEQ ID NO: 56817 - RNA, 378 nt, Artificial Sequence
  derived and/or modified sequence opt11 from anti-HIV-1_HeavyChain
caagugcaacugguccagagcggggccgaggucaagaaaccgggcgcgagcgugaaagugaguuguaaagcgagcggguacacguucacggccuauuacaugcacuggcucaggcaagcgcccgggcaagggcucgaguggaugggcuggaucaauccccauagcgggggcacgaacuuugcccagaaauuucaagggcgcgugaccaugaccagggacacgagcauaaccacggccuauauggagcucucgcgcuugcgcucggacgauaccgcgaccuauuucugugccaggcaaaaguucgcgagcagguacucgggcgaucaagggagcuauuucgaucucuggggcaggggcacgcucauagucgugagcuca

SEQ ID NO: 56818 - RNA, 375 nt, Artificial Sequence
  derived and/or modified sequence opt11 from anti-HIV-1_HeavyChain
agggcgcacuuggagcagagcggggcgggggugaagaagcugggggcgagcgugagggugagcuguuggacgagcgaggacauauucgagaggacggaguugauacauugggugaggcaggcgccggggcagggguuggaguggauagggugggugaaggcggugaguggggcggugaauuacgggagcuuggacuuuaggcauagggugagcuugacgagggacagggacuuguucacggcgcauauggauauaaggggguugacgcaggacgauacggcgacguauuucugugcgaggcagaaguucgcgagaggggaccaggggugguucuuugacuugugggggagggggacguugauaguggugaguagc

SEQ ID NO: 56819 - RNA, 378 nt, Artificial Sequence
  derived and/or modified sequence opt11 from anti-HIV-1_HeavyChain
caagugcgauugguccagagcggggccgaugucaagcaaccgggcgcgagcgugaaagugagcuguaaagcgagcggguacacguucacggacuauuacaugcacugggucaggcaagcgcccgggcaaacguucgagugguugggcuggaugaagcccgugaccggggccgugagcuaugccagaaaauuucaagggcgcgugagcuuuuacaugaccagggaauugggaauggccuauauggaucucaggaacuugcgcuuugacgauaccgcggucuauuucugugccaggaaaacggccggggacgugagcggggacaaucgcggguacuuuuucgaucucuggggcaggggcucgcgagugaucgugagcucg

SEQ ID NO: 56820 - RNA, 378 nt, Artificial Sequence
  derived and/or modified sequence opt11 from anti-HIV-1_HeavyChain
caagcgcacuugggcaauaaaucgggcucgggcgugaaaaagccaggggcaucggucagggucucgugcuggacaucggaagauaucuuugaaaagagcgagcuaauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcuaacgcaaggggacacggccacguacuuuugcgcgcgccagaaauuuuacgcgggcgggcaagggugguauuucgaucucuggggaaggggcacgcucauagucgugagcucg

SEQ ID NO: 56821 - RNA, 381 nt, Artificial Sequence
  derived and/or modified sequence opt11 from anti-HIV-1_HeavyChain
cagguguauauggagcagaguggggggggggugaagaagccgggggcgagcgugacguugaguuguaagacggcggaugaggauguguuugaugcggcguauaugcauugggugaggcaggcgccggggcagacguuugagugguugggguggaugaagccggugacgggagcggugaauuaugcgaggaaguuucaggggagggugaguuuuuauaggacgagggaguuggggauagcguauauggauuugaggaauuugagguuugaugauacggcgguguauuuuuguacgaggaagacggcgggggaugugaguggggauaagaggggguuuuuuuuugauuugugggggagggggaguagggugauagugaguagu

SEQ ID NO: 56822 - RNA, 381 nt, Artificial Sequence
  derived and/or modified sequence opt11 from anti-HIV-1_HeavyChain
cagguguauguggagcagccgggggggggggugaagaagccgggggcgagugugacguugaguuguaagacggcggaugaggauguguuugaugcgacguauaugcauugggugaggcaggcgccggggcagacguuugaguggcugggguggaugaagccggugacgggggcggugaauuaugcgaggaaguuucaggggagggugaguuuuuauaggacgagggaguuggggauagcguauauggaucugaggaauuugagguuugaugauacggcgguguauuuuugugcgaggaagacggcgggggaugugaguggggauaagaggggguuuuuuuuugauuuguggggaagggggaguagggugauagugaguagu

SEQ ID NO: 56823 - RNA, 381 nt, Artificial Sequence
  derived and/or modified sequence opt11 from anti-HIV-1_HeavyChain
caggucuauauggagcaagcgggcguggaaguggaaaagcccggggcaucggucacacucucgugcaagacagcggacgaggacguguucgaugccgcguacaugcacugggucaggcaagcgcccgggcaaacguucgagugguugggcuggaugaagcccgugaccggggccgugagcuaugccaggaaauuucaagggcgagugagcuuuuacaugaccagggaauugggcauggccuauauggaucucagaaacuugcgcuuugacgauaccgcggucuauuucugugccaggaaaacggccggggacgugagcggggacaauagaggguacuuuuucgaucuauggggcaggggcucgcgcgugaucgugagcucg

SEQ ID NO: 56824 - RNA, 381 nt, Artificial Sequence
  derived and/or modified sequence opt11 from anti-HIV-1_HeavyChain
caggucuauauggagcaagcgggcgcgggcgugaaaaagcccggggccucggucacgcucucgugcaagaccgcggacgaggacguguucgaugccgcguacaugcacugggucaggcaagcgccagggcaaacguucgagugguugggcuggaugaagcccgugaccggggccgugagcuaugccaggaaauuucaagggcgcgugagcuuuuacaugaccagggaauugggcauggccuauauggaucucaggaacuugcgauuugacgauaccgcggucuauuucugugccaggaaaacggccggggacgugagcggggacaaucgcggguacuuuuucgaucucuggggcaggggcucgcgcgugaucgugagcucg

SEQ ID NO: 56825 - RNA, 381 nt, Artificial Sequence
  derived and/or modified sequence opt11 from anti-HIV-1_HeavyChain
caggugcauauggagcaggcgggggcgggggugaagaagccgggggcgagugugacguugaguuguaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggauuugaggaauuugagguuugaugauacggcgguguauuuuugugcgaggaagacggcgggggaugugaguggggauaagaggggguuuuuuuuugauuugugggggagggggaguagggugauagugaguagu

SEQ ID NO: 56826 - RNA, 381 nt, Artificial Sequence
  derived and/or modified sequence opt11 from anti-HIV-1_HeavyChain
cagguguauauggagcaggcgggggcggaggugaagaagccgggggcgagugugacguugaguugugagacggcggaugaggauguguuugaugcggcguauaugcauugggugagacaggcgccggggcagacguuugagugguugggguggaugaagccggugacgggggcggugaauuaugcgaggaaguuucaggggagggugaguuuuuauaggacgagggaguuggggauagcguauauggauuugaggaaucugagguuugaugauacagcgguguauuuuugugcgagaaagacggcgggggauguaaguggggauaagaggggguuuuuuuuugauuugugggggagggggaguagggugauagugaguagc

SEQ ID NO: 56827 - RNA, 381 nt, Artificial Sequence
  derived and/or modified sequence opt11 from anti-HIV-1_HeavyChain
caaguguacauggaacagcccgggggcggggucaagaaaccgggcgcgagcgugacauugagcuguaaaacggccgaugaagaugucuuugacgcggccuauaugcauugggugcgacaggccccgggccagaccuuugaauggcucggguggaugaaaccggucacgggcgcggucaauuacgcgcgcaaguuccagggcagggucucguucuaucgcacgcgcgagcucgggaucgcguacauggaccugcgcaaucucagguucgaugacacggccguguacuuuugcgcgcgcaagaccgcgggcgaugucucgggcgauaaaaggggcuuuuucuuugacuugugggggcgcgggagcagggucauagucucgagc

SEQ ID NO: 56828 - RNA, 372 nt, Artificial Sequence
  derived and/or modified sequence opt11 from anti-HIV-1_HeavyChain
gccacgcccuggaacaagagcgggagcggggucaagaaaccgggagcgagcgugcgcgugagcuguuggacgagcgaggacauauucgagcgcacggaauugagcuuggucaggcaagcgcccgggcaagggcucgaguggauaggcuggaugaaaaccgugaccggggccgugaacuuuggcucgcccaauuucaggcacggggucucgcucacgcgcgaucgcgaucucuuuaccgcgcacauggacauacgagggcucacgcaaggggacacggccacguacuuuugcgcgcgccagaaauuugaaaggggcgggcaagggugguauuucgaucucuggggcaggggcacgcucauagucgugagcucg

SEQ ID NO: 56829 - RNA, 381 nt, Artificial Sequence
  derived and/or modified sequence opt11 from anti-HIV-1_HeavyChain
caggucuauauggagcaagcgggcgcgggcaugaaaaagcccggggccucgaugacggcaucgugcaagacagcggacgaggacauauucgaugccgcguacaugcacugggucaggcaagcgcccgggcaaacguucgagugguugggcuggaugaagcccgugaccggggccgugaacuaugccaggcaauuucaagggcgcgugagcuuuuacaggaccagggaauugggcauagccuauauggaucucagggacuugaaauuugacgauacagcggucuauuucugugccaggaaaacgaaaggggacgugagcggggacgaucgcggguucuuuuucgaucuauggggcaggggcacgcgcgugaucgugagcucg

SEQ ID NO: 56830 - RNA, 378 nt, Artificial Sequence
  derived and/or modified sequence opt11 from anti-HIV-1_HeavyChain
cagguccagcucgugcaaucgggcgcggaagugaaaaagcccggggccucggucaaggucucgugcaaggccucgggcuauaccuuuaccggguacuauaugcauugggugcgccaggccccgggacagaccuuugaauggcucggguggaugaaaccggucacgggcgcggucaauuacgcgcgccaguuccagggcagggucucguucuaucgcacgcgcgagcucgggaucgcguacauggaccugcgcgaucuaaaguucgaugacacggccguguacuuuugcgcgcgcaagaccaaggccgaugucucgggcgaugacaggggcuuuuucuucgacuugugggggcgcgggaccagggucauagucucgagc

SEQ ID NO: 56831 - RNA, 381 nt, Artificial Sequence
  derived and/or modified sequence opt11 from anti-HIV-1_HeavyChain
agggucuauauggagcaagcgggcgcgggagugaaaaagcccggggccucggucacgcucucgugcaagaccgcggacgaggacguguucgaugccgcguacaugcacugggucaggcaagcgcccgggcaaacguucgaguggcugggcuggaugaagcccgugaccggggccgugagcuaugccaggaaauuucaagggcgcgugagcuuuaccaugaccagggaauugggcauggccuauauggaucucaggaacuugcgcuuugacgauaccgcggucuauuucugugccaggaaaacggccggggacgugagcggggacaaucgcggguacuuuuucgaucucuggggcaggggaucgcgcgugaucgugagcucg

SEQ ID NO: 56832 - RNA, 381 nt, Artificial Sequence
  derived and/or modified sequence opt11 from anti-HIV-1_HeavyChain
cagguguauauggagcagaguggggggggggugaagaagccggggccgaguguaacguugaguuguaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggauuugaggaauuugagguuugaugauacggcgguguauuuuugugcgaggaagacggcgggggaugugaguggggauaagaggggguuuuuuuuugauuuguggggaagggggaguagggugauagugaguagu

SEQ ID NO: 56833 - RNA, 378 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacacguucacgggcuauuacauacacuggaugaggcaagcgcccgggcaagggcucgaguggaugggcuggaucaaucccaauagcggggccgugagcuaugccaggaaauuucaagggcgcgugagcuuucuacaugaccagggcauacgcauggccuauauggaucucaggaacuugcgcuuugacgauaccgcggucuauuucugugccaggaaaacggccggggacgugagcggggacaaucgcggguacuuuuucgaucucuggggcaggggcucgcgcgugaucgugagcucg

SEQ ID NO: 56834 - RNA, 381 nt, Artificial Sequence
  derived and/or modified sequence opt11 from anti-HIV-1_HeavyChain
caggugcauauggagcaggcggggguggagguggagaagccgggggcgagugugacguugaguuguaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggaucugaggaauuugagguuugaugauacggcgguguauuuuugugcgaggaagacggcgggggaugugaguggggauaagaggggguuuuuuuuugauuugugggggagggggagcagggugauagugaguagu

SEQ ID NO: 56835 - RNA, 381 nt, Artificial Sequence
  derived and/or modified sequence opt11 from anti-HIV-1_HeavyChain
cagguauauauggagcaagcgggagcgggggugaaaaagccaggggcaucggcaacgcuaucgugcaagaccgcggacgaggacguguucgaugccgcguacaugcacugggucaggcaagcgccagggcaaacguucgagugguugggcuggaugaagccagugacaggggcagugagcuaugccaggaaauuucaagggagagugagcuuuuacaugacaagggaguugggaauggcauauauggaucucaggaacuugagauuugacgauacggcgguauauuucugugcaaggaaaacggcaggggacgugagcggggacaauagaggguacuuuuucgaucucuggggaaggggcucgagagugauagugagcucg

SEQ ID NO: 56836 - RNA, 375 nt, Artificial Sequence
  derived and/or modified sequence opt11 from anti-HIV-1_HeavyChain
gggcacgaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucuuuaccgcgcacauggacauacgcgggcucacgcaagaugacacggccauauacuuuugcgcgcgccagaaauuugccaggggcgaucaagggugguuuuucgaucuauggggcaggggcacgcuaauagucgugagcucg

SEQ ID NO: 56837 - RNA, 378 nt, Artificial Sequence
  derived and/or modified sequence opt11 from anti-HIV-1_HeavyChain
caagcgcacaggggcacgaucuggggccuggaagugaaaaagcccgggggcugggucagggucucgugcuggaccucggaagauaucuuugaaaggaccgagcuaauacacugggucaggcaagcgcccgggcaagggcuagaguggauaggcuggguaaagaccgugaccggggccgugaacuuuggcucgcccaauuucaggcacagggucucgcuaacgcgcgaucgcgaucuauuuacagcgcacauggacauaagagggcuaacgcaaggggacacggccacguacuuuugcgcgagacagaaauuugaaaggggcgggcaagggugguauuucgaucuauggggcaggggcacgcuaauagucgugagcucg

SEQ ID NO: 56838 - RNA, 381 nt, Artificial Sequence
  derived and/or modified sequence opt11 from anti-HIV-1_HeavyChain
cagguccauauggagcaagcgggcgcgggcguggaaaagcccggggccucggucacgcucucgugcaagaccgcggacgaggacguguucgaugcagcguacaugcacugggucaggcaagcgcccgggcaaacguucgagugguugggcuggaugaagcccgugaccggggccgugagcuaugccaggaaauuucaagggcgcgugagcuuuuacaugacaagggaauugggcauggcauauauggaucucaggaacuugcgcuuugacgauaccgcggucuauuucugugccaggaaaacggcaggggacgugagcggggacaaucgcggguacuuuuucgaucucuggggcaggggcucgcgcgugaucgugagcucg

SEQ ID NO: 56839 - RNA, 381 nt, Artificial Sequence
  derived and/or modified sequence opt11 from anti-HIV-1_HeavyChain
cagguguauauggagcagaguggggggggggugaagaagccgggggcgagugugacacugaguuguaagacggcggacgaggauguguucgaugcagcguauaugcauugggugaggcaggcgccggggcagacguuugagugguugggguggaugaagccggugacgggggcggugaguuaugcgaggaaguuucaggggagagugaguuuuuauaugacgagggagcuggggauggcguauauggauuugaggaaccugagguuugaugauacggcgguguauuuuugugcgaggaagacggcaggggaugugaguggggauaauaggggguauuuuuuugauuugugggggagggggaguagagugauagugaguagc

SEQ ID NO: 56840 - RNA, 381 nt, Artificial Sequence
  derived and/or modified sequence opt11 from anti-HIV-1_HeavyChain
cagguguauauggagcagaguggggggggggugaagaagccgggggcgagugugacguugagcuguaagacggcggaugaggauguguuugaugcggcguauaugcauugggugaggcaggcgccggggcagacguuugagugguugggguggaugaagccggugacgggggcggugaauuaugcgaggaaguuucaggggagggugagcuuuuauaggacgagggaguuggggauagcguauauggauuugaggaauuugagguuugaugauacggcgguguauuuuugugcgaggaagacggcgggggaugugaguggggauaagaggggguuuuuuuuugauuugugggggagggggaguagggugauagugaguagu

SEQ ID NO: 56841 - RNA, 381 nt, Artificial Sequence
  derived and/or modified sequence opt11 from anti-HIV-1_HeavyChain
gagguguauauggagcagagugggggggggguaaagaagccgggggcgagcgugacguugaguuguaagacggcgagugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggagcuggggauagcguauauggauuugaggaaucugagguuugaugauacggcgguguacuuuugugcgaggaagacggcgggggaugugaguggggauaagaggggguuuuuuuuugauuugugggggagggggaguaggguaauagugaguagc

SEQ ID NO: 56842 - RNA, 381 nt, Artificial Sequence
  derived and/or modified sequence opt11 from anti-HIV-1_HeavyChain
cagguccagcuagugcaaucaggcgcggaagugaaaaagcccggggccucggucacgcucucgugcaagaccgcggacgaggacguguucgaugccgcguacaugcacugggucaggcaagcgcccgggcaaacguucgaguggcugggcuggaugaagcccgugaccggggccgugagcuaugccaggaaauuucaagggcgcgugagcuuuuacaugaccagggaauugggcauggccuauauggaucucaggaacuugcgcuuugacgauaccgcggucuauuucugugccaggaaaacggccggggacgugagcggggacaaucgcggguacuuuuucgaucucuggggcaggggcucgcgcgugaucgugagcucg

SEQ ID NO: 56843 - RNA, 381 nt, Artificial Sequence
  derived and/or modified sequence opt11 from anti-HIV-1_HeavyChain
caggucuuuauggagcaaucgggagggggcaugaaaaagcccggggccucgaugacggucucgugcaagacagcggacgaggacguguucgaugcagcguacaugcacuggguaaggcaagcgcccgggcaaacguucgagugguugggcuggaugaagccagugaccggggccgugagcuaugcaaggaaauuucaagggcgcgugagcuuuuacaugaccagggaauugggcauggccuauauggaucuaaggaacuugcgauuugacgauaccgcggucuauuucugugcaaggaaaacggcaggggacgugagcggggacaaucgcggguacuuuuucgaucucuggggcaggggcucgagagugaucgugagcucg

SEQ ID NO: 56844 - RNA, 381 nt, Artificial Sequence
  derived and/or modified sequence opt11 from anti-HIV-1_HeavyChain
cagguguauauggagcaggcggggggggggaugaaaaagccgggggcgaguaugacggugaguuguaagacggcggaugaggacauauucgaugcggcguauaugcauugggugaggcaggcgccggggcagacguuugagugguugggguggaugaagccggugacgggggcggugaauuaugcaaggagguuucaggggagggugagcuuuuacaggacaagggaguuggggauagcauauauggauuugagggauuugaaauuugaugauacggcgguguauuuuugugcgaggaagacgaagggggaugugagcggggacgauaggggguuuuuuuucgauuugugggggagggggacgagagugauagugagcagu

SEQ ID NO: 56845 - RNA, 381 nt, Artificial Sequence
  derived and/or modified sequence opt11 from anti-HIV-1_HeavyChain
cagguguauauggagcaggcgggggcgggggugaagaagccgggggcgagugugacguugagcuguaaggcggcggaugaggauguguuugaugcagcguauaugcauugggugaggcaggcgccggggcagacguuugagugguugggguggaugaagccggugacgggggcggugaguuaugcgaggaaguuucaggggagggugaguuuuuauaugacgagggaguuggggauggcguauauggacuugaggaauuugagguuugaugauacggcgguguauuuuugugcgaggaagacggcgggggaugugaguggggauaauaggggguauuuuuuugauuugugggggagggggaguagggugauagugaguagu

SEQ ID NO: 56846 - RNA, 381 nt, Artificial Sequence
  derived and/or modified sequence opt11 from anti-HIV-1_HeavyChain
caaguguucauggaacaggccggggccgggaugaagaaaccgggcgcgagcaugaccgugagcuguaaaacggccgaugaagauaucuuugacgcggccuauaugcauugggugcgccaggccccaggccagaccuuugaauggcucggguggaugaaaccggucacgggcgcggucaauuacgcgcgccaguuccagggcaggguaucguucuaucgcacgcgcgagcucgggauagcguacauggacuugcgcgaucucaaguucgacgacacggccguguacuuuugcgcgcgcaagaccaagggcgaugucucgggcgaugacaggggcuuuuucuuugaccugugggggcgcgggaccagagucauagucucgagc

SEQ ID NO: 56847 - RNA, 381 nt, Artificial Sequence
  derived and/or modified sequence opt11 from anti-HIV-1_HeavyChain
caaguguacauggaacagcccgggggcgaggucaagaaaccgggcgcgagcgugaccuugagcuguaaaacggccgaugaagauguauuugacgcggccuauaugcauugggugcgccaggccccgggccagaccuuugaauggcucggguggaugaaaccggucacgggcgcggucaauuacgcgcgcaaguuccagggcagggucucguucuauaugacgcgcgagcucgggauggcguacauggaccugcgcaaucucagguucgaugacacggccguguacuuuugcgcgcgcaagaccgcgggcgaugucucgggcgauaacaggggcuauuucuuugacuugugggggcgcgggagcagggucauaguaucgagc

SEQ ID NO: 56848 - RNA, 381 nt, Artificial Sequence
  derived and/or modified sequence opt11 from anti-HIV-1_HeavyChain
cagguccauauggagcaagcgggcgcgggcgugaaaaagcccggggccucggucacgcucucgugcaagaccgcggacgaggacguguucgaugccgcguacaugcacuggguaaggcaagcgcccgggcaaacguucgaguggcugggcuggaugaagcccgugaccggggccgugagcuaugccaggaaauuucaagggcgcgugagcuuuuacaugaccagggaauugggcauggcauauauggaucucaggaacuugcgcuuugacgauaccgcggucuauuucugugccaggaaaacagccggggacgugagcggggacaaucgcggguacuuuuucgaucucuggggcaggggcucgcgcgugaucgugagcucg

SEQ ID NO: 56849 - RNA, 381 nt, Artificial Sequence
  derived and/or modified sequence opt11 from anti-HIV-1_HeavyChain
caggucuauauggagcaagcgggcgggggagugaaaaagccaggggccucggucacgcuaucgugcaagaccgcggacgaggacguguucgaugccgcguacaugcacugggucaggcaagcgcccgggcaaacguucgagugguugggcuggaugaagcccgugaccggggccgugaacuaugccaggaaauuucaagggcgagugagcuuuuacaggaccagggaauugggcauagccuauauggaucuaaggaacuugagauuugacgauaccgcggucuauuucugugccaggaaaacggccggggacgugagcggggacaagcgcggguucuuuuucgaucuauggggcaggggcccgagagugaucgugagcucg

SEQ ID NO: 56850 - RNA, 381 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcgggcacacguucacgaacuaugacauaaacugggucaggcaagcgcccgggcaagggcucgaguggauaggcugggucaagaucgugagcgggaccgugaacuuugccucgcucgauuucaggaacaggaucucgcucucgcgcgaucgcgaucucucgaccgcguacauggacauacgcgggcucacgcaagaugacacggccacguacuuuugcgcgcgccagaaauuugccucgcgcuauagcggggaccagggcucguacuuugaccugugggggcgcgggaccuugaucguggucucgagc

SEQ ID NO: 56851 - RNA, 381 nt, Artificial Sequence
  derived and/or modified sequence opt11 from anti-HIV-1_HeavyChain
cagguguauauggagcaggcggggggggggaugaagaagccgggggcgaguaugacggugaguuguaagacggcggaugaggauauauuugaugcggcguauaugcauugggugaggcaggcgccggggcagacguuugagugguugggguggaugaagccggugacgggggcggugaauuaugcgaggcaguuucaggggagggugagcuuuuauaggacgagggaguuggggauagcguauacggauuugagggauuugaaguuugaugauacggcgguguauuuuugugcgaggaagacgaagggggaugugaguggggaugauaggggguuuuuuuuugauuugugggggagggggacgagagugauagugaguagu

SEQ ID NO: 56852 - RNA, 381 nt, Artificial Sequence
  derived and/or modified sequence opt11 from anti-HIV-1_HeavyChain
cagguauauauggagcaagcgggagggggagugaaaaagccaggggcaucagucacgcuaucgugcaagacagcggacgaggacguguucgaugccgcguacaugcacuggguaaggcaagcgccggggcaaacguucgagugguugggguggaugaagccagugacaggggcagugaacuaugcaaggcaauuucaagggcgcgugagcuuuuacaggacaagggaauugggaauagcauauauggaucuaagggacuugaaauuugacgauacagcgguauauuucugugcaaggaaaacgaaaggggacgugagcggggacgauagaggguucuuuuucgaucuauggggaaggggaacgagagugauagugagcucg

SEQ ID NO: 56853 - RNA, 381 nt, Artificial Sequence
  derived and/or modified sequence opt11 from anti-HIV-1_HeavyChain
cagguguauauggagcaggcgggggggggggugaagaagccgggggcgagugugacguugaguuguaagacggcggaugaggauguguuugaugcggcguauaugcauugggugaggcaggcgccggggcagacguuugaguggccgggguggaugaagccggugacgggggcggugaauuaugcgaggaaguuucaggggagggugaguuuuuauaggacgagggaguuggggauagcguauauggaucugaggaaucugagguuugaugauacggcgguguauuuuugugcgagaaagacggcgggggaugugaguggggauaagaggggguuuuuuuuugauuugugggggagggggaguagggugauagugaguagc

SEQ ID NO: 56854 - RNA, 381 nt, Artificial Sequence
  derived and/or modified sequence opt11 from anti-HIV-1_HeavyChain
caggucuauauggagcaagcgggcgggggcgugaaaaagcccggggcaucggccacgcucucgugcaagaccgcggacgaggacguguucgaugcagcguacaugcacugggucaggcaagcgcccgggcaaacguucgagugguugggcuggaugaagcccgugaccggggccgugagcuaugccaggaaauuucaagggcgcgugagcuuuuacaugaccagggaauugggaauggccuauauggaucuaaggaacuugcgcuuugacgauaccgcggucuauuucugugccaggaaaacggcaggggacgugagcggggacaauagaggguacuuuuucgaucucuggggcaggggcucgcgcgugaucgugagcucg

SEQ ID NO: 56855 - RNA, 381 nt, Artificial Sequence
  derived and/or modified sequence opt11 from anti-HIV-1_HeavyChain
cagguguauauggagcaggcgggggggggggugaagaagccgggggcgagugugacguugaguuguaagacggcggaugaggauguguuugaugcggcguauaugaggugggugaggcaggcgccggggcagacguuugagugguugggauggaugaagccggugacgggggcggugaauuaugcgaggaaguuucaggggagggugaguuuuuauaggacgagggaguuggggauagcguacauggauuugaggaauuugagguuugaugauacggcgguguauuuuugugcgaggaagacggcgggggaugugaguggggauaagaggggguuuuuuuuugauuugugggggagggggaguagggugauagugaguagu

SEQ ID NO: 56856 - RNA, 381 nt, Artificial Sequence
  derived and/or modified sequence opt11 from anti-HIV-1_HeavyChain
cagguccagcucgugcaaucgggcgcggaagugaaaaagcccggggccucggucaaggucucgugcagggccucgggcuauaccuuuggcaaucacgcgaucucgugggugcgccaggccccgggccagggccuggaauggaugggguggauacgcccgaaaacgggcgcgcgcaaucaagcgcgccaguuccagcccaggaucucgcucacacgcgaucgcgcgcucucaaccgcguacuuggacuugaacucgcucacgagcgcggacucgggcacguacuuuugcgcgcgccagaccuuuaaaccggacuuuuacuuugccgaucaaggguggucguucaaucucuggggcaggggcgcgcacuuuaucgugagcucg

SEQ ID NO: 56857 - RNA, 381 nt, Artificial Sequence
  derived and/or modified sequence opt11 from anti-HIV-1_HeavyChain
cagguguauauggagcaggcgggggggggggugaagaagccgggggcgagugugacauugagcuguaagacggcggaugaggauguguuugaugcggcguauaugcauugggugaggcaggcgccggggcagacguuugagugguugggguggaugaagccggugacgggggcggugaguuaugcgaggaaguuucaggggagggugaguuuuuauaugacgagggaguuggggauggcguauauggauuugaggaauuugagguuugaugauacggcgguguauuuuugugcgaggaagacggcgggggaugugaguggggauaauaggggguauuuuuuugauuugugggggccggggaguagggugauagugaguagu

SEQ ID NO: 56858 - RNA, 381 nt, Artificial Sequence
  derived and/or modified sequence opt11 from anti-HIV-1_HeavyChain
caaguguacauggaacaggccggggccggggucaagaaaccgggcgcgagcgugaccuugagcuguaaaacggccgaugaagaugucuuugacgcggccuauaugcauugggugcgccaggccccgggccagaccuuugaauggcucggguggaugaaaccggucacgggcgcggucaauuacgcgcgcaaguuccagggcagggucucguucuaucgcacgcgcgagcucgggaucgcguacauggacuugcgaaaucucagguucgaugacacggccguguacuuuugcgcgcgcaagaccgcgggcgaugucucgggagauaaaaggggcuuuuucuuugacuugugggggcgcgggagcagggucauagucucgagc

SEQ ID NO: 56859 - RNA, 381 nt, Artificial Sequence
  derived and/or modified sequence opt11 from anti-HIV-1_HeavyChain
caggugcauauggagcaggcgggggggggggugaagaagccgggggcgagugugacguugagcuguaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggauuugaggaauuugagguuugaugauacggcgguguauuuuugugcaaggaagacggcgggggaugugaguggggauaagaggggguuuuuuuuugauuugugggggagggggaguagggugauagugaguagc

SEQ ID NO: 56860 - RNA, 381 nt, Artificial Sequence
  derived and/or modified sequence opt11 from anti-HIV-1_HeavyChain
cagguguauauggagcaggcgggggaugggaugaagaagccgggggcgaguaugacggugaguuguaagacggcggaugaggauauauuugaugcggcguauaugcauugggugaggcaggcgccggggcagacguuugaguggcugggguggaugaagccggugacgggggcggugaauuaugcaaggcaguuucaggggagggugagcuuuuauaggacgagggaguuggggauagcguauauggauuugagggauuugaaguuugaugauacggcgguguauuuuugugcgaggaagacgaagggggaugugagcggggaugauaggggguuuuuuuuugaucugugggggagggggacgagggugauagugaguagu

SEQ ID NO: 56861 - RNA, 381 nt, Artificial Sequence
  derived and/or modified sequence opt11 from anti-HIV-1_HeavyChain
caggugcaguuggugcagaguggggcggaggugaagaagccgggggcgagugugacguugaguuguaagacggcggaugaggauguguuugaugcggcguauaugcauugggugaggcaggcgcaggggcagacguuugagugguugggguggaugaagccggugacgggggcggugaauuaugcgaggaaguuucaggggagggugaguuuuuauaggacgagggaguuggggauagcguauauggauuugaggaauuugagguuugaugauacggcgguguauuuuugugcgaggaagacggcgggggaugugaguggggauaagaggggguuuuuuuuugauuugugggggagggggaguagggugauagugaguagu

SEQ ID NO: 56862 - RNA, 381 nt, Artificial Sequence
  derived and/or modified sequence opt11 from anti-HIV-1_HeavyChain
caaguguacauggaacaggccgggggcggggucaagaaaccgggcgcgagcgugaccuugagcuguaaaacggccgaugaagaugucuuugacgcggccuauaugcauugggugcgccaggccccgggccagaccuuugaauggcucggguggaugaaaccggucacgggcgcggucaauuacgcgcgcaaguuccagggcagggucucguucuaucgcacgcgcgagcucgggaucgcguacauggacuugcgcaaucuaagguucgaugacacggccguguacuuuugcgcgcgcaagaccgcgggcgaugucucgggcgauaaaaggggcuuuuucuuugacuugugggggcgcgggagccaggucauagucucgagc

SEQ ID NO: 56863 - RNA, 381 nt, Artificial Sequence
  derived and/or modified sequence opt11 from anti-HIV-1_HeavyChain
caagugcaauugguccagagcggggccgaggucaggaaaccgggcgcgagcgugaaagugagcuguaaagcgagcggguacacguucacgaacuauuacaugcacugggucaggcaagcgcccgggcaagggcucgaguggauaggcugggucaagaucgugagcgggaccgugaacuuugccucgcuagauuucaggaacaggaucucgcucucacgcgaucgcgaucucucgaccgcguacauggacauacgcgggcucacgcaagaugacacggccacguacuuuugcgcgcgccagaaauuugccucgcgcuauagcggggaccagggcucguacuuugacuugugggggcgcgggaccuugaucguggucucgagc

SEQ ID NO: 56864 - RNA, 381 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacagaauugauccauugggugcgccaggccccgggccagggcuuggaauggaucgggugggugaaaacggucacgggcacggucaauuacgcgcgcaaguuccagggcagggucucguucuaucgcacgcgcgagcucgggaucgcguacauggacuugcgcaaucucagguucgaugacacggccguguacuuuugcgcgcgcaagaccgcgggcgaugucucgggcgauaaaaggggcuuuuucuuugacuugugggggcgcgggagcagggucauagucucgagc

SEQ ID NO: 56865 - RNA, 381 nt, Artificial Sequence
  derived and/or modified sequence opt11 from anti-HIV-1_HeavyChain
cuaauccaucucgcgcaaucgggcgcggaagugaaaaagcccggggccucggucacacucucgugcaagaccgcggacgaggacguguucgaugccgcguacaugcacugggucaggcaagcgcccgggcaaacguucgagugguugggcuggaugaagcccgugaccggggccgugagcuaugccaggaaauuucaagggcgagugagcuuuuacaugaccagggaauugggcauggccuauauggaucucaggaacuugcgcuuugacgauaccgcggucuauuucugugccaggaaaacggccggggacgugagcggggacaaucgcggguacuuuuucgaucuauggggcaggggcucgcgcgugaucgugagcucg

SEQ ID NO: 56866 - RNA, 381 nt, Artificial Sequence
  derived and/or modified sequence opt11 from anti-HIV-1_HeavyChain
caagugcaauugguccagagcggggccgaggucaagaaaccgggcgcgagcaugaccgugagcuguaaaacggccgaugaagauaucuuugacgcggcauauaugcauugggugcgccaggcaccgggccagaccuuugaauggcucggauggaugaaaccggucacgggcgcggucaauuacgcgcgccaguuccagggcagggucucguucuaucgcacgcgcgagcucgggaucgcguacauggacuugcgcgaucuaaaguucgaugacacggccguguacuuuugcgcgcgcaagaccaagggcgaugucucgggcgaugacaggggcuuuuucuuugacuugugggggcgcgggaccagggucauagucucgagc

SEQ ID NO: 56867 - RNA, 381 nt, Artificial Sequence
  derived and/or modified sequence opt11 from anti-HIV-1_HeavyChain
cagguguauauggagcaggggagggggggggugaagaagccgggggcgagcgugacguugaguuguaagacggcggaugaggauguguuugaugcggcguauaugcauugggugaggcaggcgccggggcagacguuugagugguugggguggaugaagccgguaacgggggcggugaauuaugcgaggaaguuucaggggagggugaguuuuuauaggacgagggaguuggggauagcguauauggaucugaggaauuugagauuugaugauacggcgguguauuuuugugcgaggaagacggcgggggaugugaguggggauaagaggggguuuuuuuuugauuugugggggagagggagcagggugauagugaguagc

SEQ ID NO: 56868 - RNA, 381 nt, Artificial Sequence
  derived and/or modified sequence opt11 from anti-HIV-1_HeavyChain
cagguguauauggagcaggcggggggggggaugaagaagccgggggcgagcaugacggugaguuguaagacggcggaugaggauguguuugaugcggcguauaugcauugggugaggcaggcgccggggcagacguuugagugguugggguggaugaagccggugacgggggcggugaauuaugcgaggcaguuucaggggagggugaguuuuuauaggacgagggagcuggggauagcguauauggauuugagggauuugaagagugaugauacggcgguguauuuuugcgcgaggaagacggcgggggaugugaguggagauaagaggggguuuuuuuuugauuugugggggagggggaguagggugauagugaguagc

SEQ ID NO: 56869 - RNA, 381 nt, Artificial Sequence
  derived and/or modified sequence opt11 from anti-HIV-1_HeavyChain
caagugcaacugguccagagcggggccgaggucaagaaaccgggcucgagcauaaaagugagcuguaaagcgagcggggacacgaucucgcgcuaugccauaaacugggucaggcaagcgcccgggcaagggcucgaguggauaggcugggucaagaccgugaccggggccgugaacuuuggcucgcucgauuucaggcacaggaucucgcucacgcgcgaccgcgaucucuuuaccgcgcacaugggcauacgcgggcucacgcaaggggacacggccacguacuuuugcgcgcgccagaaauuugaaucgcgcuauaccgggggccagggcugguacuuugacuugugggggcgcgggacccauauaguggucucgagc

SEQ ID NO: 56870 - RNA, 381 nt, Artificial Sequence
  derived and/or modified sequence opt11 from anti-HIV-1_HeavyChain
cagguguauauggagcaggcgggggggggggugaagaagccgggggcgagugugacguugagcuguaagacggcggaugaggauauauuugaugcggcguauaugcauugggugaggcaggcgccggggcagacguuugaguggcugggguggaugaagccggugacgggggcggugaauuaugcgaggaaguuucaggggagggugaguuuuuauaggacgagggaguuggggauagcguauauggaucugaggaauuugagguuugaugauacggcgguguacuuuugugcgaggaagacggcgggggaugugaguggggacaagaggggguuuuuuuuugauuugugggggagggggagcagggugauagugagcagu

SEQ ID NO: 56871 - RNA, 381 nt, Artificial Sequence
  derived and/or modified sequence opt11 from anti-HIV-1_HeavyChain
caggucuauauggagcaagcgggcgggggcgugaaaaagcccggggccucggucacgcucucgugcaagaccgcggacgaggacguguucgaugccgcguacaugcacugggucaggcaagcgcccgggcaaacguucgagugguugggcuggaugaagcccgugaccggggccgugaacuaugccaggaacuuucaagggcgcgugagcuuuuacaggaccagggaauugggcauagccuauauggaucucagaaaccugcgauuugacgauaccgcagucuauuucugugccaggcaaaaguucgagagcagguacucgggcgaucaagggagcuauuucgaucucuggggcaggggcacgcucauaaucgugagcucg

SEQ ID NO: 56872 - RNA, 381 nt, Artificial Sequence
  derived and/or modified sequence opt11 from anti-HIV-1_HeavyChain
caaguguacauggaacaggccgggggcggggucaagcgcccgggcgcgagcgugacauugagcuguaaaacggccgaugaagaugucuuugacgcggccuauaugcauugggugcgccaggccccgggccagaccuuugaauggcucggguggaugaaaccggucacgggcgcggucaauuacgcgcgcaaguuccagggcagggucucguucuaucgcacgcgcgagcucgggaucgcguacauggacuugcgcaaucucagguucgaugacacggccguguacuuuugcgcgcgcaagaccgcgggcgaugucucgggagauaaaaggggcuuuuucuuugacuugugggggcgcgggagcagggucauagucucgagc

SEQ ID NO: 56873 - RNA, 381 nt, Artificial Sequence
  derived and/or modified sequence opt11 from anti-HIV-1_HeavyChain
caggugcagcuggugcagaguggggaugaggugaagaagccgggggcgagugugacguugaguuguaagacggcggaugaggauguguuugaugcggcguacaugcauugggugaggcaggcgccggggcagacguuugaguggcugggguggaugaagccggugacgggggcggugaauuaugcgaggaaguuucaggggagggugaguuuuuauaggacgagggaguuggggauagcguauauggauuugaggaauuugagauuugaugauacagcgguguauuuuugugcgaggaagacggcgggggaugugaguggggauaagaggggauuuuuuuuugauuugugggggagggggagcagggugauagugagcagu

SEQ ID NO: 56874 - RNA, 381 nt, Artificial Sequence
  derived and/or modified sequence opt11 from anti-HIV-1_HeavyChain
cagguccagcucgugcaaucgggcgcgggcgugaaaaagcccgggagcucggucaaggucucgugcaaggccucgggcgggaccuuuagcucguacgcgaucaauugguugcgccaggucccgggccagcgcccggaauggaugggguggauacgaccgaaaacgggcgcgcgcaaucaagcgcgccaguuccagcccagaaucucgcucacgcgcgaucgcgcgcucucgaccgcguacuuggacuugaacucgcucacgagcgcggacucgggcacguacuuuugcgcgcgccagaccuuuaaaccggacuuuuacuuugccgaucaaggguggucguucaaucucuggggcaggggcgcgcacuuuaucgugagcucg

SEQ ID NO: 56875 - RNA, 381 nt, Artificial Sequence
  derived and/or modified sequence opt11 from anti-HIV-1_HeavyChain
cagguguauauggagagggcgggggggggggugaagaagccgggggcgagcgugacguugaguugugagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggauuugaggaauuugagguuugaugauacggcgguguauuuuugugcgaggaagacggcgggggaugugaguggggauaagaggggguuuuuuuuugauuugugggggagggggaguagggugauagugaguagu

SEQ ID NO: 56876 - RNA, 381 nt, Artificial Sequence
  derived and/or modified sequence opt11 from anti-HIV-1_HeavyChain
cagguauauauggagcaagcgggagcgggcaugaaaaagccaggggccucgaugacggucucgugcaagaccgcggacgaggacauauucgacgccgcguacaugcacugggucaggcaagcgccagggcaaacguucgaguggcugggauggaugaagccagugacaggggccgugaacuaugccaggcaauuucaagggcgcgugagcuuucuacaggaccagggcauaagaauagcauauauggaucuaagggaccugaaauuugacgauacagcagucuauuucugugccaggaaaacgaaaggggacgugagcggggacgaucgaggauucuuuuucgaucucuggggaaggggcacgcgagugaucguaagcucg

SEQ ID NO: 56877 - RNA, 381 nt, Artificial Sequence
  derived and/or modified sequence opt11 from anti-HIV-1_HeavyChain
cagguguauaugggggcggggagggggggggugaagaagccgggggcgagugugacguugaguuguaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggauuugaggaauuugagguuugaugauacggcgguguauuuuugugcgaggaagacggcgggggaugugaguggggauaagaggggguuuuuuuuugauuugugggggagggggaguagggugauagugaguagu

SEQ ID NO: 56878 - RNA, 381 nt, Artificial Sequence
  derived and/or modified sequence opt11 from anti-HIV-1_HeavyChain
caaguguacauggaacaggccggggccggggucaagaaaccgggcgcgagcgugaccuugagcuguaaaacggccgaugaagaugucuuugacgcggccuauaugcauugggugcgccaggccccgggccagcccuuugaauggcucggguggaugaaaccggucacgggcgcggucucguacgcgcgcaaguuccagggcagggucucguucuauaugacgcgcgagcucgggauggcguacauggacuugcgcaaucucagguucgaugacacggccguguacuuuugcgcgcgcaagaccgcgggcgaugucucgggcgauaacaggggcuauuucuuugacuugugggggcgcgggagcagggucauagucucgagc

SEQ ID NO: 56879 - RNA, 381 nt, Artificial Sequence
  derived and/or modified sequence opt11 from anti-HIV-1_HeavyChain
caaguccaacucguacaauccggcgccgaagucaaaaaacccggcgccuccgucaaaaucuccugcaaagccuccggcuacaccuucauccgccacggcauccacuggcuccgccaagucccaggccaacgccccgaauggaugggcuggauccgccccaaaaccggcgcccgcaaccaagcccgccaauuccaaccccgcaucucccucgcccgcgaccgcgcccucuccaccgccuaccucgaccucaacucacucaccuccgccgacuccggcaccuacuucugcgcccgccaaaccuucaaacccgacuucuacuucgccgaccaaggcugguccuucaaccucuggggccgcggcgcccacuucaucgucuccucc

SEQ ID NO: 56880 - RNA, 381 nt, Artificial Sequence
  derived and/or modified sequence opt11 from anti-HIV-1_HeavyChain
caggucuugcucgugcaaucgggcgcggaagugaaaaagcccgggagcucggucaaggucucgugcaaggccucgggcgacagccugaccaaguacgcguucucgugggugcgccaggccccgggccagggcccggaauggaugggauggauacgcccgaaaacgggcgcgcgcaaucgcgcgcgccaguuccagcccaggaucucgcucacgcgcgaucgcgcgcucucaaccgcguacuuggacuugaacucgcucacgagcgcggacucgggcacguacuuuugcgcgcgccagaccuuuaaaccggacuuuuacuuugccgaucaaggguggucguucaaucucuggggcaggggcgcgcacuuuaucgugagcucg

SEQ ID NO: 56881 - RNA, 381 nt, Artificial Sequence
  derived and/or modified sequence opt11 from anti-HIV-1_HeavyChain
cagguguauauggagcaggcgggggggggggugaagaagccgggggcgagugugacguugaguuguaagacggcggaugaggauguguuugaugcggcguauaugcauugggugaggcaggcgagggggcagacguuugagugguugggguggaugaagccggugacgggggcggugaauuaugcgaggaaguuucaggggagggugaguuuuuauaggacgagagaguuggggauagcguacauggauuugaggaauuugagguuugaugauacggcgguguauuuuugugcgaggaagacggcgggggaugugaguggggauaagaggggguuuuuuuuugaucugugggggagggggaguagggugauagugaguagc

SEQ ID NO: 56882 - RNA, 381 nt, Artificial Sequence
  derived and/or modified sequence opt11 from anti-HIV-1_HeavyChain
caggucuauauggagcaagcgggcgggggcgugaaaaagcccggggccucggucacgcuaucgugcaagaccgcggacgaggacguguucgaugccgcguacaugcacugggucaggcaagcgcccgggcaaacguucgagugguugggcuggaugaagcccgugaccggggccgugaacuaugccaggaaauuucaagggcgcgugagcuuuuacaggaccagggaauugggcauagccuauauggaucuaaggaacuugcgcuuugacgauaccgcggucuauuucugugccaggaaaacggccggggacgugagcggggacaaucgcggguacuuuuucgaucucuggggcaggggcucgcgcgugauagugagcucg

SEQ ID NO: 56883 - RNA, 381 nt, Artificial Sequence
  derived and/or modified sequence opt11 from anti-HIV-1_HeavyChain
caaguguacauggaacaggccgggggcggggucaagaaaccgggcgcgagcgugaccuugagcuguaaaacggccgaugaagaugucuuugacgcggccuauaugcauugggugcgccaggccccgggccagaccuuugaauggcuaggguggaugaaaccggucacgggcgcggucaauuacgcgcgcaaguuccagggcagggucucguucuaucgaacgcgcgagcucgggaucgcguacauggacuugcgcaaucucagguucgaugacacggccguguacuuuugcgcgcgcaagaccgcgggcgaugucucgggcgauaaaaggggcuuuuucuuugacuugugggggcccgggagcagggucauagucucgagc

SEQ ID NO: 56884 - RNA, 381 nt, Artificial Sequence
  derived and/or modified sequence opt11 from anti-HIV-1_HeavyChain
cagguguauauggagcaggcggggggggggaugaagaagccgggggcgagcaugacggugaguuguaagacggcggaugaggauauauuugaugcggcguauaugaggugggugaggcaggcgccggggcagacguuugagugguugggguggaugaagccagugacgggggcggugaauuaugcgaggcaguuucaggggagggugaguuuuuauaggacgagggaguuggggauagcguauauggauuugagggaucugaaguuugaugauacggcgguguauuuuugugcgagaaagacgaagggggaugugaguggggaugacaggggguuuuuuuuugauuugugggggagggggacgagggugauagugaguagc

SEQ ID NO: 56885 - RNA, 381 nt, Artificial Sequence
  derived and/or modified sequence opt11 from anti-HIV-1_HeavyChain
caggucuauauggagcaagcgggagggggcgugaaaaagcccggggcaucggucacgcucucgugcaagaccgcggacgaggacguguucgaugccgcguacaugcacugggucaggcaagcgcccgggcaaacauucgagugguugggcuggaugaagcccgugaccggggccgugagcuaugccaggaaauuucaagggcgcgugagcuuuuacaugaccagggaauugggcauggccuaucucgaucucaggaacuugcgauuugacgauaccgcggucuauuucugugcaaggaaaacggccggggacgugagcggggacaaucgaggguacuuuuucgaucucuggggcaggggcucgcgcgugauagugagcucg

SEQ ID NO: 56886 - RNA, 381 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacacguucacgggcuauuacaugcacugggucaggcaagcgcccgggcaagggcucgaguggauaggcugggucaagaccgugaccggggccgugaacuuuggcucgcucgauuucaggcacaggaucucgcucacgcgcgaucgagaucucuuuaccgcgcacauggacauacgagggcucacgcaaggggacacggccacguacuuuugcgcgcgccagaaauuugaaucgcgcuauaccgggggccagggcugguacuuugaccugugggggcgcgggacccauaucguggucucgagc

SEQ ID NO: 56887 - RNA, 381 nt, Artificial Sequence
  derived and/or modified sequence opt11 from anti-HIV-1_HeavyChain
caggucuauauggagcaagcgggcgggggcgugaaaaagcccggggccucggucacgcucucgugcaagaccgcggacgaggacguguucgaugccgcguacaugcacugggucaggcaagcgcccgggcaaacguucgaguggcugggcuggaucaagcccgugaccggggcagugaacuaugccaggaaauuucaagggcgagugagcuuuuacaggaccagggaauugggcauagccuauauggaucucaggaacuugcgcuuugacgauaccgcggucuauuucugugccaggaaaacggccggggacgugagcggggacaagcgcggguucuuuuucgaucucuggggcaggggcucgcgcgugaucgugagcuca

SEQ ID NO: 56888 - RNA, 381 nt, Artificial Sequence
  derived and/or modified sequence opt11 from anti-HIV-1_HeavyChain
cagguguauauggagcaggcggggggggggaugaagaagccgggggcgagugugacggugaguuguaagacggcggaugaggauauauuugaugcggcguauaugcauugggugaggcaggcgccggggcagacguuugagugguugggguggaugaagccggugacgggggcggugaauuaugcgaggcaguuucaggggagggugaguuuuuauaggacgagggaguuggggauagcguauauggauuugagggauuugaaguuugaugauacggcgguguauuuuugugcgaggaagacgaagggggaugugagcggggaugauaggggguuuuuuuuugauuugugggggagggggacgagggugauagugaguagu

SEQ ID NO: 56889 - RNA, 381 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggucgagcgaggacauaagcaaggccgagcucauacacugggucaggcaagcgcccgggcaagggcucgaguggauaggcugggucaagaccgugaccggggcagugaacuuuggcucgcucgauuucaggcacaggaucucgcuaacgcgagaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 56890 - RNA, 381 nt, Artificial Sequence
  derived and/or modified sequence opt11 from anti-HIV-1_HeavyChain
cagguguauauggaggcggggagggggggggugaagaagccgggggcgagugcgacguugaguuguaagacggcggaugaggauguguuugaugcggcguauaugcauugggugaggcaggcgccggggcagacguuugagugguugggguggaugaagccggugacgggggcggugaguuaugcgaggaaguuucaggggagggugaguuuuuauaugacgagggaguuggggauggcguauauggauuugaggaauuugagguuugaugauacggcgguguauuuuugugcgaggaagacggcgggggaugugaguggggauaauaggggguauuuuuuugaucugugggggagggggaguagggugauagugagcagu

SEQ ID NO: 56891 - RNA, 381 nt, Artificial Sequence
  derived and/or modified sequence opt11 from anti-HIV-1_HeavyChain
aggugcauauggaggcaagcgggcgggggcgugaaaaagcccggggccucggucacgcucucgugcaagaccgcggacgaggacguguucgaugccgcguacaugcacugggucaggcaagcgcccgggcaaacguucgagugguugggcuggaugaagcccgugaccggggccgugagcuaugccaggaaauuucaagggcgcgugagcuuuuacaugaccagggaacugggcauggccuauauggaucucaggaacuugcgcuuugacgauaccgcggucuauuucugugccaggaaaacggccggggacgugagcggggacaaucgcggguacuuuuucgaucucuggggcaggggcucgcgcgugaucgugagcucg

SEQ ID NO: 56892 - RNA, 381 nt, Artificial Sequence
  derived and/or modified sequence opt11 from anti-HIV-1_HeavyChain
cagguauauauggagcaagcgggagggggcgugaaaaagcccggggccucggucacgcucucgugcaagaccgcggacgaggacguguucgaugccgcguacaugcacugggucaggcaagcgccagggcaaacguucgagugguugggcuggaucaagcccgugaccggggccgugagcuaugcaaggaaauuucaagggcgcgugagcuuuuacaugaccagggaauugggaauggccuauauggaucucaggaacuugcgauuugacgauaccgcggucuauuucugugccaggaaaacggccggggacgugagcggggacaaucgcggguacuuuuucgaucucuggggcaggggcucgcgcgugauagugagcucg

SEQ ID NO: 56893 - RNA, 384 nt, Artificial Sequence
  derived and/or modified sequence opt11 from anti-HIV-1_HeavyChain
cagagccaucucgagcaaucgggcucggccaugaaaaagcccggggccucggucaagagcucgugcuggaccucggaagauaucuuugacacgaccgagcucauauacugggucaggcaagcgcccgggcaagggcucgaguggauaggaugggucaagaucgugagcgggaccgugaacuucgccucgcucgauuucaggaacaggaucucgcuaucacgcgaucgcgaucucucgaccgcguacauggacauacgcgggcucacgcaagaugacacggccacguacuuuugcgcgcgccagaaauuugccucacgcuauagcggggaccagggcucguacuuugacuugugggggcgcgggaccuugaucguggucucgagc

SEQ ID NO: 56894 - RNA, 381 nt, Artificial Sequence
  derived and/or modified sequence opt11 from anti-HIV-1_HeavyChain
agguguuuguggaggcaggcggggggggggaugaagaagccgggggcgaguaugacggugaguuguaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggauuugaggaauuugagguuugaugauacggcgguguauuuuugugcgaggaagacggcgggagaugugaguggggauaagaggggguuuuuuuuugauuugugggggagggggaguagggugauagugaguagu

SEQ ID NO: 56895 - RNA, 381 nt, Artificial Sequence
  derived and/or modified sequence opt11 from anti-HIV-1_HeavyChain
agguguauaugggagagggcggggggggggaugaagaagccgggggcgaguaugacggugaguuguaagacggcggaugaggauauauuugaugcggcguauaugcauugggugaggcaggcgccggggcagacguuugagugguugggguggaugaagccggugacgggggcggugaauuaugcgaggcaguuucaggggagggugaguuuuuauaggacgagggaguuggggauagcguauauggaucugagggauuugaaguuugaugauacggcgguguauuuuugugcgaggaagacgaagggggaugugaguggggaugauaggggguuuuuuuuugauuugugggggagggggacgagggugauagugaguagc

SEQ ID NO: 56896 - RNA, 381 nt, Artificial Sequence
  derived and/or modified sequence opt11 from anti-HIV-1_HeavyChain
caggugcaguuggagcaggcgggggggggggugaagaagccgggggcgagcgugacguugagcuguaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauagaacgagggaguuggggauagcguauauggauuugaggaauuugagguuugaugauacggcgguguauuuuugugcgaggaagacggcgggggaugugagcggggauaagaggggguuuuuuuuugauuugugggggagggggagcagagugauagugagcagu

SEQ ID NO: 56897 - RNA, 381 nt, Artificial Sequence
  derived and/or modified sequence opt11 from anti-HIV-1_HeavyChain
cagguguauauggagcaggcggggggggggaugaagaagccgggggcgagcaugacggugaguuguaagacggcggaugaggauguguuugaugcggcauauaugcauugggugaggcaggcgccggggcagacguuugaguggcugggguggaugaagccggugacgggggcggugaauuaugcgaggaaguuucaggggagggugaguuuuuauagaacgagggaguuggggauagcguauauggacuugaggaauuugagguuugaugauacggcgguguauuuuugugcgaggaagacggcgggggaugugaguggggauaagaggggguuuuuuuuugaucugugggggagggggaguagggugauagugaguagu

SEQ ID NO: 56898 - RNA, 381 nt, Artificial Sequence
  derived and/or modified sequence opt11 from anti-HIV-1_HeavyChain
cagguguauauggagcaggcgggggggggggugaagaagccgggggcgagugugacgcugaguuguaagacggcggaugaggauguguuugaugcggcauauaugaggugggugaggcaggcgccggggcagacguuugagugguugggguggaugaagccggugacgggggcggugaguuaugcgaggaaguuucaggggagggugaguuuuuauaugacgagggaguuggggauggcauauauggauuugaggaauuugagguuugaugauacggcgguguauuuuugugcgaggaagacggcgggggaugugaguggggauaauaggggguauuuuuuugauuugugggggagggggaguagggugauagugaguagu

SEQ ID NO: 56899 - RNA, 381 nt, Artificial Sequence
  derived and/or modified sequence opt11 from anti-HIV-1_HeavyChain
cagguguauauggagcagccgggggggggggugaagaagccgggggcgagugugacguugaguuguaagacggcggaugaggauguguuugaugcggcguauaugcauugggugaggcaggcgccggggcagacguuugagugguugggguggaugaagccggugacgggggcggugaguuaugcgaggaaguuucaggggagggugagcuuuuauaugacgagggaguuggggauggcguauauggauuugaggaauuugagguuugaugauacggcgguguauuuuugugcgaggaagacggcgggggaugugagcggggauaauaggggguauuuuuuugauuugugggggagggggagcagggugauagugaguagu

SEQ ID NO: 56900 - RNA, 381 nt, Artificial Sequence
  derived and/or modified sequence opt11 from anti-HIV-1_HeavyChain
cagguauauauggagcaggcggggggggaggugaagaagccgggggcgagugugacguugaguuguaagacggcggacgaggauguguuugaugcggcguauaugcauugggugaggcaggcgccggggcagacguuugagugguugggguggaugaagccggugacgggggcggugaguuaugcgaggaaguuucaggggagggugagcuuuuauaugacgagggaguuggggauggcauauauggauuugaggaaucugagauuugacgauacggcgguguauuuuugugcgaggaagacggcgggggacgugagcggggauaauaggggguacuuuuuugaucugugggggagggggaguagagugauagugagcagu

SEQ ID NO: 56901 - RNA, 381 nt, Artificial Sequence
  derived and/or modified sequence opt11 from anti-HIV-1_HeavyChain
caaguccaacucguccaaucaggcgccgaagucaaaaaacccggcgccuccguccgcgucuccugccaagccuccggcuacaucuucaccggcuacuucgucaacuggcuccgccaacuccccggccaacgacccgaauggaugggcuggauccgccccaaauccggcgcccgcaaccaagcccgccaauuccaaccccgcaucucacucacccgcgaccgcgcccuauccaccgccuaccucgacuccaacucccucaccuccgccgacuccggcacauacuucugcgcccgccaaaccuucaaacccgacuucuacuucgccgaccaaggcugguccuucaaccucuggggccgcggcgcccacuucaucgucuccucc

SEQ ID NO: 56902 - RNA, 381 nt, Artificial Sequence
  derived and/or modified sequence opt11 from anti-HIV-1_HeavyChain
gggugcauauggacgcaagcgggcgggggcgugaaaaagcccggggccucggucacgcucucgugcaagaccgcggacgaggacguguucgaugccgcguacaugcacugggucaggcaagcgcccgggcaaacguucgagugguugggcuggaugaagcccgugaccggggccgugagcuaugccaggaaauuucaagggcgcgugagcuuuuacaugaccagggaauugggcauggccuauauggaucucaggaacuugcgcuuugacgauaccgcggucuauuucugugccaggaaaacggccggggacgugagcggggacaaucgcggguacuuuuucgaucucuggggcaggggcucgcgcgugaucgugagcucg

SEQ ID NO: 56903 - RNA, 381 nt, Artificial Sequence
  derived and/or modified sequence opt11 from anti-HIV-1_HeavyChain
agguguauauggaggcaggcggggggggggaugaagaagccgggggcgaguaugacggugaguuguaagacggcggaugaggauauauuugaugcggcguauaugcauugggugaggcaggcgccggggcagacguuugagugguugggguggaugaagccggugacgggggcggugaauuaugcgaggcaguuucaggggagggugaguuuuuauaggacgagggaguuggggauagcguauauggauuugagggaucugaaguuugaugauacggcgguguauuuuugugcgaggaagacgaagggggaugugaguggggaugacaggggguuuuuuuuugauuugugggggagggggacgagagugauagugaguagu

SEQ ID NO: 56904 - RNA, 381 nt, Artificial Sequence
  derived and/or modified sequence opt11 from anti-HIV-1_HeavyChain
cagguguauauggagcaggcgggggggggagugaagaagccgggggcgagugugacgcugaguuguaagacggcggaugaggauguguuugaugcggcguauaugcauugggugaggcaggcgccggggcagacguuugaguggguaggguggaugaagccggugacgggggcggugaguuaugcgaggaaguuucaggggagagugaguuuuuauaugacgagggaguuggggauggcguauauggauuugaggaauuuaagguuugaugauacggcgguguauuuuugugcgaggaagacggcgggggaugugagcggggauaauaggggguauuuuuuugauuugugggggagggggaguagggugauagugaguagu

SEQ ID NO: 56905 - RNA, 381 nt, Artificial Sequence
  derived and/or modified sequence opt11 from anti-HIV-1_HeavyChain
cagguguauauggagcaggcgggggggggggugaaggagccgggggcgagugugacguugaguuguaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcguauauggaucugaggaauuugagguuugaugauacggcgguguauuuuugugcgaggaagacggcgggggaugugaguggggauaagaggggguuuuuuuuugauuugugggggagggggaguagggugauagugaguagu

SEQ ID NO: 56906 - RNA, 381 nt, Artificial Sequence
  derived and/or modified sequence opt11 from anti-HIV-1_HeavyChain
caagcgcacuuggaacagagcgggagcgggguaaagaaaccgggcgcgagcgugcgcgugagcuguuggucgagcgaggacauauucaagaccgagcucauacacugggucaggcaagcgcccgggcaagggcucgaguggauaggcugggucaagaccgugacaggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuugaaucgcgcuauacagggggccagggcugguacuuugacuugugggggcgcgggacccauaucguggucucgagc

SEQ ID NO: 56907 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggucgagcgaggacauauucgagcgcacggaauugauccauugggugcgccaggccccgggccagggcuuggaauggaucggguggaugaaaacggucacgggcgcggucaauuucgggagcuuggacuuucgccaucgcaucagcuugaccagggacagggacuuguucacggcccauauggauauaaggggcuuggcccagggcgauaccgcgaccuauuucugugccaggcaaaaguucgagagcagguacacgggcgggcaagggugguauuucgaucucuggggcaggggcacgcacauagucgugagcucg

SEQ ID NO: 56908 - RNA, 384 nt, Artificial Sequence
  derived and/or modified sequence opt11 from anti-HIV-1_HeavyChain
caagcgcacuuggaacagagcgggagcgggguaaagaaaccgggcgcgagcgugagagugagcuguuggacgagcgaggacauauucgagcgcacggaauugauccauugggugagacaggcaccgggacagggauuggaauggaucgggugggugaaaacgguaacgggcgcgguaaauuucgggagccuggacuuuagacaucgaaucagcuugaccagggacagggacuuguucacggcccauauggauauaaggggcuugacacagggcgauacagcgaccuauuucugugcaagacaaaaguucgagagcagguacacgggcgggcaagggugguauuucgaucucuggggaaggggcacgcacauagucgugagcucg

SEQ ID NO: 56909 - RNA, 384 nt, Artificial Sequence
  derived and/or modified sequence opt11 from anti-HIV-1_HeavyChain
caaagccaccucgaacaauccggcuccgccaugaaaaaacccggcgccuccguccgcguauccugcuggaccucagaagacaucuucgacaccaccgaacucaucuacuggguccgacaagcccccggccaaggccucgaauggaucggcuggguaaaaaucguauccggcaccgucaacuucgccucccucgacuuccgcaaccgcaucucccucucccgcgaccgcgaccucuccaccgccuacauggacauccgcggccucacccaagacgacaccgccaccuacuucugcgcccgccaaaaauucgccucccgcuacuccggcgaccaaggcuccuacuucgaccucuggggccgcggcacccucaucguagucuccucc

SEQ ID NO: 56910 - RNA, 384 nt, Artificial Sequence
  derived and/or modified sequence opt11 from anti-HIV-1_HeavyChain
ucccacaccuggaacaaccgcggcuccgccaugaaaaaacccggcgccucaguccgcgucuccugcuggaccuccgaagacaucuucgacaccaccgaacucaucuacuggguccgccaagcccccggccaaggccucgaauggaucggcugggucaaaaucgucuccggcaccgucaacuucgccucccucgacuuccgcaaccgcaucucacucucccgagaccgcgaccucuccaccgccuacauggacauccgcggccucacccaagacgacaccgccaccuacuucugcgcccgccaaaaauucgccucccgcuacuccggcgaccaaggcuccuacuucgaccucuggggccgaggcacccucaucgucgucuccucc

SEQ ID NO: 56911 - RNA, 381 nt, Artificial Sequence
  derived and/or modified sequence opt11 from anti-HIV-1_HeavyChain
caaucgcacuuggaacagagcgggagcgcgaugaagaaaccgggagcgagcgugagagugagcuguuggacgagcgaggacauauuccauaacgagcucauauacugggucaggcaagcgcccgggcaagggcucgaguggauaggcugggucaagaucgugagcgggaccgugaacuuugccucgcucgauuucaggaacaggaucucgcucucgcgcgaucgcgaucucucgaccgcguacauggacauacgcgggcucacgcaagacgacacggccacguacuuuugcgcgcgccagaaauuugccucgcgcuauagcggggaccagggcucguacuuugacuugugggggcgcgggaccuugaucguggucucgagc

SEQ ID NO: 56912 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcguaagcuguuggacgagcgaggacauauucgagcgcacggaacugauacauugggugcgccaggccccgggccagggcuuggaauggaucggguggaugaaaacggucacgggcgcggucaauuucgggagcuuggacuuucgccaucgcaucagcuugaccagggacagggacuuguucacggcccauauggauauaaggggcuugacccagggcgauaccgcgaccuauuucugugccaggcaaaaguucgagagcagguacacgggcgggcaagggugguauuucgaucucuggggcaggggaacgcacauagucgugagcucg

SEQ ID NO: 56913 - RNA, 381 nt, Artificial Sequence
  derived and/or modified sequence opt11 from anti-HIV-1_HeavyChain
caaguguucauggaacaggccgggggcgaggucaagaaaccgggcgcgagcaugaccgugagcuguaaaacggccgaugaagaugucuuugacgcggccuauaugcauugggugcgccaggccccgggccagaccuuugaauggcucggguggaugaaaccggucacgggcgcggucaauuacgcgcgccaguuccagggcagggucucguucuaucgcacgcgagagcucgggaucgcguacauggacuugcgcgaucucaaguucgaugacacggccguguacuuuugcgcgcgcaagaccaagggcgaugucucgggcgaugacaggggcuuuuucuuugacuugugggggcgcgggaccagggucauagucucgagc

SEQ ID NO: 56914 - RNA, 381 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacaagcgaggacauauucgaggacgagcucauacacugggucaggcaagcgcccgggcaagggcucgaguggauaggcugggucaagaucgugagcgggaccgugaacuuugccucgcucgauuucaggaacaggaucucgcucucgcgcgaucgcgaucucucgaccgcguacauggacauacgcgggcucacgcaagaugacacggccacguacuuuugcgcgcgccagaaauuugccucgcgcuauagcggggaccagggcucguacuuugacuugugggggcgcgggaccuugaucguggucucgagc

SEQ ID NO: 56915 - RNA, 381 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacaagcgaggacauacucaaggccgagcucauauacugggucaggcaagcgcccgggcgcgggcucgaguggauaggcugggucaagaccgugagcgggaccgugaacuuuggcucgagcgauuucaggaacaggaucucgcucacgcgcgaucgcgaucucucgaccgcgcacauggacauacgagggcucacgcaagaugacacggccacguacuuuugcgcgcgccagaaauuugaaucgcucuauagcgaugaccagggcucguacuuugacuugugggggcgcgggaccuugaucauagucucgagc

SEQ ID NO: 56916 - RNA, 381 nt, Artificial Sequence
  derived and/or modified sequence opt11 from anti-HIV-1_HeavyChain
caaguccaacucguccaauccggcgccgaagucaaaaaacccggcgccuccgucaaagucuccugcaaagccuccggcuacuccuucaccgacuacuacauccacuggcuccgccaaguccaaggccaacgccccgaauggaugggcuggauccgcccccgcaccggcgcccgcaaccaagcccgccaauuccaaccccgcaucucacucacccgcgaccgcgcccucuccaccgccuaccucgaccucaacucccucaccuccgccgacuccggcaccuacuucugcgcccgccaaaccuucaaacccgacuucuacuucgccgaccaaggcugguccuucaaccucuggggccgcggcgcccacuucaucgucuccucc

SEQ ID NO: 56917 - RNA, 381 nt, Artificial Sequence
  derived and/or modified sequence opt11 from anti-HIV-1_HeavyChain
cagguguuuauggagcaggcggggggggaggugaagaagccgggggcgaguaugacggugaguuguaagacggcggaugaggauguguuugaugcggcguauaugcauugggugaggcaggcgccggggcagacguuugagugguugggguggaugaagccggugacgggggcggugaauuaugcgaggaaguuucaggggagggugagcuuuuauaggacgagggaguuggggauagcguauauggauuugagggauuugaaguuugaugauacggcgguguauuuuugugcgaggaagacgaagggggaugugagcggggaugauaggggguuuuuuuuugaucugugggggagggggacgagagugauagugaguagu

SEQ ID NO: 56918 - RNA, 384 nt, Artificial Sequence
  derived and/or modified sequence opt11 from anti-HIV-1_HeavyChain
caagcgcacuuggaacagagcggggccggagucaagaaaccgggcgcgagcgugcgcgugagcuguuggacgagcgaggacauauucgagcgaacggaauugauccauugggugcgccaggcaccgggccagggcuuggaauggaucgggugggugaaaacggucacgggcgcggucaauuucgggagcuuggacuuucgccaucgaaucagcuugaccagggacagagacuuguucacggcacauauggauauaaggggcuugacccagggcgauaccgcgaccuauuucugugccaggcaaaaguucgagagcagguacacgggcgggcaagggugguauuucgaucucuggggcaggggcacgcacauagucgugagcuca

SEQ ID NO: 56919 - RNA, 384 nt, Artificial Sequence
  derived and/or modified sequence opt11 from anti-HIV-1_HeavyChain
caggcccaucucgagcaaucgggcgcgggcgugaaaaagcccggggccucggucagggucucgugcuggagcucggaagauaucuuugaaaggaccgagcucauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuacagcgcacauggacauacgagggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 56920 - RNA, 384 nt, Artificial Sequence
  derived and/or modified sequence opt11 from anti-HIV-1_HeavyChain
cagagccaucucgagcaaucgggcucggccaugaaaaagcccggggccucggucagggucucgugcugggccucggaagauaucuucgacacgaccgagcucauauacugggucaggcaagcgcccgggcaagggcuagaguggauaggcugggucaagaucgugagcgggaccgugaacuucgccucgcucgauuucagaaacaggaucucgcucucgcgcgaucgcgaccuaucgaccgcguacauggacauacgcgggcucacgcaagaugacacggccacguacuuuugcgcgcgccagaaauuugccucgcgcuauagcggggaccagggcucguacuuugacuugugggggcgcgggaccuugaucguggucucgagc

SEQ ID NO: 56921 - RNA, 381 nt, Artificial Sequence
  derived and/or modified sequence opt11 from anti-HIV-1_HeavyChain
cgcugucgcuugguccagagcggggccgaggucaagaaaccgggcgcgagcgugcgcgugagcugucaagcgagcggguacacguucucggccuauggcgugaacuggguaaggcaagcgcccgggcaagagcucgaguggauaggcugggucaagaccgugaccggggcagugaacuuuggcucgcccaauuucaggcacaggaucucgcuaacgcgcgaucgcgaucucuuuaccgcgcacauggacauacgcgggcucacgcaaggggacacggccacguacuuuugcgcgcgccagaaauuugaaucgcgauauacagggggccagggcugguacuuugacuugugggggcgcgggacccauaucguggucucgagc

SEQ ID NO: 56922 - RNA, 384 nt, Artificial Sequence
  derived and/or modified sequence opt11 from anti-HIV-1_HeavyChain
caagcgcaccuggaacagagcgggagcggggucaagaaaccgggcgcgagcgugcgcgugagcuguuggucgagcgaggacauauucgagcgcacggaauugauccauugggugugccaggccccgggccagggcuuggaauggaucgggugggugaaaacggucacgggcgcggucaauuucgggagcuuggacuuucgccaucgcaucagcuugaccagggacagggaccuguucacggcccauauggauauaagaggcuugacccagggcgauaccgcgaccuauuucugugccaggcaaaaguucgagagcagguacacgggcgggcaagggugguauuucgaucucuggggcaggggcacgcacauaguagugagcucg

SEQ ID NO: 56923 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggucgagcgaggacauauucgagcgcacggaauugauccauugggugcgccaggccccgggccagggcuuggaauggauagggugggugaaaauagucacgggcgcggucaauuucgggagcuuggacuuucgccaucgaauaagccugaccagggacagggacuuguucacggcccauauggauauaaggggcuugacccagggcgauaccgcgaccuauuucugugccaggcaaaaguucgagagcagguacacgggcgggcaagggugguauuucgaucucuggggcaggggcacgcacauagucgugagcucg

SEQ ID NO: 56924 - RNA, 384 nt, Artificial Sequence
  derived and/or modified sequence opt11 from anti-HIV-1_HeavyChain
cagguccagcucgugcaaucgggcuuggaagugaaaaagcccggggccucggucagggucucgugcuggaccucggaagauaucuuugacacgaccgagcucauauacugggucaggcaagcgcccgggcaagggcucgaguggauaggcugggucaagaucgugagcgggaccgugaacuuugccucgcucgauuucaggaacaggaucucgcucucgcgcgaucgcgaucucucgaccgcgcacauggacauacgcgggcucacgcaagaugacacggcaacguacuuuugcgcgcgacagaaauuugccucacgcuauagcggggaccagggcucguacuuugacuugugggggcgcgggaccuugauaauagucucgagc

SEQ ID NO: 56925 - RNA, 384 nt, Artificial Sequence
  derived and/or modified sequence opt11 from anti-HIV-1_HeavyChain
caaucgcacuuggaacagagcgggagcgcgaugaagaaaccgggcgcgagcgugcgcguaagcuguuggacgagcgaggacauauucgauaccacggaacugaucuauugggugcgccaggccccgggccagggcuuggaauggaucgggugggugaaaauagucucgggcacggucaauuucgcgagcuuggacuuucgcaaucgcaucagcuugagcagggacagggaccugagcacggcccauauggauauaaggggcuugcgccaggacgauaccgcgacauauuucugugccaggcaaaaguucgagagcagguacucgggcgaucaagggagcuauuucgaucucuggggcagaggcacgcucauaaucgugagcucg

SEQ ID NO: 56926 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccauugggugcgccaggccccaggacagggcuuggaauggaucgggugggugaaaacggucacgggcgcggucaauuucgggagcucggacuuucgccagcgcgugagcuugaccagggacagggacuuguucacggcacauauggauaucaggggcuugacccagggcgauaccgcgaccuauuucugugccaggcaaaaguucgcgagcagguacucgggcgaucaagggagcuauuucgaucucuggggcaggggcacgcucauagucgugagcucg

SEQ ID NO: 56927 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggccuggaauggaucgggugggugaaaacggucacgggcgcggucaauuucgggagcccgaacuuucgccaucgcgugagccugaccagggacagggacuuguucacggcccauauggauaucagaggcuugacacagggcgauaccgcgaccuauuucugugccaggcaaaaguucgagagcagguacacgggcgggcaagggugguauuucgaucuauggggcaggggcacgcacauagucgugagcucg

SEQ ID NO: 56928 - RNA, 384 nt, Artificial Sequence
  derived and/or modified sequence opt11 from anti-HIV-1_HeavyChain
aggcacacgugggagcaaucaggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucucgaccgcguacauggacauacgcgggcucacgcaagaugacacggccacguacuuuugcgcgcgacagaaauuugccucgcgcuauaguggggaccagggcucguacuuugacuugugggggcgcgggaccuugaucguggucucgagc

SEQ ID NO: 56929 - RNA, 384 nt, Artificial Sequence
  derived and/or modified sequence opt11 from anti-HIV-1_HeavyChain
caaucacacuuggaacagagcgggagcgcgaugaagaaaccgggcgcgagcgugcgcgugagcuguuggacgagcgaggacauauucgauaccacggaauugaucuauugggugcgccaggccccgggccagggccuggaauggaucgggugggugaaaauagucucgggcacggucaauuucgcgagcuuggacuuucgcaaucgcaucagcuugagcagggacagggacuugagcacggccuauauggauauaaggggcuuaacccaggacgauaccgcgaccuauuucugugccaggcaaaaguucgagagcagguacacgggcgggcaagggugguauuucgaucucuggggcaggggcacgcacauagucgugagcucg

SEQ ID NO: 56930 - RNA, 384 nt, Artificial Sequence
  derived and/or modified sequence opt11 from anti-HIV-1_HeavyChain
cagguccagcucgugcaaucgggcgcggaagugaaaaagcccggggccucggucagggucucgugcuggaccucggaagauaucuuugacacgaccgagcucauauacuggguaaggcaagcgcccgggcaagggcucgaguggauaggcugggucaagaucgugagcgggaccgugaacuuugccucgcucgauuucaggaacaggaucucgcucucgcgcgaucgcgaucucucgaccgcgcacauggacauacgcgggcucacgcaagaugacacggccacguacuuuugcgcgcgccagaaauuugaaucgcgcuauaccgggggccagggcugguacuuugaccugugggggagagggacccauaucguggucucgagc

SEQ ID NO: 56931 - RNA, 384 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacgagcgaggacauauucgauaccacggaauugaucuauugggugcgccaggccccgggacagggcuuggaauggaucgggugggugaaaauagucucgggcacggucaauuucgcgagcuuggacuuucgcaaucgcaucagcuugagcagggacagggacuugagcacggcauauauggauauaaggggcuugacccagggcgauaccgcgaccuauuucugugccaggcaaaaguucgagagcagguacacgggcgggcaagggugguauuucgaucucuggggcaggggcacgcacauagucgugagcuca

SEQ ID NO: 56932 - RNA, 384 nt, Artificial Sequence
  derived and/or modified sequence opt11 from anti-HIV-1_HeavyChain
caagcccaccucgaacaauccggcuccggcgucaaaaaacccggcgccuccguccgcguauccugcuggaccuccgaagacaucuucgaacgcaccgaacucauccacuggguccgccaagcccccggccaaggccucgaauggaucggcugggucaaaaccgucucaggcgccgucaacuucggcucccccgacuuccgccaccgcaucucccucucccgcgaccgcgaccucuccaccgcccacauggacauccgcggccuaacccaagacgacaccgccaccuacuucugcgcccgccaaaaauucgccucccgcuacuccggcgaccaaggcucauacuucgaccucuggggccgcggcacccucaucaucgucuccucc

SEQ ID NO: 56933 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggcaggggcuuggaauggaucgggugggugaaaacggucucgggcacggucaauuucgggagcucggacuuucgcaaucgcgugagcuugaccagggacagggacuugagcacggcccauauggauaucagaggcuugacccaggacgauaccgcgaccuauuucugugccaggcaaaaguucgagagcuuguacucggacgaucaagggagcuauuucgaucuauggggcaggggcacgcucauaaucgugagcucg

SEQ ID NO: 56934 - RNA, 384 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggaccuccgaagacaucuucgaacgcaccgaacucauccacuggguccgacaagcccccggccaaggccucgaauggaucggcugggucaaaaccgucaccggcgccgucaacuucggcucccccaacuuccgcaaccgcaucucccucacccgagaccgcgaccuauccaccgcccacauggacauccgaggccucacccaagacgacaccgccaccuacuucugcgcccgccaaaaauucgaaucccucuacuccgacgaccaaggcuccuacuucgaccucuggggccgcggcacccucaucaucgucuccucc

SEQ ID NO: 56935 - RNA, 384 nt, Artificial Sequence
  derived and/or modified sequence opt11 from anti-HIV-1_HeavyChain
cagagccaucucgagcaaucgggcucggccaugaaaaggcccggggccucggucagggucucgugcuggaccucggaagauaucuuugacacgaccgagcucauauacugggucaggcaagcgcccgggcaagggcucgaguggauaggcugggucaagaucgugagcgggaccgugaacuuugccucgcucgauuucaggaacaggaucucgcucucgcgcgaucgcgaucucucgaccgcguacauggacauacgcgggcuaacgcaagaugacacagccacguacuuuugcgcacgccagaaauuugccucgcgcuauagcggggaccagggcucguacuuugacuugugggggcgcgggaccuugaucguggucucgagc

SEQ ID NO: 56936 - RNA, 384 nt, Artificial Sequence
  derived and/or modified sequence opt11 from anti-HIV-1_HeavyChain
caagcgcacuuggaacagagcgggagcggggucaagaaauugggcgcgagcgugcgagugagcuguuggacgagcgaggacauauucgagcgaacggaauugauccauugggugcgacaggcaccgggccagggcuuggaauggauagggugggugaaagcggucucgggagcggucaauuacgggagccuggacuuuagaaauagaauaagccugagcagggacagggacuugagcacggccuauauggauauaaggggcuugacccaggacgauaccgcgaccuauuucugugccaggcaaaaguucgcgagcagguacucgggagaucaagggagcuauuucgaucucuggggcaggggaacgcucauaguagugagcucg

SEQ ID NO: 56937 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggacgagcgaggacauauucgagcgaacggaauugauacauugggugcgacaggcaccgggacagggccuggaauggaucgggugggugaaaacggucacgggcgcggucaauuucgggagcuuggacuuucgccaucgcaucagcuugaccagggacagagacuuuuucacggcccauauggauauaaggggcuugacccagggcgauaccgcgaccuauuucugugccaggcaaaaguucgagagcagguacacgggcgggcaagggugguauuucgaucucuggggcaggggcacgcacauagucgugagcucg

SEQ ID NO: 56938 - RNA, 381 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggucgagcgaggacauauucaggaccgagcucauacacugggucaggcaagcgcccgggcaagggcucgaguggauaggcugggucaagaccgugaccggggccgugaacuuuggcucgcucgauuucaggcacaggaucucgcucacgcgcgaucgcgaucuauucaccgcgcacauggacauacgcgggcuaacgcaaggggacacagccacguacuuuugcgcgcgccagaaauuugaaucgcgcuauaccgggggccagggcugguacuuugaccugugggggcgcgggacccauaucguggucucgagc

SEQ ID NO: 56939 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgaacggaauugauccauugggugcgccaggccccgggccagggcuuggaauggaucgggugggugaaaacggucacgggcgcggucaauuucgggagcccgaacuuucgacaucgcgugagcuugaccagggacagggacuuguucacggcccauauggauaucaggggcuugacccagggcgauaccgcgaccuauuucugugccaggcaaaaguucgagagcuuguacucggacgaucaagggagcuauuucgaucucuggggcaggggcacgcucauaaucguaagcucg

SEQ ID NO: 56940 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucgucuccggcaccgucaacuucgccucccucgacuuccgcaaccgcaucucccucucccgcgaccgcgaccucuccaccgcccacauggacauccgcggccucacccaagacgacaccgccaccuacuucugcgcccgccaaaaauucgccucccgcuacuccggcgaccaaggcuccuacuucgaccucuggggccgcggcacccucaucaucgucuccucc

SEQ ID NO: 56941 - RNA, 384 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcucauauacugggucaggcaagcgcccgggcaagggcucgaguggauaggcugggucaagaucgugagcgggaccgugaacuuugccucgagcgauuucaggaacaggaucucgcucucgcgcgaucgcgaucucucgaccgcgcacauggacauacgcgggcucacgcaagaugacacggccacguacuuuugcgcgcgccagaaauuugccucgcgcuauagcggggaccagggcucguacuuugacuugugggggcgcgggaccuugaucguggucucgagc

SEQ ID NO: 56942 - RNA, 384 nt, Artificial Sequence
  derived and/or modified sequence opt11 from anti-HIV-1_HeavyChain
caggcccaucucgagcaaucgggcucgggcgucaaaaagcccggggccucgguaagggucucgugcuggaccucagaagauaucuuugaaaggaccgagcucauauacugggucaggcaagcacccgggcgcgggcucgaguggauaggcugggucaagaccgugagcgggaccgugaacuuuggcucgagcgauuucaggaacaggaucucgcucacgcgcgaucgagaucucucgaccgcgcacauggacauacgagggcucacgcaagaugacacggccacguacuucugcgcgcgccagaaauuugaaucacucuacagcgaugaccagggcucauacuuugaccugugggggcgcgggacccugaucauagucucgagc

SEQ ID NO: 56943 - RNA, 384 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcuaauacacugggucaggcaagcgcccgggcaagggcucgaguggauaggcugggucaagaccgugaccggggccgugaacuuuggcucgcucgauuucaggcacaggaucucgcucacgcgagaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 56944 - RNA, 384 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuucggcacgaccgagcucauauacugggucagacaagcgcccgggcaagggcucgaguggauuggcugggucaagaucgugagcgggaccgugaacuuugccucgcucgauuucagaaacaggaucucgcucucgcgcgaucgcgaucucucgaccgcguacauggacauacgcggacucacgcaagaugacacggccacguacuuuugcgcgcgccagaaauuugccucgcgcuauagcggggaccagggcucguacuuugacuugugggggcgcgggaccuugaucguagucucgagc

SEQ ID NO: 56945 - RNA, 384 nt, Artificial Sequence
  derived and/or modified sequence opt11 from anti-HIV-1_HeavyChain
caaguccaacucguccaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaauagucuccggcaccgucaacuucgccucccucgacuuccgcaaccgcaucucccucucccgcgaccgcgaccucuccaccgccuacauggacauccgcggccucacccaagacgacaccgccaccuacuucugcgcccgccaaaaauucgccucccgcuacuccggcgaccaaggcuccuacuucgaccucuggggccgcggcacccucaucgucgucuccucc

SEQ ID NO: 56946 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggacgagcgagggcauauucgagcgcacggaauugauccauugggugcgccaggccccgggccagggcuuggaauggaucgggugggugaaaacggucacgggcgcggucaauuucgggagcuuggacuuucgacaucgcaucagcuugaccagggacagggaccuguucacggcacauauggauauaaggggauugacccagggagauaccgcgaccuauuucugugccaggcaaaaguucgagagcagguacacgggcgggcaagggugguauuucgaucucuggggaaggggcacgcacauagucgugagcucg

SEQ ID NO: 56947 - RNA, 384 nt, Artificial Sequence
  derived and/or modified sequence opt11 from anti-HIV-1_HeavyChain
caagcgcaccuggaacagagcgggagcggggucaagaaaccaggcgcgagcgugcgcgugagcuguuggacgagcgaggacauauucgagcgcacggaacugauccauugggcgcgccaggccccgggccagggcuuggaauggaucgggugggugaaaacggucacgggcgcggucaauuucgggagcccgaacuuucgccaucgcgcgagcuugaccagggacagggacuuguucacggcccauauggauaucaggggcuugaccgagggcgauaccgcgaccuauuucugugccagacaaaaguucgcgagcagguacucgggcgaucaagggagcuauuucgaucucuggggcaggggcacgcucauaaucgugagcuca

SEQ ID NO: 56948 - RNA, 384 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacgagcgaggacauauucgauaccgcggaauugaucuauugggugcgccaggccccgggccagggcuuggaauggaucgggugggugaaaauagucucgggcacggucaauuucgcgagccuggacuuucgcaaucgcauaagccugagcagggacagggacuugagcacggcccauauggauaucaggggcuugcgccaggacgauaccgcgaccuauuucugugccaggcaaaaguucgagagcagguacucgggcgaucaagggagcuauuucgaucucuggggcaggggaacgcucauaaucgugagcuca

SEQ ID NO: 56949 - RNA, 384 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaacugauccauugggugcgccaggccccgggccagggcuuggaauggaucgagugggugaaagcggucucgggcgcggucaauuacgggagcuuggacuuucgccaucgagugagcuugaccagggacagggacuuguucacggcccauauggauaucaggggcuugacccaggacgauaccgcgaccuauuucugugccaggcaaaaguucgagagcagguacacgggcgggcaagggugguauuucgaucucuggggcaggggcacgcacauagucgugaguucg

SEQ ID NO: 56950 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagccccaggccaaggccucgaauggaucggcugggucaaaaucgucuccggcaccgucaacuucgccucccucgacuuccgcaaccgcaucucccucucccgagaccgcgaccuauccaccgccuacauggacauccgcggccucacccaagacgacaccgccaccuacuucugcgcccgacaaaaauucgccucccgcuacuccggcgaccaaggcuccuacuucgaccucuggggccgcggcacccucgacugcgucuccucc

SEQ ID NO: 56951 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacuaaucuacuggguccgacaagcccccggccaaggccucgaauggaucggcugggucaaaaucgucuccggcgccgucaacuucgcaucccucgacuuccgaaaccgcaucucccucucccgcgaccgcgaccucuccaccgcccacauggacauccgcggccucacccaagacgacaccgccaccuacuucugcgcccgccaaaaauucgccucccgcuacuccggcgaccaaggcuccuacuucgaccucuggggccgcggcacccucaucaucgucuccucc

SEQ ID NO: 56952 - RNA, 384 nt, Artificial Sequence
  derived and/or modified sequence opt11 from anti-HIV-1_HeavyChain
caggcgcacuuggagcagagcgggagcgggguaaagaagcugggggcgagcgugagggugaguuguuggacgagcgaggacauauucgagaggacggaguugauacauugggugaggcaggcgccggggcagggguuggaguggauagggugggugaaggcggugagcggggcggugaauuacgggagcuuggacuuuagacauagagugagcuugacgagggacagggacuugagcacggcgcauauggauauaaggggguugacgcagggggauacggcgacguauuucugugcgaggcagaaguucgagagcagguacacaggagggcaggggugguauuucgaucugugggggagggggacgcacauagugguaagcagu

SEQ ID NO: 56953 - RNA, 384 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucucaaccgcgcacauggacauacgcgggcucacgcaagaugacacggccacguacuuuugcgcgcgccagaaauucgaaucgcucuauagcgaugaccagggcucguacuuugacuugugggggcgcgggaccuugaucauagucucgagc

SEQ ID NO: 56954 - RNA, 384 nt, Artificial Sequence
  derived and/or modified sequence opt11 from anti-HIV-1_HeavyChain
caagcgcacuuggaacagagcgggagcggggucaagaaaccgggagcgagcgugcgagugagcuguuggacgagcgaggacauauucgagcgcacagaauugauccauugggugcgccaggccccgggccagggcuuggaauggaucgggugggugaaaacggucacgggcacggucaauuucgggagccugaacuuucgccaucgcaucagcuugaccagggacagggacuuguucacggcccauauggauauaaggggcuugacccagggcgauaccgcgaccuauuucugugccagacaaaaguucgagagcagguacacgggcgggcaagggugguauuucgaucucuggggaaggggcacgcacauagucgugagcucg

SEQ ID NO: 56955 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgaacgcaccgaacucaucuacuggguccgccaagcccccggccgcggccuagaauggaucggcugggucaaaaucgucuccggcaccgucaacuucgccucccucgacuuccgcaaccgaaucucccucucccgcgaccgcgaccucuccaccgcccacauggacauccgcggccucacccaagacgacaccgccacauacuucugcgcccgccaaaaauucgccucccgcuacuccggcgaccaaggcuccuacuucgaccucuggggccgcggcacacucaucaucgucuccucc

SEQ ID NO: 56956 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacacaaccgaacucaucuacuggguccgccaagcccccggccaaggccucgaauggaucggcugggucaaaaucgucuccggcaccgucaacuucgccucccuagacuuccgaaaccgcaucucccucucccgcgaccgcgaccucuccaccgccuacauggacauccgcggccucacccaagacgacaccgccaccuacuucugcgcccgccaaaaauucgccucccgcuacuccggcgaccaaggcuccuacuucgaccucuggggccgcggcacccuaaucaucgucuccucc

SEQ ID NO: 56957 - RNA, 384 nt, Artificial Sequence
  derived and/or modified sequence opt11 from anti-HIV-1_HeavyChain
caagcgcgcuuggaacagagcgggagcggggucaagaaauugggcgcgagcgugcgcgugagcuguuggacgagcgaggacauauucgagcgcacggaauugauccauugggugcgacaggccccgggccagggcuuggaauggaucgggugggugaaagcggucucgggcgcggucaauuacgggagcuuggacuuucgcaaucgcaucagcuugagcagggacagggacuugagcacagccuauauggauauaaggggcuugacacaggacgauaccgcgaccuauuucugugccaggcaaaaguucgcgagcagguacucgggcgaucaagggagcuauuucgaucucuggggcaggggcacgcucauaguagugagcucg

SEQ ID NO: 56958 - RNA, 384 nt, Artificial Sequence
  derived and/or modified sequence opt11 from anti-HIV-1_HeavyChain
caggcccaucucgagcaaucgggcucggccaugaaaaagcccggggccucggucagggucucgugcuggaccucagaagauaucuuugacacgaccgagcucauauacugggucaggcaagcgcccgggcaagggcucgaguggauaggcugggucaagaucgugagcgggaccgugaacuuugccucgcucgacuucaggaacaggaucucgcucucgagagaccgcgaucucucgaccgcgcacauggacauacgagggcuaacgcaagaugacacggccacguacuuuugcgcgcgccagaaauuugccucgcgcuauagcggggaccagggcucguacuuugaccugugggggcgcgggaccuugaucauagucucgagc

SEQ ID NO: 56959 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggucgagcgaggacauauucgagcgcacggaauugauacauugggugcgccaggccccgggccagggcuuggaauggaucgggugggugaaaacggucacgggcgcggucaauuucgggagcuuggacuuucgccaucgcaucagcuugaccagggacagggaccugagcacggccuauauggauauaaggggauugacccaggacgauaccgcgaccuauuucugugccaggcaaaaguucgcgagcagguacucgggcgaucaagggagcuauuucgaucucuggggcaggggcacgcuaauagucgugagcucg

SEQ ID NO: 56960 - RNA, 384 nt, Artificial Sequence
  derived and/or modified sequence opt11 from anti-HIV-1_HeavyChain
caggcccaucucgagcaaucgggcucgggcgugaaaaagcccggggccucggucagggucucgugcuggagcucggaagauaucuuugaaaggaccgagcucauacacugggucaggcaagcgcccgggcaagggcucgaguggauaggcugggucaagaccgugaccggggccgcgaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 56961 - RNA, 384 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggagcgagcucauacacugggucaggcaagcgcccgggcaagggcuagaguggauaggcugggucaagaccgugaccggggccgugaacuuuggcucgcucgauuucaggcacaggaucucgcucacgcgagaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 56962 - RNA, 381 nt, Artificial Sequence
  derived and/or modified sequence opt11 from anti-HIV-1_HeavyChain
agguguauauggaggcaggcgggggggggggugaagaagccgggggcgagcgugacguugaguuguaagacggcggaugaggauguguuugaugcggcguauaugcauugggugaggcaggcgccggggcagacguuugagugguugggguggaugaagccggugacgggggcggugaguuaugcgaggaaguuucaggggagggugaguuuuuauaugacgagggggauaaggauggcguauauggauuugaggaauuugagguuugaugauacggcgguguauuuuugugcgaggaagacggcgggggacgugaguggggauaauaggggguauuuuuuugauuugugggggagggggaguagggugauagugaguagu

SEQ ID NO: 56963 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgaacgcaccgaacucaucuacuggguccgccaagcccccggccgcggccucgaauggaucggcugggucaaaaucgucagcggcaccgucaacuucgccucccucgacuuccgaaaccgaaucucacucucccgcgaccgcgaccucuccaccgccuacauggacauccgcggccucacccaagacgacaccgccaccuacuucugcgcccgccaaaaauucgccucccgcuacucaggcgaccaaggcuccuacuucgaccucuggggacgcggcacccucaucgucgucuccucc

SEQ ID NO: 56964 - RNA, 384 nt, Artificial Sequence
  derived and/or modified sequence opt11 from anti-HIV-1_HeavyChain
cagagccaucucgagcaaucaggcucggccaugaaaaagcccggggccucggucagggucucgugcuggaccucagaagauaucuuugaaaggaccgagcucauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauacgcgggcuaacgcaaggggacacggccacguacuuuugcgcgcgacagaaauuugaaucgcgcuauaccgggggccagggcugguacuuugacuugugggggcgcgggacccauaucguggucucaagc

SEQ ID NO: 56965 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcccccggacaaggccucgaauggaucggcugggucaaaaucgucuccggcaccgucaacuucgccucccucgacuuccgcaaccgcauaucccucucccgagaccgcgaccucuccgccgcccacauggacauccgcggccucacccaagacgacaccgccaccuacuucugcgcccgccaaaaauucgccucccgcuacuccggcgaccaaggcuccuacuucgaccuauggggccgcggcacccucaucaucgucuccucc

SEQ ID NO: 56966 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggacgagcgaggacauauucgagcgcacggaauugauccauugggugcgccaggccccgggccagggccuggaauggaucgggugggugaaaauagucucgggcgcggucaauuucgggagcccgaacuuucgccagcgcgugagcuugaccagggacagggacuuguucacggcccauauggauaucaggggcuugacccagggcgauaccgcgaccuauuucugugccaggcaaaaguucgcgagcagguacucgggcgaucaagggagcuauuucgaucucuggggcaggggcacgcucauagucgugagcucg

SEQ ID NO: 56967 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggucgagcgaggacauauucgagcgcacagaauugauccauugggugcgccaggccccgggccagggccuggaauggaucgggugggugaaaacggucacgggcgcggucaauuucgggagcuuggacuuucgccaucgcaucagcuugaccagggacagggaccuguucacggcccauauggauauaaggggcuugacccagggcgauaccgcgaccuauuucuguaccaggcaaaaguucgagagcagguacacgggcgggcaaggaugguauuucgaucucuggggcaggggcacgcacauagucgugagcucg

SEQ ID NO: 56968 - RNA, 384 nt, Artificial Sequence
  derived and/or modified sequence opt11 from anti-HIV-1_HeavyChain
caagcgcaccuggaacagagcgggagcggagucaagaaaccgggcgcgagcgugcgcgugagcuguuggucgagcgaggacauauucgagcgcacggaauugauccauugggugcgccaggccccgggccagggcccggaauggaucgggugggugaaaacggucacgggcgcggucaauuucgggagcuuggacuuucgccaucgcaucagcuugacaagggacagggacuuguucacggcccauauggauauaagaggccugacccagggcgauaccgcgaccuauuucugugccaggcaaaaguucgagagcagguacacgggagggcaagggugguauuucgaucuauggggcaggggcacgcacauagucgugagcucg

SEQ ID NO: 56969 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggucgagcgaggacauauucgagcgcacggaauugauccauugggugcgccaggcaccgggccagggccuggaauggaucgggugggugaaaacagucacgggcgcggucaauuucgggccauuggacuuucgacaucgcaucagcuugaccagggacagggacuuguucacggcccauauggauauaaggggacugacccagggagauaccgcgaccuauuucugugccaggcaaaaguucgagagcagguacacgggagggcaagggugguauuucgaucucuggggaaggggaacgcacauagucgugagcucg

SEQ ID NO: 56970 - RNA, 384 nt, Artificial Sequence
  derived and/or modified sequence opt11 from anti-HIV-1_HeavyChain
caaucccaccucgaacaaucaggccccgccaugaaaaaacccggcgccuccguccgcgucagcugcuggaccuccgaagacaucuucgaacgcaccgaacucaucuacuggguccgccaagcccccggccgcggccucgaauggaucggcugggucaaaacagucuccggcacagucaacuucggcuccuccgacuuccgaaaccgcaucucccuaacccgcgaccgcgaccucuccaccgcccacauggacauccgcggccucacccaagacgacaccgccaccuacuucugcgcccgccaaaaauucgaaucacucuacuccgacgaccaaggcuccuacuucgaccucuggggccgcggcacccucaucaucgucuccucc

SEQ ID NO: 56971 - RNA, 384 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcucauauacugggucagacaagcgcccgggcaagggcucgaguggauaggcugggucaagaucgugagcgggaccgugaacuuugccucgcucgauuucaggaacaggaucucgcucucgcgagaucgcgggcucucgaccgcgcacauggacauacgcgggcucacgcaagaugacacggccacguacuuuugcgcgcgccagaaauuugccucgcgcuauagcggggaccagggcucauacuuugaccugugggggcgcgggacccugaucauagucucaagc

SEQ ID NO: 56972 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaacugauccauugggugcgccaggccccgggccagggcuuggaauggaucgggugggugaaaacggucucgggcgcggucaauuucgggagcccgaacuuucgccaucgagugagcuugaccagggacagggaccuguucacggcccauauggauaucaggggcuugacccagggcgauaccgcgaccuauuucugugccaggcaaaaguucgcgagcagguacucgggcgaucaagggagcuauuucgaucucuggggcaggggcacgcuaauaaucgugagcucg

SEQ ID NO: 56973 - RNA, 384 nt, Artificial Sequence
  derived and/or modified sequence opt11 from anti-HIV-1_HeavyChain
caaucccaccucgaacacuccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucgucuccggcaccgucaacuucgcaucccucgacuuccgcaaccgcaucucacucucccgcgaccgagaccucuccaccgccuacauggacauccgcggccucacccaagacgacaccgccaccuacuucugcgcccgccaaaaauucgccucccgcuacuccggcgaccaaggcuccuacuucgaccucuggggccgcggcacccucaucgucgucuccucc

SEQ ID NO: 56974 - RNA, 384 nt, Artificial Sequence
  derived and/or modified sequence opt11 from anti-HIV-1_HeavyChain
caagcgcaccuggaacagagcgggagcggggucaagaaaccgggcgcgagcgugcgcgugagcuguuggacgagcgaggacauauucgagcgcacggaauugauccauuggguacgccaggccccgggccagggccuggaauggaucgggugggugaaaauagucucgggcgcggucaauuucgggagcccgaacuuucgccagcgcgugagcuugaccagggacagagaccuguucacggcccauauggauaucaggggcuugacccagggcgauaccgcgaccuauuucugugccagacaaaaguucgagagccuguacucggacgaucaagggagcuauuucgaucucuggggcaggggcacgcucauaaucgugagcucg

SEQ ID NO: 56975 - RNA, 384 nt, Artificial Sequence
  derived and/or modified sequence opt11 from anti-HIV-1_HeavyChain
caagcccaccucgaacaauccggcuccggcgucaaaaaacccggcgccuccguccgcgucucaugcuggaccuccgaagacaucuucgaacgcaccgaacucauccacuggguccgccaagcccccggacaaggccucgaauggaucggcugggucaaaaccgucuccggcgccgucaacuucggcucccccaacuuccgccaccgcaucucccucacccgcgaccgcgaccucuucaccgcccacauggacauccgcggccuaacccaaggcgacacagccaccuacuucugcgcccgccaaaaauucgaaucccgauacacaggcggccaaggcugguacuucgaccucuggggccgcggcacccacaucgucgucuccucc

SEQ ID NO: 56976 - RNA, 384 nt, Artificial Sequence
  derived and/or modified sequence opt11 from anti-HIV-1_HeavyChain
caagcgcacuuggaacagagcgcgagcggggucaggcgaccgggcgcgagcgugcgcgugagcuguuggacgagcgaggacauauucgagcgcucagaauugaucuauugggugcgccaggccccgggcaggggcuuggaauggaucggguggauaaaauuggucucgggagcggucaauuucgggagcguggacuuucgcaaucgcaucagcuugagcagggacagggaccugagcacggcccauauggauauaaggggcuugcgccaggacgauaccgcgaccuauuucugugccaggcaaaaguucgagagcagguacucgggcgaucaagggagcuauuucgaucucuggggcaggggcacgcucauaauagugagcucg

SEQ ID NO: 56977 - RNA, 384 nt, Artificial Sequence
  derived and/or modified sequence opt11 from anti-HIV-1_HeavyChain
caagcgcacuuggaacagagcgcgagcggggucaagcgaccgggcgcgagcgugcgcgugagcuguuggacgagcgaggacauauucgagcgcacggaauugaucuauugggugcgccaggccccgggccagggcuuggaauggaucgggugggugaaaacggucucgggcgcggucaauuucgggagccaggacuuucgcgaucgcuuuagcuugaccagagacagggacuugagcacggcccauauggauaucaggggcuugacccaggacgauaccgcgaccuauuucugugccaggcaaaaguucgcgagcagguacucgggcgaucaagggagcuauuucgaucucuggggcaggggcacgcucauaaucgugagcuca

SEQ ID NO: 56978 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaacugauccauugggugcgccaggccccgggccagggcuuggaauggaucgggugggugaaaacggucacgggcgcggucaauuucgggagcuuggacuuucgccaucgcauaagccugaccagagacagggaccuguucacggcccauauggauaucaggggcuugacccagggcgauaccgcgaccuauuucugugccaggcaaaaguucgagagcagguacacgggcgggcaagggugguauuucgaucucuggggcagaggcacgcacauagucgugagcucg

SEQ ID NO: 56979 - RNA, 384 nt, Artificial Sequence
  derived and/or modified sequence opt11 from anti-HIV-1_HeavyChain
caagcccaccuagaacaauccggcuccggcgucaaaaaacccggcgccuccguccgcgucuccugcuggaccuccgaagacaucuucgaacgcaccgaacucauccacuggguccgccaagcccccggccaaggccucgaauggaucggcugggucaaaaccgucuccggcgccgucaacuucggcucccccaacuuccgccaccgcgucucccuaacccgcgaccgcgaccucuucaccgcccacauggacauccgcggccucacccaagacgacaccgccaccuacuucugcgcccgccaaaaauucgaaucccucuacuccgacgaccaaggcuccuacuucgaccucuggggccgcggcacacucaucaucgucuccucc

SEQ ID NO: 56980 - RNA, 384 nt, Artificial Sequence
  derived and/or modified sequence opt11 from anti-HIV-1_HeavyChain
caaucccaccucaaacaauccggcuccgccaugaaaaaacccggcgccuccguccgcgucucaugcuggaccuccgaagacaucuucgaacgcaccgaacucaucuacuggguccgccaagcccccggccgcggccucgaauggaucggcugggucaaaaccgucuccggcaccgucaacuucggcuccuccgacuuccgcaaccgcaucucccucacccgcgaccgcgaccucuccaccgcccacauggacauccgcggccucacccaagacgacaccgccaccuacuucugcgcccgccaaaaauucgaaucccucuacuccgacgaccaaggcuccuacuucgaccucuggggccgcggcacccucaucaucgucuccucc

SEQ ID NO: 56981 - RNA, 384 nt, Artificial Sequence
  derived and/or modified sequence opt11 from anti-HIV-1_HeavyChain
caggcccaucucgagcaaucgggaucgggcgugaaaaagccaggagccucggucagggucucgugcuggagcucggaagauaucuuugaaaggaccgagcucauacacugggucaggcaagcgcccgggcaagggcucgaguggauaggcugggucaagaccgugaccggggccgugaacuuuggcucgcucgauuucaggcacaggaucucacucacgcgcgaucgcgaucucucgaccgcgcacauggacauacgcgggcucacgcaagaugacacggccacguacuuuugcgcgcgccagaaauuugccucgcgcuauagcggggaccagggcucguacuuugacuugugggggcgcgggaccuugaucauagucucgagc

SEQ ID NO: 56982 - RNA, 384 nt, Artificial Sequence
  derived and/or modified sequence opt11 from anti-HIV-1_HeavyChain
caagcgcacuuggaacagagcgggagcggggucaagaaauugggagcgagcgugcgcgugagcuguuggacgagcgaggacauauucgagcgcacggaauugauccauugggugcgacaggcaccgggccagggccuggaauggaucgggugggugaaagcggucucgggcgcggucaauuacggaagccuggacuuucgccaucgcgugagcuugaccagggacagggacuuguucacggcccauauggauaucaggggcuugacccaggacgauaccgcgaccuauuucugugccaggcaaaaguucgagagcagguacacgggagggcaagggugguauuucgaucucuggggcaggggaacgcacauagucgugagcucg

SEQ ID NO: 56983 - RNA, 384 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggaccuccgaagacaucuucgaacgcaccgaacuaauccacuggguccgccaagcccccggacaaggccucgaauggaucggcugggucaaaaccguaaccggcgccgucaacuucggcucccccaacuuccgccaccgcgucucacucacccgcgaccgcgaccucuucaccgcccacauggacauccgcggccucacccaagacgacaccgccacauacuucugcgcccgccaaaaauucgaaucacucuacucagacgaccaaggcuccuacuucgaccucuggggccgcggcacccuaaucaucgucuccucc

SEQ ID NO: 56984 - RNA, 384 nt, Artificial Sequence
  derived and/or modified sequence opt11 from anti-HIV-1_HeavyChain
cagagccaucucgagcaaucgggcucggccaugaaaaagcccggggccucggucaggguaucgugcuggaccucggaagauauccuggaaaggaccgagcucauauacugggucaggcaagcgcccgggcgcgggcucgaguggauaggcugggucaagaccgugagcgggaccgugaacuuuggcucgagcgauuucaggaacaggaucucgcuaacgcgcgaucgcgaucucucaaccgcgcacauggacauacgcgggcuaacgcaagaugacacggccacguacuuuugcgcgcgccagaaauuugaaucgcucuauagcgaugaccagggcucguacuuugacuugugggggcgcgggaccuugaucauagucucgagc

SEQ ID NO: 56985 - RNA, 384 nt, Artificial Sequence
  derived and/or modified sequence opt11 from anti-HIV-1_HeavyChain
caagcccaccucgaacaauccggcuccggcgucaaaaaacccggcgccuccguccgcgucucaugcuggaccuccgaagacaucuucgaacgcaccgaacucauccacuggguccgccaagcccccggccaaggccucgaauggaucggcugggucaaaaccgucaccggcgccgucaacuucggcucccccaacuuccgccaacgcgucucccucacccgcgaccgcgaccuauucaccgcccacauggacauccgcggccucacccaaggcgacaccgccaccuacuucugcgcccgccaaaaauucgccucccgcuacuccggcgaccaaggauccuacuucgaccucuggggccgcggcacccucaucgucgucuccucc

SEQ ID NO: 56986 - RNA, 384 nt, Artificial Sequence
  derived and/or modified sequence opt11 from anti-HIV-1_HeavyChain
caagcgcacuuggaacagagcgggagcggggucaagaaaccaggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgacaucgcaucagcuugaccagggacagggacuuguucacggcccauauggauauaaggggccugacccagggcgauaccgcgaccuauuucugugccaggcaaaaguucgagagcagguacacgggcgggcaagggugguauuucgaucucuggggcagaggcacgcacauagucgugagcucg

SEQ ID NO: 56987 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaugacauauucgagcgcacggaacugauccauugggugcgccaggccccgggccagggcuuggaauggaucgggugggugaaaacggucacgggcgcggucaauuucgggagcccgaacuuucgccagcgcgugagcuugaccagggacagggaccuguucacggcccauauggauaucaggggccugacccagggcgauaccgcgaccuauuucugugccaggcaaaaguucgagagcagguacacgggcgggcaagggugguauuucgaucucuggggcaggggcacgcacauagucgugagcucg

SEQ ID NO: 56988 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacauauucgacaccaccgaacucaucuacuggguccgccaagcccccggccaaggccucgaauggaucggcugggucaaaaucgucuccggcaccgucaacuucgccucccucgacuuccgcaaccgcaucucccucucccgcgaccgcgaccucuccaccgcccacauggacauccgcggccucacccaagacgacaccgccaccuacuucugcgcccgacaaaaauucgccucccgcuacuccggcgaccaaggcuccuacuucgaccucuggggccgcggcacccucaucgucgucuccucc

SEQ ID NO: 56989 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgaacggaauugauccauugggugcgccaggccccgggccagggccuggaauggaucgggugggugaaaacggucacgggcgcggucaauuucgggagcccaaacuuucgcaaucgcaucagcuugagcagggacagggacuugagcacggcccauauggauauaaggggauugacccaggacgauaccgcgaccuauuucugugcaaggcaaaaguucgcgagcagguacucgggcgaucaagggagcuauuucgaucucuggggcaggggcacgcucauaaucgugagcucg

SEQ ID NO: 56990 - RNA, 384 nt, Artificial Sequence
  derived and/or modified sequence opt11 from anti-HIV-1_HeavyChain
caggcccaucucgagcaaucggccucgggcgugaaaaggcccggggccucggucagggucucgugcuggaccucggaagauaucuuugaaaggaccgagcucauauacugggucaggcaagcgcccgggcaagggcucgaguggauaggcugggucaagaccgugaccggggccguaaacuuuggcucgcucgauuucaggcacaggaucucgcucacgcgagaucgcgaucucuuuaccgcgcacauggacauacgcgggcuaacgcaaggggacacggccacguacuuuugcgcacgccagaaauuugaaucgcgcuauaccgggggccagggcugguacuuugacuugugggggcgcgggacccauaucguggucucgagc

SEQ ID NO: 56991 - RNA, 384 nt, Artificial Sequence
  derived and/or modified sequence opt11 from anti-HIV-1_HeavyChain
caggcccaucucgagcaaucggccucgggcgugcgcaggcccggggccucggucagggucucgugcuggaccucggaagauaucuuugaaaggagcgagcucauauacuggguaaggcaagcgcccgggcgcgggcucgaguggauaggcuggaucaagcucgugagcggggccgugaacuuuggcucggucgauuucagggacagggucucgcucacgcgcgaucgcgaucuauuuaccgcgcacauggacauacgcgggcucacgcaagaugacacggccacguacuuuugcgcgcgccagaaauuugccucgcgcuauagcggggaccagggcucguacuuugacuugugggggcgcgggaccuugaucauagucucgagc

SEQ ID NO: 56992 - RNA, 384 nt, Artificial Sequence
  derived and/or modified sequence opt11 from anti-HIV-1_HeavyChain
caagcgcacuuggaacagagcgggagcggggucaagaaaccgggagcgagcgugcgcgugagcuguuggacgagcgaggacauauucgagcgcacggaauugauccauugggugcgacaggccccgggccagggcuuggaauggaucgggugggugaaaacggucucgggcacggucaauuucgcgagcuuggacuuucgcaaucgcaucagcuugagcagggacagagacuugagcacggccuauauggauauaaggggccugacccaggacgauaccgcgaccuauuucugugccaggcaaaaguucgcgagcagguacucgggcgaucaagggagcuauuucgaucucuggggcaggggcacgcuaauagucgugagcucg

SEQ ID NO: 56993 - RNA, 384 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcacccggacaagggcucgaguggauaggcugggucaagaccgugagcggggccgugaacuuuggcucgcccaauuucaggcacaggaucucgcucucgcgcgaucgcgaucucucgaccgcguacauggacauacgagggcucacgcaagaugacacggccacguacuuuugcgcgcgccagaaauuugccucgcgcuauagcggggaccagggcucguacuuugacuugugggggcgcgggaccuugaucguggucucgagc

SEQ ID NO: 56994 - RNA, 384 nt, Artificial Sequence
  derived and/or modified sequence opt11 from anti-HIV-1_HeavyChain
caagcgcacuuggaacagagcgggagcggggucaagaaaccgggcgcgagcguacgcgugagcuguuggucgagcgaggacauauucgagcgcacggaauugauccauugggugcgccaggccccgggccagggccuggaauggaucgggugggugaaaacggucacgggcgcggucaauuucgggagcuuggacuuucgccaucgcauaagcccgaccagggacagggaccuguucacggcacauauggauaucaggggcuugacccagggcgauaccgcgaccuauuucugugcaaggcaaaaguucgagagcagguacacgggcgggcaagggugguauuucgaucucuggggcaggggcacgcucauagucgugagcucg

SEQ ID NO: 56995 - RNA, 384 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcucauauacugggucaggcaagcgcccgggcaagggcuagaguggauaggcugggucaagaucgugagcgggaccgugaacuuugccucgcucgauuucaggaacaggaucucgcucucgcgcgaucgcgaucucccgaccgcguacauggacauacgcgggcucacgcaagaugacacggccacguacuuuugcgcgcgccagaaauuugccucgcgcuauagcggggaccagggcucguacuuugaccugugggggcgcgggaccuugaucguggucucgagc

SEQ ID NO: 56996 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucgccagcggcaccgucaacuucgccucccucgacuuccgcaaccgaaucucccucucccgcgaccgcgaccucuccacagcccacauggacauccgcggccucacccaagacgacaccgccaccuacuucugcgcccgccaaaaauucgccucccgcuacuccggcgaccaaggcuccuacuucgaccucuggggccgcggcacccucaucgucgucucaucc

SEQ ID NO: 56997 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaccgucaccggcgccgucaacuucggcucccucgacuuccgccaccgaaucucccucacccgcgaccgagaccucuucaccgcacacauggacauccgcggccucacccaaggcgacaccgccaccuacuucugcgcccgccaaaaauucgaaucccgcuacaccggcggccaaggcugguacuucgaccucuggggccgcggcacccacaucgucgucuccucc

SEQ ID NO: 56998 - RNA, 384 nt, Artificial Sequence
  derived and/or modified sequence opt11 from anti-HIV-1_HeavyChain
caaguccaacucguccaauccggcgccgaagucaaaaaacccggcgccucaguccgcgucuccugcuggaccuccgaagacaucuucgacaccaccgaacucaucuacuggguccgccaagcccccggccaaggccucgaauggaucggcugggucaaaaucgucuccggcaccgucaacuucgccucccuagacuuccgcaaccgcaucucccucucccgcgaccgcgaccucuccaccgcccacauggacauccgcggccuccgccaagacgacaccgccaccuacuucugcgcccgacaaaaauucgaaucccgcuacuccggcgaccaaggcuccuacuucgaccucuggggccgcggcacccucaucaucgucuccucc

SEQ ID NO: 56999 - RNA, 384 nt, Artificial Sequence
  derived and/or modified sequence opt11 from anti-HIV-1_HeavyChain
cagagccaucucgagcaaucgggcucagccaugaaaaagcccggggccucggucagggucucgugcuggacaucggaagauaucuucgacacgaccgagcucauauacugggucaggcaagcgcccggacaagggcucgaguggauaggcugggucaagaucgugagcggaaccgugaacuuugccucgcucgauuucaggcacaggaucucgcuaacgcgcgaccgcgaccucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 57000 - RNA, 384 nt, Artificial Sequence
  derived and/or modified sequence opt11 from anti-HIV-1_HeavyChain
caagcgcacuuggaacagagcgcgagcggggucaaacgaccgggagcgagcguacgcgugagcuguuggacgagcgaggacauauucgagcgcucggaauugaucuauugggugcgccaggccccgggccagggcuuggaauggaucgggugggugaaaacggucacgggcgcggucaauuucgggagcuuggacuuucgccaucgaaucagcuugaccagggacagggacuuguucacggcccauauggauauaaggggcuugacccagggcgauaccgcgaccuauuucugugccaggcaaaaguucgagagcagguacacgggcgggcaagggugguauuucgaucucuggggcaggggcacgcacauagucgugagcucg

SEQ ID NO: 57001 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccauugggugcgccaggccccgggccagggccuggaauggaucgggugggugaaaacggucacgggcgcggucaauuucgggagcucggacuuucgccagcgcgugagccugaccagggacagggacuuguucacggcccauauggauaucaggggccugacccagggcgauacagcgaccuauuucugugccaggcaaaaguucgagagcuuguacucagacgaucaagggagcuauuucgaucucuggggcaggggcacgcucauaaucgugagcucg

SEQ ID NO: 57002 - RNA, 384 nt, Artificial Sequence
  derived and/or modified sequence opt11 from anti-HIV-1_HeavyChain
caaucccaccucgaacaauccggcucagccaugaaaaaacccggcgccuccguccgcguauccugcuggaccucagaagacaucuucgaacgcaccgaacucaucuacuggguacgccaagcccccggccgaggccucgaauggaucggcugggucaaaaccgucuccggcaccgucaacuucggcuccuccgacuuccgcaaccgcaucucccucacccgcgaccgcgaccuauccaccgcccacauggacauccgcggacucacccaagacgacaccgccaccuacuucugcgcccgccaaaaauucgaaucccucuacucagacgaccaaggcuccuacuucgaccucuggggccgcggcacccuaaucgucgucuccucc

SEQ ID NO: 57003 - RNA, 384 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgaacggaauugauccauugggugcgccaggccccgggccagggcuuggaauggaucgggugggugaaagcggucucgggcgcggucaauuacgggagcuuggacuuucgccaucgagugagcuugacaagggacagggacuuguucacggcccauauggauaucaggggcuugacccagggcgauaccgcgaccuauuucugugccaggcaaaaguucgagagcagguacacgggcgggcaagggugguauuucgaucucuggggcagaggcacgcacauagucgugagcuca

SEQ ID NO: 57004 - RNA, 381 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauacucaggaaaucggaauugauccauugggugcgccaggccccgggccagggcuuggaauggaucgggugggugaaaacggucacgggcgcggucaauuucgggcaccagaucucggacagggucucgcucacgcgcgaucgcgaucucucgacagcgcacauggacauacgcgggcucacgcaagaugacacggccacauacuuuugcgcgcgccagaaauuugaaucgcucuauagcgaugaccagggcucguacuuugacuugugggggcgcgggaccuugaucauagucucgagc

SEQ ID NO: 57005 - RNA, 384 nt, Artificial Sequence
  derived and/or modified sequence opt11 from anti-HIV-1_HeavyChain
ccggcccaucucgagcaaucgggcucgggcgugaaaaagcccggggccucggucagggucucgugcugggccucggaagauaucuucgaaaggaccgagcucauacacugggucaggcaagcgcccgggcaagggcuagaguggauaggcugggucaagaccgugaccggggccgugaacuuuggcucgcucgauuucaggcacaggaucucgcucacgcgcgaucgcgaucuauuuaccgcgcacauggacauacgagggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 57006 - RNA, 384 nt, Artificial Sequence
  derived and/or modified sequence opt11 from anti-HIV-1_HeavyChain
caagcgcacuuggaacagagcgcgagcggggucaagcgcccgggcgcgagcgugcgcgugagcuguuggacgagcgaggacauauucgagcgcucggaauugaucuauugggugcgccaggccccgggccagggcuuggaauggaucgggugggugaaaacggucucgggcgcggucaauuucgggagcacggacuuucgcgagcgcaucagcuugagcagggacagggacuugagcacggccuauauggauauaaggggcuugacccaggacgaugccgcgaccuauuucugugccaggcaaaaguucgcgagcagguacucgggcgaucaagggagcuauuucgaucucuggggcaggggcacgcucauagucgugagcucg

SEQ ID NO: 57007 - RNA, 384 nt, Artificial Sequence
  derived and/or modified sequence opt11 from anti-HIV-1_HeavyChain
caggcccaucucgagcaaucgggcucgggcgugaaaaagcccggggccucggucagggucucaugcuggagcucggaagauaucuuugaaaggaccgagcucauacacugggucaggcaagcgcccgggcaagggcucgaguggauaggcugggucaagaccgugaccggggccgugaacuuuggcucgcucgaucucaggcacaggaucucgcucacgcgcgaucgcgaucucuuuacagcgcacauggacauacgcgggcuaacgcaaggggacacggccacguacuuuugcgcgcgccagaaauuugaaucgcgcuauaccgggggccagggcugguacuuugaccugugggggcgcgggacccauaucguggucucgagc

SEQ ID NO: 57008 - RNA, 384 nt, Artificial Sequence
  derived and/or modified sequence opt11 from anti-HIV-1_HeavyChain
caagcccaccucgaacaaucaggcuccggcgucaaaaaacccggcgccuccguccgcgucuccugcuggaccuccgaagacaucuucgaacgcaccgaacucauccacuggguccgccaagcccccggccaaggccucgaauggaucggcugggucaaaaccgucaccggcgccgucaacuucggcucacucgacuuccgacaccgcaucucccucacccgagaccgcgaccucuucaccgcccacauggacaucagaggccucacccaaggcgacaccgccaccuacuucugcgcccgccaaaaauucgaaucccgcuacaccggaggccaaggcugguacuucgaccucuggggccgcggcacccucaucgucgucuccuca

SEQ ID NO: 57009 - RNA, 384 nt, Artificial Sequence
  derived and/or modified sequence opt11 from anti-HIV-1_HeavyChain
ucccacgaccucgaacaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucgucucaggcaccgucaacuucgccucccucgacuuccgcaaccgaaucucccucucccgcgaccgcgaccucuccaccgccuacauggacauacgcggccucacccaagacgacaccgccaccuacuucugcgcccgccaaaaauucgccucccgcuacuccggcgaccaaggcuccuacuucgaccucuggggccgcggcacccucaucgucgucuccucc

SEQ ID NO: 57010 - RNA, 384 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcaagggcuagaguggauaggcugggucaaggccgugaccggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuugaaucgcgcuauaccgggggccagggcugguacuucgacuugugggggcgcgggacccauaucguggucucgagc

SEQ ID NO: 57011 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccaucgcgugagcuugaccagggacagggacuuguucacggcccauauggauaucaggggccugacccagggagauaccgcgaccuauuucugugccaggcaaaaguucgcgagcagguacucgggcgaucaagggagcuauuucgaucucuggggcaggggcacgcucauagucgugagcucg

SEQ ID NO: 57012 - RNA, 384 nt, Artificial Sequence
  derived and/or modified sequence opt11 from anti-HIV-1_HeavyChain
caaucgcacuuggaacagagcgggagcgcgaugaagaaaccgggcgcgagcguacgcgugagcuguuggacgagcgaggacauauucgauaccacggaauugaucuacugggugcgccaggccccgggccagggcuuggaauggaucgggugggugaaaauagucucgggcacggucaauuucgcgagcucggacuuucgcaaucgcaucagcuugagcagggacagggacuugagcacggcacauauggggauaaggggcuugcgccaggacgauaccgcgaccuauuucugugccaggcaaaaguucgagagcagguacucgggcgaucaagggagcuauuucgaucucuggggcaggggcacgcucauaaucgugagcuca

SEQ ID NO: 57013 - RNA, 384 nt, Artificial Sequence
  derived and/or modified sequence opt11 from anti-HIV-1_HeavyChain
gagguccagcucgugcaaucgggcgcggacgugaaaaagcccggggccucggucagggucucgugcuggaccucggaagauaucuuugacacgaccgagcucauauacugggucaggcaagcgcccgggcaagggcucgaguggauaggcugggucaagaucgugagcgggaccgugaacuuugccucgcucgauuucaggaacaggaucucgcucucgcgagaucgcgaucucucgaccgcguacauggacauacgagggcucacgcaagaugacacggcaacguacuuuugcgcgcgccagaaauuugccucgcgcuauagcggggaccagggcucguacuuugacuugugggggcgcgggacccugaucguggucucgagc

SEQ ID NO: 57014 - RNA, 384 nt, Artificial Sequence
  derived and/or modified sequence opt11 from anti-HIV-1_HeavyChain
caagcccaccucgaacaauccggcuccggcgucaaaaaacccggcgccuccguccgcgucuccugcugguccucagaagacaucuucgaacgcaccgaacucauccacuggguacaccaagcccccggccaaggccucgaauggaucggcugggucaaaaccgucaccggcgccgucaacuucggcucccucgacuucagacaccgcauaucccucacccgcgaccgcgaccucuucaccgcccacauggacauccgcggccucacccaaggcgacaccgccaccuacuucugcgcacgacaaaaauucgaaucccgcuacaccggcggccaaggcugguacuucgaccucuggggccgcggcacccacaucgucgucuccucc

SEQ ID NO: 57015 - RNA, 384 nt, Artificial Sequence
  derived and/or modified sequence opt11 from anti-HIV-1_HeavyChain
caaucccaccuagaacaauccggcuccgccaugaaaaaacccggcgccuccguccgcgucuccugcuggaccuccgaagacauauucgacaccaccgaacuaaucuacuggguccgccaagcccccggccaaggccucgaauggaucggcugggucaaaauagucuccggcaccgucaacuucgccucccucgacuuccgcaaccgcaucucacucucacgcgaccgcgcccucuccaccgcccacauggacauccgcggccucacccaagacgacaccgccaccuacuucugcgcccgccaaaaauucgccucccgcuacuccggcgaccaaggcuccuacuucgaccucuggggccgcggcacccucaucaucgucuccucc

SEQ ID NO: 57016 - RNA, 384 nt, Artificial Sequence
  derived and/or modified sequence opt11 from anti-HIV-1_HeavyChain
caagcgcacuuggaacagagugggagcggggucaagaaaccgggcgcgagcgugcgcgugagcuguuggucgagcgaggacauauucgagcgcacggaauugauccauugggugcgccaggccccaggccagggcuuggaauggaucgggugggugaaaacggucacgggcgcggucaauuucgcgagcuuggacuuucgcaaucgcaucagcuugagcagggacagggacuugagcacggccuauauggauauaaggggcuugacccaggacgauaccgcgacauacuucugugccaggcaaaaguucgcgagcagguacucgggcgaucaagggagcuauuucgaucucuggggcaggggcacgcucauagucgugagcucg

SEQ ID NO: 57017 - RNA, 384 nt, Artificial Sequence
  derived and/or modified sequence opt11 from anti-HIV-1_HeavyChain
caagcgcacuuggaacagagcgcgagcggggucaggcgcccgggcgcgagcgugcgcgugagcuguuggacgagcgaggacauauucgagcgcucggaacugaucuauugggugcgccaggccccgggcaggggcuuggaauggaucggguggauaaaauuggucucgggcgcggucaauuucgcgagcuuggacuuucgcaaucgcaucagcuugagcagggacagggaccugagcacggccuauauggauauaaggggcuugacccaggacgauaccgcgaccuauuucugugccaggcaaaaguucgcgagcagguacucgggcgaucaagggagcuauuucgaucucuggggcaggggcacgcucauagucgugagcucg

SEQ ID NO: 57018 - RNA, 384 nt, Artificial Sequence
  derived and/or modified sequence opt11 from anti-HIV-1_HeavyChain
caggcccaucucgagcaaucgggcucgggcgugaaaaagcccggggccucggucagggucucgugcuggagcucggaagauaucuuugaaaggacagagcucauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauaagagggcucacgcaagaugacacggccacguacuuuugcgcgcgccagaaauuugccucgcgcuauagcggggaccagggcucguacuuugacuugugggggcgcgggaccuugaucauagucucgagc

SEQ ID NO: 57019 - RNA, 384 nt, Artificial Sequence
  derived and/or modified sequence opt11 from anti-HIV-1_HeavyChain
caaucgcacuuggaacagagcgggagcgcgaugaagaaaccgggcgcgagcgugcgagugagcuguuggacgagcgaggacauauucgauaccacggaauugaucuauugggugcgccaggccccgggccagggcuuaggcuggaucgggugggugaaaauagucucgggcacggucaauuucgcgagcuuggacuuucgcucgcgcaucagcuugagcagggacagggacuugagcacggccuauauggauauaaggggccugacccaggacgauaccgcgaccuauuucugugccaggcaaaaguucgcgagcagguacucgggagaucaagggagcuauuucgaucucuggggcaggggcacgcucauagucgugagcuca

SEQ ID NO: 57020 - RNA, 384 nt, Artificial Sequence
  derived and/or modified sequence opt11 from anti-HIV-1_HeavyChain
caagcgcacuuggaacagagcgggagcggggucaagaaaccgggagcgagcgugcgcgugagcuguuggacgagcgaggacauauucgagagaacggaauugauccauugggugcgccaggccccgggccagggcuuggaauggaucgggugggcgaaaacggucacgggcgcggucaauuucgggagcuuggacuuucgccaucgcaucagcuugaccagggacagggacuuguucacggcccauauggauauaaggggcuugacacagggcgauacagcgaccuauuucugugccaggcaaaaguucgagagcagguacacgggagggcaagggugguauuucgaucucuggggcaggggaacgcacauagucgugagcucg

SEQ ID NO: 57021 - RNA, 384 nt, Artificial Sequence
  derived and/or modified sequence opt11 from anti-HIV-1_HeavyChain
caggcccaucucgagcaaucgggcucggccaugaaaaagcccggggccucggucagggucucgugcuggaccucggaagauaucuuugaaaggaccgagcucauauacugggucaggcaagcgccagggcgcgggcucgaguggauaggcugggucaagaccgugagcgggaccgugaacuuuggcucgagcgauuucaggaacaggaucucgcucacgcgcgaucgcgaucucucgaccgcgcacauggacauacgcgggcucacgcaagaugacacggccacguacuuuugcgcgcgccagaaauuugaaucgcucuauagcgaugaccagggcucguacuuugaccugugggggcgcgggacccugaucauagucucgagc

SEQ ID NO: 57022 - RNA, 384 nt, Artificial Sequence
  derived and/or modified sequence opt11 from anti-HIV-1_HeavyChain
caaucccaccucgaacaaucaggcuccgccaugaaaaaacccggcgccuccguccgcgucuccugcuggaccucagaagacaucuucgacaccaccgaacucaucuacugggucagacaagcccccggccaaggccucgaauggaucggcugggucaaaaucgucuccggcaccgucaacuucggcucccucgacuuccgccaccgcaucucccucacccgcgaccgcgaccucuucaccgcccacauggacauccgcggccucacccaaggcgacaccgccaccuacuucugcgcccgccaaaaauucgaaucccgcuacaccggcggccaaggcugguacuucgaccucuggggccgcggcacccacaucgucgucuccucc

SEQ ID NO: 57023 - RNA, 384 nt, Artificial Sequence
  derived and/or modified sequence opt11 from anti-HIV-1_HeavyChain
caagcccaccucgaacaauccggcuccggcgucaaaaaacucggcgccuccguccgcgucuccugcuggaccuccgaagacaucuucgacaccaccgaacucaucuacuggguccgacaagcccccggccaaggccucgaauggaucggcugggucaaaaucgucuccggcaccgucaacuucgccucccucgacuuccgcaaccgcaucucccucucccgagaccgcgaccucuccaccgccuacauggacauccgcggccucacccaagacgacaccgccaccuacuucugcgcccgccaaaaauucgccucccgcuacucaggcgaccaaggcuccuacuucgaccuauggggccgaggcacccucaucgucgucuccucc

SEQ ID NO: 57024 - RNA, 384 nt, Artificial Sequence
  derived and/or modified sequence opt11 from anti-HIV-1_HeavyChain
ucccacaaccucgaacaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucgucuccggcaccgucaacuucgccucacucgacuuccgcaaccgcaucucccucucccgcgaccgcgaccucuccaccgccuacauggacauccgcggccucacccaagacgacacagccaccuacuucugcgcccgccaaaaauucgccucacgcuacuccggcgaccaaggcucauacuucgaccucuggggccgcggcacccucaucgucgucuccuca

SEQ ID NO: 57025 - RNA, 384 nt, Artificial Sequence
  derived and/or modified sequence opt11 from anti-HIV-1_HeavyChain
agccauaccuggaacaaucgagggagcgcgaugaagaaaccgggcgcgagcgugcgcgugagcuguuggacgagcgaggacauauucgagcgaacggaacugaucuauugggugcgccaggccccgggcaggggcuuggaauggaucgggugggugaaaacggucucgggcacggucaauuucgggagcucggacuuucgcaaucgcaucagcuugagcagggacagggacuugagcacggcccauauggauauaaggggcuugacccaggacgauacagcgaccuauuucugugccaggcaaaaguucgcgagcagguacucgggcgaucaagggagcuauuucgaucucuggggcaggggcacgcucauaaucgugagcucg

SEQ ID NO: 57026 - RNA, 384 nt, Artificial Sequence
  derived and/or modified sequence opt11 from anti-HIV-1_HeavyChain
agccauaccuggaacgagagcgggagcgcgaugaagaaaccgggcgcgagcgugcgcgugagcuguuggacgagcgaggacauauucgagcgcacggaauugaucuauugggugcgacaggccccgggcaggggcuuggaauggaucgggugggugaaaauagucucgggcacggucaauuucgcgagcuuggacuuucgcaaucgcauaagccugagcagggacagggacuugagcacggccuauauggauaucaggggccugacccaggacgauaccgcgacauauuucugugccaggcaaaaguucgcgagcagguacucgggagaucaagggagcuauuucgaucucuggggcaggggcacgcucauagucgugagcucg

SEQ ID NO: 57027 - RNA, 384 nt, Artificial Sequence
  derived and/or modified sequence opt11 from anti-HIV-1_HeavyChain
aggcauacgugggagcagagcgggagcggggugaagaagccgggggcgagcgugagggugaguuguuggacgagcgaggacauauucgagaggacggaguugauacauugggugaggcaggcgccggggcagggguuggaguggauagggugggugaagacggugacgggggcggugaauuacgggagcuugaacuuuaggaguaggauaaguuugacgagggacagggacuuguucacggcgcauauggauauaaggggguugacgcagggggauacggcgacguauuucugugcgaggcagaaguucgagagcagguacacgggagggcaggggugguauuucgaucugugggggagggggacgcacauaguggugagcagc

SEQ ID NO: 57028 - RNA, 384 nt, Artificial Sequence
  derived and/or modified sequence opt11 from anti-HIV-1_HeavyChain
caagcccaccucgaacaauccggcuccggcgucaaaaaacccggcgccuccgucaaagucuccugcuggaccuccgaagacaucuucgaacgcacagaacucauccacuggguccgccaagcccccggccaaggccucgaauggaucggcugggucaaaaccgucaccggcgccgucaacuucggcucccucgacuuccgccaccgcaucucccucacccgcgaccgcgaccuauucaccgcccacauggacauccgcggccucacccaaggcgacaccgccaccuacuucugcgcccgccaaaaauucgaaucccgcuacaccggcggccaaggcugguacuucgaccucuggggccgcggcacccacaucgucguauccucc

SEQ ID NO: 57029 - RNA, 384 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaagggagcgagcucauacacugggucaggcaagcgcccgggcaagggcucgaguggauaggcugggucaagaccgugaccggggccgugaacuuuggcucggccuauuucaggcacagggucucgcucacgcgcgaucgcgaucucucgaccgcguacauggacauacgcgggcucacgcaagaugacacggccacguacuuuugcgcgcgccagaaauuugccucgcgauauagcggggaccagggcucguacuuugacuugugggggcgcgggaccuugaucguggucucgagc

SEQ ID NO: 57030 - RNA, 384 nt, Artificial Sequence
  derived and/or modified sequence opt11 from anti-HIV-1_HeavyChain
gggcacgaucucgagcaaucgggcucgggcgugaaaaagcccggggccucggucagggucucgugcuggaccucggaagauaucuuugaagggagcgagcucauacacugggucaggcaagcgcccgggcaagggcucgaguggauaggcuggguaaagaccgugaccggggccgugaacuuuggcucggccuauuucagacacaggaucucgcucucgcgcgaucgcgaucucucgaccgcguacauggacauacgcgggcucacgcaagaugacacggccacguacuuuugcgcgcgccagaaauuugccucgcgcuauagcggggaccagggcucguacuucgacuugugggggcgagggacccugaucguggucucgagc

SEQ ID NO: 57031 - RNA, 384 nt, Artificial Sequence
  derived and/or modified sequence opt11 from anti-HIV-1_HeavyChain
ucgcacacguggaauaacaggggcucggccaugaaaaagcccggggccucggucagggucucaugcuggaccucagaagauaucuucgacacgaccgagcucauauacugggucaggcaagcgcccgggcaagggcucgaguggauaggcugggucaagaccgugagcgggaccgugaacuuuggcucaagcgacuucaggaacaggaucucgcucacgcgagaccgcgaccucucgaccgcgcacauggacauacgcgggcucacgcaagacgacacggccacguacuucugcgcgcgccagaaauuugaaucgcucuauagcgaugaccagggcucguacuuugaccugugggggcgcgggaccuugaucauagucucgagc

SEQ ID NO: 57032 - RNA, 384 nt, Artificial Sequence
  derived and/or modified sequence opt11 from anti-HIV-1_HeavyChain
agacauacgugggagcagagcgggagcggggugaagaagccgggggcgagcguaagggugagcuguuggacgagcgaggacauauucgagaggacggagcugauacauugggugaggcaggcgccggggcaggggcuggaguggauagggugggugaagacggugagcggggcggugaauuucgggagcccgaacuuuaggcacagggugagcuugacgagggacagagacuuguucacggcgcauauggauauaaggggguugacgcagggggauacggcgacguauuucugugcgagacagaaguucgagagcagguacacgggagggcaggggugguauuucgaucugugggggagggggacgcacauaguggugagcagc

SEQ ID NO: 57033 - RNA, 384 nt, Artificial Sequence
  derived and/or modified sequence opt11 from anti-HIV-1_HeavyChain
ucgcacacguggaauaacaggggcucggccaugaaaaagcccggggccucagucagggucucgugcuggaccucggaagauaucuuugaaaggaccgagcucauauacugggucaggcaagcgcccgggcgcgggcuagaguggauaggcugggucaagacagugagcgggacagugaacuucggcucgagcgauuucaggaacaggaucucgcucacgcgcgaccgcgaccucucgaccgcgcacauggacauacgcgggcucacgcaagaugacacggccacguacuuuugcgcacgccagaaauuugaaucgcucuauagcgaugaccagggcucauacuuugaccugugggggcgagggacccugaucauagucucgagc

SEQ ID NO: 57034 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucucaugccucgccuccgaagacaucuucgacaccaccgaacucaucuacuggguccgccaagcccccggccaaggccucgaauggaucggcugggucaaaaucgucuccggcaccgucaacuucgccucccucgacuuccgcaaccgcaucucccuaucccgcgaccgcgaccucuccaccgccuacauggacauccgcggccucacccaagacgacaccgccaccuacuucugcgcccgccaaaaauucgccucccgcuacuccggcgaccaaggcucauacuucgaccucuggggccgcggcacccucaucgucgucuccucc

SEQ ID NO: 57035 - RNA, 384 nt, Artificial Sequence
  derived and/or modified sequence opt11 from anti-HIV-1_HeavyChain
caaucccaccucgaacaauccggcgccgccaugaaaaaacccggcgccucaguccgcgucuccugcuggaccucagaagacaucuucgacaccaccgaacucaucuacuggguccgccaagcccccggacaaggccucgaauggaucggcugggucaaaaucgucucaggcaccgucaacuucgccucccucgacuuccgaaaccgcaucucccucucccgcgaccgagaccucuccaccgcccacauggacauccgcggccuccgccaagacgacaccgccaccuacuucugcgcccgccaaaaauucgaaucccgcuacuccggcgaccaaggcuccuacuucgaccucuggggccgcggcacccucaucaucgucuccucc

SEQ ID NO: 57036 - RNA, 384 nt, Artificial Sequence
  derived and/or modified sequence opt11 from anti-HIV-1_HeavyChain
aggcauacgugggagcagagcgggagcggggugaagaagccgggggcgagcgugagggugagcuguuggacgagcgaggacauauucgagaagagcgaauugauacauugggugaggcaggcgccggggcagggguuggaguggauagggugggugaagacggugacgggggcggugaauuucgggagcagugacuuuaggcagagggugagccugacgagggacagagacuuguucacggcacauauggacauaaggggguugacacagggggauacggcgacguauuucugugcgaggcagaaguucgagagcagguacacgggggggcaggggugguauuucgaucugugggggagggggacgcacauaguggugagcagu

SEQ ID NO: 57037 - RNA, 384 nt, Artificial Sequence
  derived and/or modified sequence opt11 from anti-HIV-1_HeavyChain
agucauaccuggaacgagagcgggagcgcgaugaagaaaccgggcgcgagcgugcgcgugagcuguuggacgagcgaggacauauucgauaccacggaauugaucuauugggugcgccaggccccgggccagggauuggaauggaucgggugggugaaaauagucucgggcacggucaauuucgcgagcuuggacuuucgaaaucgcaucagcuugagcagggacagggacuugagcacggccuauauggauauaaggggcuugacccaggacgauaccgcgaccuauuucugugccaggcaaaaguucgcgagcagguacucgggcgaucaagggagcuauuucgaucucuggggcaggggcacgcucauagucgugagcucg

SEQ ID NO: 57038 - RNA, 384 nt, Artificial Sequence
  derived and/or modified sequence opt11 from anti-HIV-1_HeavyChain
aggcacacguggaaugaaucgggcucgggagugaaaaagcccggggccucggucagggucucgugcuggagcucggaagauaucuuugaaaggaccgagcucauacacugggucaggcaagcacccgggcgcgggcucgaguggauaggcugggucaagaccgugagcgggaccgugaacuuuggcucgagcgauuucaggaacaggaucucgcucacgcgcgaucgcgaucucucgaccgcgcacauggacauacgagggcucacgcaagaugacacggccacguacuuuugcgcgcgccagaaauuugaaucgcucuauagcgaugaccagggcucguacuuugacuugugggggcgcgggaccuugaucauagucucgagc

SEQ ID NO: 57039 - RNA, 384 nt, Artificial Sequence
  derived and/or modified sequence opt11 from anti-HIV-1_HeavyChain
cagagccaucucgagcaaucgggcucggaaaugaaaaagcccggggccucggucagggucucgugcuggaccucggaagauaucuuugacacgaccgagcucauauacugggucaggcaagcacccgggcaagggcucgaguggauaggcugggucaagaucgugagcgggaccgugaacuuugccucgcucgauuucaggaacaggaucucgcucucgcgcgaucgcgaucucucgaccgcguacauggacauacgcgggcucacgcaagaugacacggccacguacuuuugcgcgcgccagaaauuugccucgcgcuauagcggggaccagggcucauacuuugaccugugggggcgagggaccuugaucguggucucgagc

SEQ ID NO: 57040 - RNA, 384 nt, Artificial Sequence
  derived and/or modified sequence opt11 from anti-HIV-1_HeavyChain
cgccauaccugggaacagagcgggagcggggucaagaaaccgggagcgagcgugcgcgugagcuguuggacgagcgaggacauauucgagcgcacggaauugauccauugggugcgccaggccccgggccagggcuuggaauggaucggguggguaaaaacggucacgggcacgguaaauuucgggagcuugaacuuucgccagcgcgugagcuugaccagggacagggacuuguucacggcccauauggauaucaggggcuugacccagggcgauaccgcgaccuauuucugugccaggcaaaaguucgagagcuuguacucggacgaucaagggagcuauuucgaucucuggggcaggggcacgcucauaaucgugagcuca

SEQ ID NO: 57041 - RNA, 384 nt, Artificial Sequence
  derived and/or modified sequence opt11 from anti-HIV-1_HeavyChain
caagcgcacuuggaacagagcgggagcggggucaagaaaccgggagcgagcgugcgcgugagcuguuggacgagcgaggacauauucgagcgcucggaauugauccauugggugcgccaggccccgggccagggccuggaauggaucgggugggugaaaacggucacgggcgcggucaauuucgggagccagaucuuucgccauagaaucagcuugaccagggacagggacuuguucacggcccauauggauauaaggggcuugacccagggcgauaccgcgaccuauuucugugccaggcaaaaguucgagagcagguacacgggcgggcaagggugguauuucgaucucuggggcaggggcacgcacauagucgugagcucg

SEQ ID NO: 57042 - RNA, 384 nt, Artificial Sequence
  derived and/or modified sequence opt11 from anti-HIV-1_HeavyChain
agccauaccuggaacaagagcgggagcgcgaugaagaaaccgggcgcgagcgugcgcgugagcuguuggacgagcgaggacauauucgagcgcacggaauugaucuauugggugcgccaggccccgggcaggggcuuggaauggaucgggugggugaaaacggucucgggcacggucaauuucgggagcucggacuuucgcaaucgaaucagcuugaccagggacagggacuugagcacggcccauauggauauaaggggcuugacccaggacgauaccgcgaccuauuucugugccaggcaaaaguucgagagcuuguacucggacgaucaagggagcuauuucgaucuauggggcaggggcacgcucauaaucgugagcucg

SEQ ID NO: 57043 - RNA, 384 nt, Artificial Sequence
  derived and/or modified sequence opt11 from anti-HIV-1_HeavyChain
caggcccaucuagagcaaucgggcucgggcgugaaaaagcccggggccucggucagggucucgugcuggagcucggaagauaucuuugaaaggacagagcucauacacugggucaggcaagcgcccgggcaagggcucgaguggauaggcugggucaagaccgugaccggggccgugaacuuuggcucgcaaauauucaggcacaggaucucgcucacgcgcgaucgcgaucucuuuaccgcgcacauggacauacgcgggcucacgcaaggggacacggccacguacuuuugcgcgcgccagaaauuugaaucgcgauauaccgggggccagggcugguacuuugacuugugggggcgagggcccacgcucuuugucucgagc

SEQ ID NO: 57044 - RNA, 384 nt, Artificial Sequence
  derived and/or modified sequence opt11 from anti-HIV-1_HeavyChain
caagcgcacuuggaacagagcgcgagcggggucaggcgcccgggcgcgagcgugcgcgugagcuguuggacgagcgaggacauauucgagcgcucggaauugaucuauugggugcgccaggccccgggaaggggcuuggaauggaucggguggauaaaaacgugcucgggcgcggucaauuucgggagcguggacuuucgcgaucgcgugaguuugaccagggacagggacuuguucacggcccauauggauaucaggggacugacccagggcgauaccgcgaccuauuucugugccaggcaaaaguucgagagcagguacacgggcgggcaagggugguauuucgaucucuggggcaggggcacgcacauagucgugagcucg

SEQ ID NO: 57045 - RNA, 384 nt, Artificial Sequence
  derived and/or modified sequence opt11 from anti-HIV-1_HeavyChain
ucgcacacgguagagcaaucgggcucggccaugaaaaagcccggggccucggucaggguaucgugcuggaccucggaagauaucuuugacacgaccgagcucauauacugggucaggcaagcgcccgggcaagggcucgaguggauaggcugggucaagaucgugagcgggaccgugaacuuugccucgcucgauuucaggaacagaaucucgcucucgcgcgaucgcgaucucucgaccgcguacauggacauacgcgggcucacgcaagaugacacggccacguacuuuugcgcgcgccagaaauuugccucgcgcuauagcggggaccagggaucguacuuugacuugugggggcgcgggacccugaucguggucucgagc

SEQ ID NO: 57046 - RNA, 384 nt, Artificial Sequence
  derived and/or modified sequence opt11 from anti-HIV-1_HeavyChain
aggcacacguggaauaaaucgggcucgggcgugaaaaagcccggggccucggucagggucucgugcuggagcucggaagauaucuuugaaaggaccgagcucauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 57047 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgacaggcaccgggccagcgcuuggaauggaucgggugggugaaaacggucacgggcgcggucaauuucgggagcccgaacuuucgccaucgcgugagcuugaccagggacagggacuugagcacggccuauauggauaucaggggcuugacccaggacgauaccgcgaccuauuucugugccaggcaaaaguucgcgagcagguacucgggcgaucaagggagcuauuucgaucucuggggcaggggcacgcucauaguagugagcucg

SEQ ID NO: 57048 - RNA, 384 nt, Artificial Sequence
  derived and/or modified sequence opt11 from anti-HIV-1_HeavyChain
ucgcacgaccucgagcaaucgggcucagccaugaaaaagcccggggcaucggucagggucucgugcuggaccucggaagauaucuuugacacgaccgagcucauauacugggucaggcaagcgcccgggcaaggacucgaguggauaggcugggucaagaucgugagcgggaccgugaacuuugccucgcucgacuucaggaacaggaucucgcucucgcgcgaccgcgaucucucaaccgcgcacauggacauacgcgggcucaggcaagaugacacggccacguacuuuugcgcgcgccagaaauuugaaucgcgcuacagcggggaccagggcucguacuucgacuuaugggggcgcgggacccugaucauagucuccagc

SEQ ID NO: 57049 - RNA, 384 nt, Artificial Sequence
  derived and/or modified sequence opt11 from anti-HIV-1_HeavyChain
aggcauacguggaacgagagcgggagcggggugaagaagccgggggcgagcgugagggugagcugcuggaguagcgaggacauauucgagaggacggaguugauacauugggugaggcaggcgccggggcagggguuggaguggauagggugggugaagacggugacgggggcggugaauuucgggagcuuggacuuuaggcauaggauaaguuugacgagggacagggacuuguucacggcgcauauggauauaagaggguugacgcagggggauacgacgacguauuucugugcgaggcagaaguucgagagcagguacacgggagggcaggggugguauuucgaucugugggggagggggacgcacauaguggugagcagc

SEQ ID NO: 57050 - RNA, 384 nt, Artificial Sequence
  derived and/or modified sequence opt11 from anti-HIV-1_HeavyChain
aggcauacgugggagcagguguggaguggggugaagaagccgggggcgagugugagggugaguuguuggagcagugaggauauauuugagaggacggagcugauacauugggugaggcaggcgccggggcagggguuggaguggauagggugggugaagacggugacgggggcggugaauuuugggaguuuggauuuuaggcauaggauaaguuugacgagagacagggauuuguuuacggcgcauauggauauaaggggguugacgcagggggauacggcgacguauuucugugcgaggcagaaguuugagaguagguauacgggggggcaggggugguauuuugacuugugggggagggggacgcauauaguggugaguagu

SEQ ID NO: 57051 - RNA, 384 nt, Artificial Sequence
  derived and/or modified sequence opt11 from anti-HIV-1_HeavyChain
cagagccaucucgagcaaucgggcucggcaaugaaaaagcccggggccucggucacggucucgugcuggaccucggaagauaucuuugacacgaccgagcucauauacugggucaggcaagcgcccgggcaagggcucgaguggauaggcugggucaagaucgugagcgggaccgugaacuuugccucgcucgauuucaggaacaggaucucacucucgcgcgaucgcgaucucucgaccgcguacauggacauacgcgggcucacgcaagaugacacggccacguacuuuugcgcgcgccagaaauuugccucgcgcuauagcggggaccagggcucguacuuugaccugugggggcgcgggaccuugaucguggucucgagc

SEQ ID NO: 57052 - RNA, 384 nt, Artificial Sequence
  derived and/or modified sequence opt11 from anti-HIV-1_HeavyChain
aggcaugacuuggagcagagugggagcggggugaagaagccgggggcgagugugagggugagcuguuggaguagcgaggacauauucgagaggacggaguugauacauugggugaggcaggcgccggggcagggguuggaguggauagggugggugaagacggugacgggggcggugaauuucgggagccuggacuuuaggcauaggauaaguuugacgagggacagggacuuguucacggcgcauauggauauaaggggguugacgcagggggauacggcgacguauuucugugcgaggcagaaguuugagagcagguacacgggggggcaggggugguauuuugauuugugggggagggggacgcacauaguggugaguagu

SEQ ID NO: 57053 - RNA, 384 nt, Artificial Sequence
  derived and/or modified sequence opt11 from anti-HIV-1_HeavyChain
gucacgaccuggaacaagagcgggagcgcaaugaagaaaccgggcgcgagcgugcgcgugagcuguuggacgagcgaggacauauucgauaccacggaauugaucuauugggugcgccaggccccgggcaggggccuggaauggaucggaugggugaaaacggucucaggcacggucaauuucgggagcucggacuuucgaaaucgaauaagccugaccagggacagagaccugagcacggcccauauggauaucaggggccugacccaggacgauaccgcgaccuauuucugugccagacaaaaguucgagagcuuguacucggacgaucaagggagcuauuucgaucucuggggcaggggcacgcucauaaucgugagcucg

SEQ ID NO: 57054 - RNA, 384 nt, Artificial Sequence
  derived and/or modified sequence opt11 from anti-HIV-1_HeavyChain
aggcacacguggaauaacacgggaucgggcgugaaaaagcccggggccucggucagggucucgugcuuggccucggaagauaucuuugaaaggaccgagcucauacacugggucaggcaagcgcccgggcaagggcuagaguggauaggcugggucaagaccgugaccggggccgugaacuuuggcucgcucgauuucaggcacaggaucucgcucacgcgcgaucgcgaucucuuuaccgcgcacauggacauacgcgggcucacgcaaggggacacggccacauacuuuugcgcgcgccagaaauuugaaucgcgcuauaccgggggccagggcugguacuuugacuugugggggcgcgggacccauaucguggucucgagc

SEQ ID NO: 57055 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugccuagccuccgaagacaucuucgaacgcaccgaacucaucuacuggguccgccaagcccccggccgcggccccgaauggaucggcugggucaaaaccgucuccggcaccgucaacuucggcuccuccgacuuccgcaaccgaaucucccucacccgcgaccgcgaccucuccaccgcccacauggacauccgcggccucacccaagacgacaccgccaccuacuucugcgcacgccaaaaauucgaaucacucuacuccgacgaccaaggauccuacuucgaccucuggggccgcggcacccucaucaucgucuccucc

SEQ ID NO: 57056 - RNA, 384 nt, Artificial Sequence
  derived and/or modified sequence opt11 from anti-HIV-1_HeavyChain
cgccacaccuggaacaacaccggaagcggagucaaaaaaccaggcgccagcguacgcguaagcugcuggacaagcgacgacaucuucgaacgcacagaacucauccacuggguacgacaagccccaggccaaggccuagaauggaucggcuggguaaaaacagucucaggcacagucaacuucgccagccuagacuuccgcaaccgcauaucccuaagcagagacagagaccucagcacagccuacauggacaucagaggccuaacccaagacgacacagcaaccuacuucugcgccagacaaaaauucgccagccgauacucaggcgaccaaggaagcuacuucgaccucuggggcagaggcacacucauagucgucagcucc

SEQ ID NO: 57057 - RNA, 384 nt, Artificial Sequence
  derived and/or modified sequence opt11 from anti-HIV-1_HeavyChain
gggacgccggggaacaagagcgggagcggggugaagaagccgggggcgagcgugagggugagcuguuggaguagcgaggacauauucgagagaacggaguugauacauugggugaggcaggcaccggggcagggguuggaguggauagggugggugaagacggugacgggggcggugaauuucgggaguuuggacuuuaggcauaggauaagcuugacgagggacagggacuuguucacggcgcauauggauauaaggggguugacgcagggggauacggcgacguauuucugugcgaggcagaaguucgagagcagguacacgggggggcaggggugguauuucgaucugugggggagggggacgcacauaguggugagcagu

SEQ ID NO: 57058 - RNA, 384 nt, Artificial Sequence
  derived and/or modified sequence opt11 from anti-HIV-1_HeavyChain
ggaacgccagggagcgagagcgggagcggggucaagagaccgggcgcgagcgugcgagugagcuguuggacgagcgaggacauauucgagaccacggaauugauccauugggugcgacaggccccgggccagggcuuggaauggauagggugggugaaaacggucucgggagcggucaauuucgggagcuugaacuuuagacaucgagugagccugaccagggacagggaccuguucacggcccauauggauaucaggggcuugacccagggcgauacagcgacauauuucugugccaggcaaaaguucgagagcagguacacgggcgggcaagggugguauuucgaucucuggggaaggggcacgcacauaguagugagcucg

SEQ ID NO: 57059 - RNA, 384 nt, Artificial Sequence
  derived and/or modified sequence opt11 from anti-HIV-1_HeavyChain
gugaccccgggcacgaacuugggcuugcgcaugaaaaagcccggggccucggucagggucucgugcuggaccucggaagauaucuuugacacgaccgagcuaauauacugggucaggcaagcgcccgggcaagggcucgaguggauaggcugggucaagaucguaagcgggaccgugaacuuugccucgcucgauuucaggaacaggaucucgcucucgcgcgaucgcgaucucucgaccgcguacauggacauacgcgggcucacgcaagaugacacggccacguacuuuugcgcgcgccagaaauuugccucgcgcuauagcggggaccagggcucguacuuugaccugugggggcgcggaaccuugaucguggucucgagc

SEQ ID NO: 57060 - RNA, 384 nt, Artificial Sequence
  derived and/or modified sequence opt11 from anti-HIV-1_HeavyChain
aggcacgaucucgagcaaucgggcgcgggcgugaaaaagcccggggccucggucagggucucgugcuggagcucagaagauaucuuugaaaggaccgagcuaauacacugggucaggcaagcgcccgggcaagggcucgaguggauaggcugggucaagaccgugaccggggccgugaacuuuggcucgcuagauuucaggcacaggaucucgcucacgcgcgaucgcgaucucuuuaccgcgcacauggacauacgcgggcucacgcaaggggacacggccacguacuuuugcgcgcgacagaaauuugaaucgcgcuauaccgggggccagggcugguacuuugacuugugggggcgcgggacccauaucguggucucgagc

SEQ ID NO: 57061 - RNA, 384 nt, Artificial Sequence
  derived and/or modified sequence opt11 from anti-HIV-1_HeavyChain
caagugcacuuggagcagagcgggagcgggguaaagaaaccgggagcgagcgugagagugagcuguuggacgagcgaggacauauucgagaaaagugaauugauacauugggugagacaggcgccgggacagggacuggaauggauagggugggugaaaacgguaacgggagcggugaauuucgggagcagugacuuuagacagagagugagcuugacaccggacagggacuuguucacggcacauauggauauaaggggguugacacagggggauacagcgacauauuucugugcaagacaaaaguucgagagcagguacacgggagggcaagggugguauuucgaucugugggggaggggaacgcacauaguggugagcucg

SEQ ID NO: 57062 - RNA, 384 nt, Artificial Sequence
  derived and/or modified sequence opt11 from anti-HIV-1_HeavyChain
gggaccacgugggagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugacaggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 57063 - RNA, 384 nt, Artificial Sequence
  derived and/or modified sequence opt11 from anti-HIV-1_HeavyChain
agccacgaccuagaacaaagcggaagcgaauggaaaaaaccaggcgccagcgugcgaguaagcugcuggacaagcgaagacauauucgacaccacagaacugauccacuggguacgccaggccccaggccaaggccuagaauggaucggauggguaaaaacagucacaggcgcagucaacuucggaagccuagacuuccgccaccgcauaagccuaaccagagacagagaccuauucacagcccacauggacaucagaggacugacccaaggcgacaccgcaacauacuucugcgccagacaaaaauucgaaagcagauacacaggcggacaaggaugguacuucgaccucuggggcagaggcacacacauagucguaagcagc

SEQ ID NO: 57064 - RNA, 384 nt, Artificial Sequence
  derived and/or modified sequence opt11 from anti-HIV-1_HeavyChain
cagagcaggcccgggaacaagagcgggagcgcgaugaagaaaccgggcgcgagcgugcgcgugagcuguuggacgagcgaggacauauucgagcgcacggaauugcucugggucaggcaagcgcccgggcgcgggcucgaguggauaggcugggucaagaccgugagcgggaccgugaacuuuggcucgagcgauuucaggaacaggaucucacucacgcgcgaucgcgaucucucgaccgcgcacauggacauacgcgggcucacgcaagaugacacggccacguacuuuugcgcgcgccagaaauuugaaucgcucuauagcgaugaccagggcucguacuuugaccugugggggcgcgggaccuugaucauagucucgagc

SEQ ID NO: 57065 - RNA, 384 nt, Artificial Sequence
  derived and/or modified sequence opt11 from anti-HIV-1_HeavyChain
ggaacgaccuggagcaagagcgggagcggggucaagaaaccgggcgcgagcgugcgcgugagcuguuggacgagcgaggacauauucgagcgcacggaauugaucuauugggugcgccaggccccgggccagggcuuggaauggaucgggugggugaaaauagucucgggcacggucaauuucgcgagcuuggacuuucgcaaucgcaucagcuugagcagggacagggacuugagcacggcacauauggauauaaggggcuugacccaggacgauaccgcaaccuauuucugugccaggcaaaaguucgcgagcagguacucgggcgaucaagggagcuauuucgaucucuggggcaggggcacgcucauaaucgugagcucg

SEQ ID NO: 57066 - RNA, 387 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauacucaggaaaaagcgcguggacucggucgggugcgauacagcgcccgggcaagggcucgaguggauaggcugggucaagaccgugaccggggccgugaacuuuggcucgagcgauuucaggcaaagggucucgcucacgcgagaucgcgaucucuuuacagcgcacauggacauacgcgggcucacgcaagaugacacggccacguacuuuugcgcgcgccagaaauuugccucgcgcuauagcggggaccagggcucguacuuugacuugugggggcgcgggaccuugaucguggucucgagc

SEQ ID NO: 57067 - RNA, 387 nt, Artificial Sequence
  derived and/or modified sequence opt11 from anti-HIV-1_HeavyChain
aaagcgcacuugggcaauaaaucgggcucgggcgugaaaaagcccggggccucggucagggucucgugcuggagcucggaagauaucuuugaaaggaccgagcucauacacugggucaggcaagcgcccgggcaagggcucgaguggauaggcugggucaagaccgugaccggggcagugaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 57068 - RNA, 384 nt, Artificial Sequence
  derived and/or modified sequence opt11 from anti-HIV-1_HeavyChain
accacggucgggaccauacucgggcgcgcgaugaagaaaccgggcgcgagcgugagagugagcuguuggacgagcgaggacauauucgauaccacggaauugaucuauugggugcgacaggccccgggccagggcuuggaauggaucgggugggugaaaauagucucgggcacggucaauuucgcgagcuuggacuuucgcaaucgcauaagccugagcagggacagggacuugagcacggccuauauggauaucaggggcuugacccaggacgauaccgcgaccuauuucugugccaggcaaaaguucgcgagcagguacucgggcgaucaagggagcuauuucgaucucuggggcaggggcacgcucauagucgugagcucg

SEQ ID NO: 57069 - RNA, 384 nt, Artificial Sequence
  derived and/or modified sequence opt11 from anti-HIV-1_HeavyChain
cagagccaucucgagcaaucgggcucggccaugaaaaagcccggggccucggucaaggucucgugcuggaccucggaagauaucuuugacacgaccgagcuaauauacugggucaggcaagcgcccgggcaagggcucgaguggauaggcugggucaagaucgugagcgggaccgugaacuucgccucgcuagauuucaggaacaggaucucgcucucacgcgaucgcgaucucucgaccgcguacauggacauacgcgggcucacgcaagaugacacggccacguacuuuugcgcgcgccagaaauuugccucgcgcuauagcggggaccagggcucguacuuugacuugugggggcgcgggaccuugaucguggucucaagc

SEQ ID NO: 57070 - RNA, 387 nt, Artificial Sequence
  derived and/or modified sequence opt11 from anti-HIV-1_HeavyChain
cagagccaucucgaacaagugugggugugccagagcaagaaaccgggcgcgagcgugcgcgugagcuguuggacgagcgaggacauauucgauaccacggaauugaucuauugggugcgccaggccccgggccagggcuuggaauggaucgggugggugaaaauagucucaggcacggucaauuucgcgagcuuggacuuucgcaaucgcaucagcuugagcagggacagggacuugagcacggcccauauggauauaaggggccugacccaggacgauaccgcgaccuauuucugugccagacaaaaguucgcgagcagguacucaggcgaucaagggagcuacuucgaucucuggggaaggggcacgcucauaaucgugagcucg

SEQ ID NO: 57071 - RNA, 384 nt, Artificial Sequence
  derived and/or modified sequence opt11 from anti-HIV-1_HeavyChain
aggcacacggucgagcaaucgggcucgggcgugaaaaagcccggggccucggucagggucucgugcuggagcucggaagauaucuuugaaaggaccgagcucauacacugggucaggcaagcgccagggcaagggcuagaguggaugggcugggucaagaccgugaccggggccgugaacuuuggcucgcuagauuucaggcacaggaucucgcucacgcgcgaucgcgaucucuuuacagcgcacauggacauacgcgggcuaacgcaaggggacacggccacguacuuuugcgcgcgccagaaauuugaaucgcgauauaccgggggccagggcugguacuuugacuugugggggcgcgggacccauaucguggucucgagc

SEQ ID NO: 57072 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuccgcccgagaagacaucuucgacaccaccgaacucaucuacuggguccgccaagcccccggccaaggccucgaauggaucggcugggucaaaaucgucugcggcaccgucaacuucgccucccuagacuuccgcaaccgcaucucccucucccgagaccgcgaccucuccaccgcccacauggacauccgcggccucacccaagacgacaccgccaccuacuucugcgcccgccaaaaauucgccucccgauacucaggcgaccaaggcuccuacuucgaccucuggggccgcggcacccuaaucaucgucucaucc

SEQ ID NO: 57073 - RNA, 387 nt, Artificial Sequence
  derived and/or modified sequence opt11 from anti-HIV-1_HeavyChain
gaagugcaaaggggcgggcgcguggucgggcgcgaugucaagaaaccgggcgcgagcgugcgcgugagcuguuggacgagcgaggacauauuccauaccgagcucauauacugggucaggcaagcgcccgggcaagggcucgaguggauaggcugggucaagauagugagcgggaccgugaacuuugccucgcucgauuucaggaacagaaucucgcucucgcgagaucgcgaucucucgaccgcguacauggacauacgcgggcucacgcaagaugacacggccacguacuuuugcgcgcgccagaaauuugccucgcgcuauagcggggaccagggcucguacuuugacuugugggggcgcgggacccugaucguggucucgagc

SEQ ID NO: 57074 - RNA, 384 nt, Artificial Sequence
  derived and/or modified sequence opt11 from anti-HIV-1_HeavyChain
ggcacgaccuggaacgagagcgggagcggggucaagaaaccgggcgcgagcgugcgcgugcccuguuggucgagcgaggacauauucgagcgcacggaauugauccaucgcgugcgccaggccccgggccagggcuuggaauggaucgggugggugaaaacggucacgggcgcggucaauuucgggagcccgaacuuucgccaucgcaucagcuugaccagggacagggacuuguucacggcccauauggauauaaggggccugacccagggcgauaccgcgaccuauuucugugccaggcaaaaguucgagagcagguacacgggcgggcaagggugguauuucgaucucuggggcagaggcacgcacauagucgugagcucg

SEQ ID NO: 57075 - RNA, 384 nt, Artificial Sequence
  derived and/or modified sequence opt11 from anti-HIV-1_HeavyChain
agaagcaauugggugcaaucgggcgcggacgugaaaaagcccggggccucagucaagagcucgugcuggaccucggaagauaucuuugacacgaccgagcucauauacugggucagacaagcgcccgggcaagggcuagaguggauaggcugggucaagaucgugagcgggaccgugaacuuugccucgcucgauuucaggaacaggaucucgcucucgcgcgaucgcgaucucucgaccgcguacauggacauacgcgggcucacgcaagaugacacggccacguacuuuugcgcgcgccagaaauuugccucgcgcuauagcggggaccagggaucguacuuugacuugugggggcgcgggaccuugaucguggucucgagc

SEQ ID NO: 57076 - RNA, 384 nt, Artificial Sequence
  derived and/or modified sequence opt11 from anti-HIV-1_HeavyChain
ccagugcaauugguccagagcggggccgaggucaagaaaccgggcgcgagcgugaaagugagcuguuggacgagcgaggacauauucgagcgcacggaauugauccauugggugcgccaggccccgggccagggcuuggaauggaucgggugggugaaaacggucacgggcgcgguaaauuucgggagcuuggacuuucgccaucgcaucagcuugaccagggacagagaccuguucacggcccauauggauauaaggggccugacccagggcgauaccgcgacauauuucugugccaggcaaaaguucgagagcagguacacgggcgggcaagggugguauuucgaucuauggggcaggggcacgcacauagucgugagcucg

SEQ ID NO: 57077 - RNA, 399 nt, Artificial Sequence
  derived and/or modified sequence opt11 from anti-HIV-1_HeavyChain
cgcgaauaccucgaacaauccggcggcggcgucaaaaaacucggcgccuccguccgcgucuccugccgcgccuccgaagaccucuucggcgacgaagccaucuacgacgacgaacucauccacuggcuccgccaaguccccggccaacgccccgaauggaugggcuggauccgccccaaaaccggcgcccgcaaccaagcccgccaauuccaaccccgcaucaaccucucccgcgaccgcgcccucaacaccgccuaccucgaccuauccucccucaccuccgccgacucagccaccuacuucugcgcccgccaaaccuucaaacccgacuucuacuucgccgaccaaggcugguccuucaaccucuggggccgcggcgcucgcgucaucgucuccucc

SEQ ID NO: 57078 - RNA, 399 nt, Artificial Sequence
  derived and/or modified sequence opt11 from anti-HIV-1_HeavyChain
caaguccaacucguccaaucaggcaccgaagucaaaaaacccggcgccucacuccgcgucucaugccgcgccuccgaagaccucuucggcgacaaaaucaucuacgacgacgaagucauccacuggcuccgccaacuccccggccaacgccccgaauggaugggcuggauccgccccaaauccggcgcccgcaaccaagcccgccaauuccaaccccgcaucucccucacccgcgaccgagcccucuccaccgccuaccucgaccucaacucccucaccuccgccgacuccggcaccuacuucugcgcccgccaaaccuucaaacccgacuucuacuucgccgaccaaggcugguccuucaaccucuggggccgcggcgcccacuucaucgucuccucc

SEQ ID NO: 57079 - RNA, 399 nt, Artificial Sequence
  derived and/or modified sequence opt11 from anti-HIV-1_HeavyChain
caagcccaccucgaacaaucaggcuccggagucaaaaaacccggcgccuccguccgagucuccugccgcgccuccgaagaccucuucggcgacgaaaucaucuacgacgacgaagucauccacuggcuccgccaaguccccggccaacgccccgaauggaugggcuggauccgccccaaaaccggcgcccgcaaccaagcccgccaauuccaaccccgcaucucccucacccgagaccgcgcccucuccaccgccuaccucgaccucaacucccucaccuccgccgacuccggcaccuacuucugcgcccgccaaaccuucaaacccgacuucuacuucgccgaccaaggcuggucauucaaccucuggggccgcggcgcccacuucaucgucuccucc

SEQ ID NO: 57080 - RNA, 399 nt, Artificial Sequence
  derived and/or modified sequence opt11 from anti-HIV-1_HeavyChain
ggcaauauauggagcgagagcgggggcggggucaagaaaccgggcgcgagcgugcgcgugagcugucgagcgagcgaggacuuguucggggacgagaucauauacgaugacgaggucauacacuggcucaggcaagugcccgggcaaaggcccgaguggaugggcuggaucaggcccaagaacgggggcaggaaccaggccaggcaauuucaaccgcgcaucagcuugacaagggacagggccuugaacacggccuaucucgaucucaauagccugaccucggccgauagcgggaccuauuucugugccaggcaaacguucaagcccgauuucuacuucgcggaccagggcuggagcuuuaacuugugggggcgcggggccagggucauagucucgagc

SEQ ID NO: 57081 - RNA, 399 nt, Artificial Sequence
  derived and/or modified sequence opt11 from anti-HIV-1_HeavyChain
caaguccaacuaguccaauccggcgccgaagucaaaaaacccggcgccucccuccgcguccccugccgcgccuccgaagaccucuucggcgacgaaaucaucuacgacgacgaagucauccacuggcuccgccaaguccccggccaacgccccgaauggaugggcuggauccgccccaaaaccggcgcccgcaaccaagcccgccaauuccaaccccgcaucucacucacccgcgaccgcgcccucuccaccgccuaccucgaccucaacucccucaccuccgcagacuccggcacauacuucugcgcccgccaaaccuucaaacccgacuucuacuucgccgaccaaggcuggucauucaaccuauggggccgcggcgcacacuucaucgucuccucc

SEQ ID NO: 57082 - RNA, 390 nt, Artificial Sequence
  derived and/or modified sequence opt11 from anti-HIV-1_HeavyChain
caagcgcaccuggaacagagcgggagcggggucaagaaaccgggcgcgagcgugcgcgugagcuguuggacgagcgaggacauauucgagcgaacggaauugauccauugggugcgccaggccccgggccagggauuggaauggaucgggugggugaaaauagucucgggcgcggucaauuucgggagcccgaacuuucgccagcgcgugagcuugacaagggacagggacuuguucacggcccauauggauaucaggggauugacacagggcgauacagcgaccuauuucugugccaggcaaaaguucgagcgcgggggccagggcuggaucuuugacuugugggggcgcgggacauugaucgcgguaucgagcgcgagcaggagcgcg

SEQ ID NO: 57083 - RNA, 393 nt, Artificial Sequence
  derived and/or modified sequence opt11 from anti-HIV-1_HeavyChain
caagcacaccuggaacagagcggaagcggagucaaaaaacugggcgcaagcguacgcguaagcugcuggacaagcgaagacauauucgaacgcacagaacuaauccacuggguacgccaggccccaggccaaggccuagaauggaucggauggguaaaagcagucucaggcgcagucaacuacggaagccuagacuuccgccaccgcgugagccuaaccagagacagagaccuaagcacagcccacauggacaucagaggccuaacccaagacgacaccgccaccuacuucugcgcccgacaaaaauucgcgcgcggagaccaaggcugguucuucgaccuauggggacgcggaacccuaaucguagucucaagcgcaagcacacgcucgacc

SEQ ID NO: 57084 - RNA, 414 nt, Artificial Sequence
  derived and/or modified sequence opt11 from anti-HIV-1_HeavyChain
caagugcaauugguccagagcggggccgaggucaagaaaccgggcgcgagcgugaccgugagcuguaaagcgagcagguacacguucauaaacuauuacauacacugggucaggcaagcgcccgggcaagggcuagaguggauaggcugggucaagcccgugagcggggccgugaacuuuggcucgcccaauuucaggcacagggucucgcucacgcgcgaucgcgaucuauuuaccgcgcacauggacauacgcgggcucacgcaaggggacacggccacguacuuuugcgcgcgccagaaauucgccagaggcgaucaagggugguuuuucgaucucuggggcaggggcacgcucauagucgugagcucggccucgaccaagggcccgagcguguucccgcacgaucucagg

SEQ ID NO: 57085 - RNA, 414 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacacgaucacgagacauuacaugcacugggucaggcaagcgcccgggcaagggcucgaguggauaggcugggucaagaccgugaccggggccgugaacuuuggcucgcccaacuucagacacagggucucgcucacgcgcgaucgcgaucucuuuaccgcgcacauggacauacgcgggcucacgcaaggggacacggccacguacuuuugcgcgcgccagaaauuugaaaggggcgggcaagggugguauuucgaccucuggggcaggggaacgcucauagucgugagcucggccucgaccaagggcccgagcguauucccgcacgaucucagg

SEQ ID NO: 57086 - RNA, 408 nt, Artificial Sequence
  derived and/or modified sequence opt11 from anti-HIV-1_HeavyChain
caggcccaucucgaacaaucgggcucgggcgugaaaaagcccggggccucggucagggucucgugcuggaccucggaagauaucuuugaaaagagcgagcuaauacacugggucaggcaagcgcccgggcaagggcucgaguggauaggcugggucaagaccgugaccggggccgugaacuuuggcucgcccaauuucaggcacagggucucacucacgcgcgaucgagaucucuuuaccgcgcacauggacauacgcgggcucacgcaaggggacacggccacguacuuuugcgcgcgccagaaauauuacgcgggcgggcaagggugguauuucgaucucuggggcaggggcacgcucauagucgugagcucggcuucgaccaagggcccgagcgaugaccugcga

SEQ ID NO: 57087 - RNA, 411 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccggggcagggguuggaguggauagggugggugaagauagugaguggggcggugaauuucgggagcccgaacuuuaggcagagggugagcuugacaagggacagggacuuguucacggcgcauauggauauaaggggguugacacagggggauacggcgacguauuucugugcgaggcagaaguucgagaggggggggcagggguggauauuugacuugugggggagagggacguugauagcggugaguagcgcgagcacgaaggggccgaguguguaugacuugagg

SEQ ID NO: 57088 - RNA, 417 nt, Artificial Sequence
  derived and/or modified sequence opt11 from anti-HIV-1_HeavyChain
caaguacaacuaguccaaagcggaagcggagucaaaaaaccaggcgcaagcguacgcguaagcugcuggacaagcgaagacauauucgaacgcacagaacuaauccacuggguacgacaagccccaggccaaggccuagaauggauaggauggguaaaaacagucucgggcgccgucaacuucggaagcccaaacuuccgccaccgcguaagccuaaccagagacagagaccuauucacagcccacauggacaucagaggccuaacccaaggcgacaccgcaaccuacuucugcgccagacaaaaauucgaacgcggcggccaaggcugguacuucgaccuauggggacgcggaacccuaaucguagucucaagcgcaagcacaaaaggacccucagucuucccccacgaccuacgc

SEQ ID NO: 57089 - RNA, 417 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggacgagcgaggacauauucgagaaaucggaauugauccauugggugcgccaggccccgggccagggcuuggaauggaucgggugggugaaaacggucacgggcgcggucaauuucgggagcccgaacuuucgccaucgcgugagcuugaccagggacagagacuuguucacggcccauauggauaucaggggcuugacccagggcgauaccgcgaccuauuucugugccaggcaaaaguucgagcgagggggccagggcugguacuuugacuugugggggcgcgggacccugaucguggucucaagcgcgagcacgaaagggcccucagucuuucccacgaucuauguc

SEQ ID NO: 57090 - RNA, 417 nt, Artificial Sequence
  derived and/or modified sequence opt11 from anti-HIV-1_HeavyChain
caagugcaauuggaacagagcgggagcggggucaagaaauugggcgcgagcgugcgcgugagcuguuggacgagcgaggacauauucgaggacgagcucauacacugggucaggcaagcgcccgggcaagggcucgaguggauaggcugggucaaggccgugagcggggccgugaacuauggcucacucgauuucaggcacagagucucgcucacgcgcgaucgagaucucuuuaccgcgcacauggacauacgcgggcuaacgcaagaugacacggccacguacuuuugcgcgcgccagaaauuugccaggggcgaucaagggugguuuuucgaucucuggggcaggggcacgcucauagucgugagcucgggcuugcaccagggcccgaucgggcucccgcccaggcucucgcgc

SEQ ID NO: 57091 - RNA, 417 nt, Artificial Sequence
  derived and/or modified sequence opt11 from anti-HIV-1_HeavyChain
caggcgcaccuggagcagagcgggagcggagugaagaagccgggggcgagcgugaggguaagcugcuggacgagcgaggacauauucgagaggacggagcugauacacugggugaggcaggcgccggggcagggacuggaguggauaggguggguaaagauagugaguggggcagugaacuucgggagcccgaacuuuaggcagagggugagccugacgagggacagagaccuguucacggcgcauauggacauaagagggcugacgcagggggacacggcgacguauuucugugcgagacagaaguucgaaaggggagggcagggguggauauucgaccugugggggagggggacgcugauagcggugagcagcgcgagcccgagggcacacagaagcagcccgacaauaugugug

SEQ ID NO: 57092 - RNA, 417 nt, Artificial Sequence
  derived and/or modified sequence opt11 from anti-HIV-1_HeavyChain
caggcgcacuuagagcaaagcggaagcggagugaaaaagccaggggcaagcguaaggguaagcugcuggacgagcgaagacauauucgaaaggacagagcuaauacacuggguaaggcaggcgccagggcaagggcuagaguggauaggauggguaaagacagugacaggggcagugaacuucggaagcagcgacuucaggcaaaggguaagccugacgagagacagggaccuguucacggcgcacauggacauaagagggcuaacgcaaggggacacggcaacguacuucugcgcgagacagaaauucuacgcgggagggcaagggugguacuucgaccuauggggaagagggacgcuaauaguagugagcagcgcaagcacaaagggaccgaguguguucccgcacgaccugagg

SEQ ID NO: 57093 - RNA, 414 nt, Artificial Sequence
  derived and/or modified sequence opt11 from anti-HIV-1_HeavyChain
caagugcacuugguccagagcggggccgaggucaagcgcccgggcgcgagcgugaaagugagcuguaaagcgagcggguacacguucacggacuauuucauacacugggucaggcaagcgcccgggcaagggcuagaguggauaggcugggucaagaccgugagcggggccgugaacuuuggcucgcucaauuucaggcacagggucucgcucacgcgugaucgcgaucucuuuaccgcgcacauggacauacgcgggcuaacgcaaggggacacggccacguacuuuugcgcgcgccagaaauuugccaggggcgaucaagggugguuuuucgaucucuggggaaggggcacgcucauagucgugagcucggccucgacaaagggaccgagcguguucccgcacgaucucagg

SEQ ID NO: 57094 - RNA, 420 nt, Artificial Sequence
  derived and/or modified sequence opt11 from anti-HIV-1_HeavyChain
caagugcaacugguccagagcggggccgaggucaagaaaccgggcgcgagcgugaaagugagcuguaaagcgagcggguacauauucacgggcucguacaugcacugggucaggcaagcgcccggacaaacguucgagugguugggcuggaugaagcccgugaccggggccgugaacuaugccaggcaauuucaagggcgcgugaguuuuuacaggaccagggaauugggcauagccuauauggaucucagggaccugaaauuugacgauaccgcggucuauuucugugccaggaaaacgaaaggggacgugagcggagacgaucgcggguucuuuuucgaucucuggggcaggggcacgcgcgugaucgugagcucggccucgaccaagggcccgagcguguucccgcacgaucucagg

SEQ ID NO: 57095 - RNA, 417 nt, Artificial Sequence
  derived and/or modified sequence opt11 from anti-HIV-1_HeavyChain
caagcccaccucgaacaauccggcuccggcgucaaaaaaccaggcgccuccguccgcgucuccugcuggaccuccgaagacaucuucgaaaaauccgaacuaauccacuggguccgccaagcccccggccaaggccucgaauggaucggcugggucaaaaccgucaccggcgcagucaacuucggcucccccaacuuccgccaccgcgucucacucacccgcgaccgcgaccucuucaccgcccacauggacauccgcggccuaacccaaggcgacaccgccaccuacuucugcgcccgccaaaaauucgaacgcggcggccaaggcugguacuucgaccuauggggccgcggaacccucaucguagucuccucagccuccaccaaaggccccuccgucuucccccacgaccuccgc

SEQ ID NO: 57096 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuucgaagggagcgagcucauacacugggucaggcaagcgcccgggcaaggacucgaguggauaggcugggucaagaccgugaccggggccgugaacuucggcucgcccaauuucaggcacaggguaucgcucacgcgagaccgcgaucucuuuaccgcgcacauggacauacgcgggcucacgcaaggggacacggccacauacuuuugcgcgcgccagaaauuugaaaggggcgggcaagggugguauuucgaucuauggggcaggggcacacuaauagucgugagcucggccucgaccaagggcccgagcguauucccgcacgaucucaga

SEQ ID NO: 57097 - RNA, 420 nt, Artificial Sequence
  derived and/or modified sequence opt11 from anti-HIV-1_HeavyChain
caaguccaacucguccaauccggagcagaagucaaaaaacccggagccuccgucaaagucuccugcaaagccuccggcuacaccuucaccggcuacuacauccacuggguccgacaagcccccggccaaggccucgaauggaugggcuggaucaaccccaacuccggcgccaccaacuacgcccaaaaauuccaaggccgccucaccaucgcccgcgacaccuccaucuccaccgccuacauggaccuccgcaaccuccgcuucgacgacaccgccgucuacuucugcgccagaaaaaccgccggcgacgucuccggcgacaaccgaggcuacuucuucgaccucuggggccgcggcucccgcgucaucgucuccuccgccuccaccaaaggccccuccgucuucccccacgaccuccgc

SEQ ID NO: 57098 - RNA, 414 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucggccucgaccaagggcccgagcguguuccaugacuugcgc

SEQ ID NO: 57099 - RNA, 414 nt, Artificial Sequence
  derived and/or modified sequence opt11 from anti-HIV-1_HeavyChain
caagcgaccuuggaacagagcgggagcggggucaagaaaccgggcgcgagcgugcgcgugagcuguuggucaagcgaggacauauucaagaccgagcucauacacugggucaggcaagcgcccgggcaagggcucgaguggauaggcugggucaaggccgugagcggggccgugaacuauggcucgcucgauuucaggcacagggucucgcucacgcgcgaucgagaucucucgaccgcgcacauggacauacgcgggcucacgcaagaugacacggccacgcacuuuugcgcgcgccagaaauuugccaggggcgaucaagggugguuuuucgaucucuggggcaggggcacgcucauagucgugagcucggccucgaccaagggcccgagcguguucccgaccauauacgug

SEQ ID NO: 57100 - RNA, 417 nt, Artificial Sequence
  derived and/or modified sequence opt11 from anti-HIV-1_HeavyChain
caagcccaccucgaacaauccggcuccggcgucaaaaaacccggcgccucaguccgagucucaugcuggaccuccgaagacaucuucgaacgaaccgaacucauccacuggguccgccaagcccccggccaaggccucgaauggaucggcugggucaaaaccgucaccggcgccguaaacuucggcucccccaacuuccgacaccgcgucucccucacccgcgaccgcgaccucuucaccgcccacauggacauccgcggccucacccaaggagacaccgccaccuacuucugcgcccgccaaaaauucgaacgcggcggccaaggcugguacuucgaccucuggggccgcggcacccuaaucgucgucucauccgccuccaccaaaggccccuccgucuuccccaccaucugcguc

SEQ ID NO: 57101 - RNA, 414 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgaacggaauugauccauugggugcgccaggccccgggccagggcuuggaauggaucgggugggugaaaacggucucgggcgcggucaauuucgggagcccgaacuuucgccaucgcgugagcuugaccagggacagggacuuguucacggcacauauggauaucaggggcuugacccagggcgauaccgcgaccuauuucugugccaggcaaaaguucgagcgcgggggccagggcuggauauuugacuugugggggcgcgggaccuugaucgcggucucgagcgcgagcccgcgcgcgcacaggagcucgcccaggagcgcg

SEQ ID NO: 57102 - RNA, 414 nt, Artificial Sequence
  derived and/or modified sequence opt11 from anti-HIV-1_HeavyChain
caagcgcacuuggaacagagcgggagcggggucaagaaaccgggcgcgagugugcgcgugagcuguuggacgagcgaggacauauucaagagcgagcuaauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacauacuuuugcgcgcgccagaaauuugaaaggggcgggcaaggguggauauucgaucucuggggcaggggcacgcucauagccgugagcucggccucgaccaagggcccgagcguguucccgaccauaugcgug

SEQ ID NO: 57103 - RNA, 414 nt, Artificial Sequence
  derived and/or modified sequence opt11 from anti-HIV-1_HeavyChain
caagcgcacuuggaacagagcgggcccggggucaagaaauugggcgcgagcgugcgcgugagcuguuggacgagcgaggacauauucgagcgcacggaauugauccauugggugcgccaggccccgggccagggcuuggaauggaucgggugggugaaagcggucucgggcgcggucaauuacgggagccuggacuuucgccaucgcgugagcuugaccagggacagggacuuguucacggcccauauggauaucaggggcuugacccaggacgauaccgcgaucuauuucugugccaggcaaaaguucgcgcgcggggaccagggcugguucuuugacuugugggggcgcgggaccuugaucguggucucgagcgcgagcacgaaagcgcacagaagcucgcccagaagcaca

SEQ ID NO: 57104 - RNA, 420 nt, Artificial Sequence
  derived and/or modified sequence opt11 from anti-HIV-1_HeavyChain
caaguccaacucguccaauccggcgccgaaaugaaaaaacccggcgccuccgucaaacucuccugcaugaccucaggcuacgucuucaccgacuucuacauccacuggguccgccaagcccccggccaaggccucgaauggaugggcuggaucaaccccggcaccggaggcaccaucuccgccccccgcuuccucggccgcgucacccucacccgcgacaccuccaucuccgccgccuacaucgaaaucaaccgcgucaccaucgacgacaccgccaccuacuucugcgcccgacaaaaauucgccucccgauacuccggcgaccaaggcucauacuucgaccucuggggccgaggaacccucaucgucgucuccuccgccuccaccaaaggcccccucggccuacccccccgcuccgcc

SEQ ID NO: 57105 - RNA, 414 nt, Artificial Sequence
  derived and/or modified sequence opt11 from anti-HIV-1_HeavyChain
caagcgcaccuggaacagagcgggagcggggucaagaaaccgggcgcaagcgugcgcgugagcuguuggacgcccgaggacauauucgagcgcacggaauuaauccauugggugcgacaggccccgggccagggccuggaauggaucgggugggugaaaauagucucgggcgcggucaauuucgggagcccgaacuuucgccagcgcgugagcuugaccagggacagggacuuguucacggcccauauggauaucaggggcuugacccagggcgacaccgcgaccuauuucugugccaggcaaaaguucgagcgcgggggccagggcuggaucuuugacuugugggggcgcgggaccuuaaucgcggucucgagcgcgagcccgcgcgcgcacaggagcucgcccaggagcgcg

SEQ ID NO: 57106 - RNA, 414 nt, Artificial Sequence
  derived and/or modified sequence opt11 from anti-HIV-1_HeavyChain
caagcgcaccuggaacagagcgggagcggggucaagaaaccgggcgcgagcgugcgcgugagcuguuggacgagcgaggacauauucgagcgcacggaacugauccauugggugcgccaggccccgggacagggccuggaauggaucgggugggugaaaccggucacgggcgcggucaaucucgcgcccaauuucaggcacagggucucgcucacgcgcgaucgcgaucucuuuaccgcgcacauggacauacgcgggcucacgcaaggggacacggccacauacuuuugcgcgcgccagaaauuugaaaggggcgggcaagggugguauuucgaucucuggggcaggggcacgcucauagucgugagcucggccucgaccaagggcccgagcguguucccgcacgaucucaga

SEQ ID NO: 57107 - RNA, 417 nt, Artificial Sequence
  derived and/or modified sequence opt11 from anti-HIV-1_HeavyChain
caggcccaucucgaacaaucgggcucgggcgugaaaaagcccggggccucggucagggucucgugcuggagcucggaagauaucuuugaaaggaccgagcucauacacugggucaggcaagcgcccgggcaagggcucgaguggauaggaugggucaaggccguaagcggggccgugaacuauggaucgcucgauuucaggcacagggucucgcucacgcgcgauagagaucucucgaccgcgcacauggacauacgcgggcucacgcaagacgacacggccacguacuuuugcgcgcgccagaaauuugccaggggcgaucaagggugguuuuucgaucuauggggcaggggcacgcucauagucgugagcucggccucgaccaagggcccgagcguguucccgcacgaucucagg

SEQ ID NO: 57108 - RNA, 414 nt, Artificial Sequence
  derived and/or modified sequence opt11 from anti-HIV-1_HeavyChain
caagcgcacuuggaacagagcgggagcggggucaagaaaccgggcgcgagcgugcgcguaagcuguuggacgagcgaggacauauucgagagaucggaacugauccauugggugcgccaggccccgggccagggccuggaauggaucgggugggugaaaacggucacgggcgcggucaauuucgggagcccgaacuuucgacagcgagugagcuugaccagggacagggacuuguucacggcccauauggauaucaggggcuugacccagggcgauaccgcgaccuauuucugugccaggcaaaaguucuaugccgggggccagggcugguacuuugacuugugggggcgcgggaccuugaucguggucucgagcgcgagcacgaaagcgcacaggagcucgcccaggagcacg

SEQ ID NO: 57109 - RNA, 414 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucaagagcgagcucauacacugggucaggcaagcgcccgggcaagggcucgaguggauaggcugggucaagaccgugaccggggccgugaacuuuggcucgagcgauuucaggcaaagggucucgcucacgcgagaucgcgaucucuuuaccgcgcacauggacauacgagggcuaacgcaaggggacacggccacguacuuuugcgcgcgccagaaauuuuacgcgggcgggcaagggugguauuucgaucuauggggcaggggcacgcuaauaguagugagcucggccucgaccaagggcccgagcguguucccgaccauaugcgua

SEQ ID NO: 57110 - RNA, 414 nt, Artificial Sequence
  derived and/or modified sequence opt11 from anti-HIV-1_HeavyChain
caagcgcacuuggaacagagcgggagcggggucaagaaacugggcgcgagcgugcgcgugagcuguuggacgagcgaggacauauucaagaccgagcucauacacugggucaggcaagcgcccgggcaagggcucgaguggauaggcugggucaaggccgugagcggggccgugaacuauggcucgcucgauuucaggcacagagucucacucacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucggccucgaccaaaggcccgagcguguucccgcacgaucuaagg

SEQ ID NO: 57111 - RNA, 417 nt, Artificial Sequence
  derived and/or modified sequence opt11 from anti-HIV-1_HeavyChain
caagcacacuuggaacagagcgggagcggggucaagaaaccgggagcgagcgugcgagugagcuguuggacgagcgaggacauauucgagaaaucggaauugauccauugggugcgccaggccccgggccagggcuuggaauggaucgggugggugaaaacggucacgggcgcggucaauuucgggagcucggacuuucgccagcgagugagcuugaccagggacagggacuuguucacggcccauauggauaucaggggccugacccagggcgauaccgcgacauauuucugugccaggcaaaaguucuaugcagggggccagggcugguacuuugaccugugggggagagggaccuugaucguggucucgagcgcgagcacgaaagggcccucgguauuucccacgaucuauguc

SEQ ID NO: 57112 - RNA, 417 nt, Artificial Sequence
  derived and/or modified sequence opt11 from anti-HIV-1_HeavyChain
caggcccaucucgagcaaucgggcucgggcgugaaaaagcccgggaccucggucagggucucgugcuggaccucggaagauaucuuugaaagaaccgagcucauacacugggucaggcaagcgcccgggcaagggcucgaguggauaggcugggucaagaccgugaccggggccgugaacuucggcucgcccaauuucaggcacagggucucgcuaacacgcgaucgcgaucuauuuaccgcgcacauggacauacgagggcucacgcaaggggacacggccacguacuuuugcgcgcgccagaaauuugccaggggcgaucaagggugguuuuucgaucucuggggcaggggcacgcucauagucguaagcucggccucgaccaagggcccgagcguguucccgaccauaugcgua

SEQ ID NO: 57113 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuucgaaaagagcgagcucauacacugggucagacaagcgccagggcaagggcucgaguggauaggcugggucaaaaccgugaccggggccgugaacuuuggcucgagcgauuucaggcaaagggucucgcucacgcgcgaucgcgaucuauuuaccgcgcacauggacauacgcgggcucacgcaaggggacacggccacguacuuuugcgcgcgccagaaauuuuacgcgggcgggcaagggugguauuucgaucucuggggcagaggcacgcucauagucgugagcucggccucgaccaagggcccgagcguguucccgcaaauauacgug

SEQ ID NO: 57114 - RNA, 417 nt, Artificial Sequence
  derived and/or modified sequence opt11 from anti-HIV-1_HeavyChain
caggcccaucucgagcaaucaggcucgggcgucaaaaagcccggggccucgguaagggucucgugcuggaccucggaagauaucuuugaaaagagcgagcucauacacugggucaggcaaacgcccgggcaagggcucgaguggauaggcugggucaagacagugaccggggccgugaacuuuggcucgagcgauuucaggcaaagggucucgcucacgcgagaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucggccucgaccaagggcccgagcguguucccgaccauauacgug

SEQ ID NO: 57115 - RNA, 417 nt, Artificial Sequence
  derived and/or modified sequence opt11 from anti-HIV-1_HeavyChain
caggcccaucucgagcaaucgggcucaggcgugaaaaagccaggggccucggucagggucucgugcuggaccucggaagauaucuuugaaaggaccgagcuaauacacugggucaggcaagcgcccgggcaagggcucgaguggauaggcugggucaagaucgugagcggggccgugaacuuuggcucgcccaauuucaggcaaagggucucgcucacgcgcgaucgcgaucucuuuaccgcgcacaugggcauacgcgggcucacgcaaggggacacggccacauacuuuugcgcgcgccagaaauuugaaaggggcgggcaaggguggauauucgaucucuggggcaggggcacgcucauagccgugagcucggccucgaccaagggcccgagcguguucccgaccauauacgug

SEQ ID NO: 57116 - RNA, 417 nt, Artificial Sequence
  derived and/or modified sequence opt11 from anti-HIV-1_HeavyChain
caagcacaccuagaacaaagcggcagcggagucaaaaaacuaggcgcaagcguacgcguaagcugcuggacaagcgaagacauauucgaacgcacagaacuaauccacuggguacgccaagccccaggccaaggccuagaauggaucggauggguaaaagcagucucaggcgcaguaaacuacggaagccuagacuuccgacaccgcguaagccucaccagagacagagaccuauucacagcccacauggacaucagaggccuaacccaagacgacaccgcaaccuacuucugcgccagacaaaaauucgcccgaggagaccaaggcugguucuucgaccuauggggacgcggaacccuaaucguagucuccagcgcaagcacaaaaggacccucagucuucccccacgaccuacgc

SEQ ID NO: 57117 - RNA, 417 nt, Artificial Sequence
  derived and/or modified sequence opt11 from anti-HIV-1_HeavyChain
caggcgcaccuggaacagagcgggagcggggugaagaagccgggggcgagcgugaggguaagcuguuggacgagcgaggacauauucgagaggacggaguugauacauugggugaggcaggcgccggggcaggggcuggaguggauaggguggguaaagacggugacgggggcggugaauuucgggagcccgaacuuuaggcauagggugagcuugacgagggacagggacuuguucacggcacauauggauauaaggggguugacgcagggggauacggcgacguauuucugugcgaggcagaaguucgagaggggggggcagggguggauauuugacuugugggggagggggacguugauagcggugaguagcgcgagcacgaaggggccaaguguguuuccgaggagcgcggug

SEQ ID NO: 57118 - RNA, 417 nt, Artificial Sequence
  derived and/or modified sequence opt11 from anti-HIV-1_HeavyChain
caagcgcacuuggaacagagcgggagcggagucaagaaaccgggcgcgagcgugcgcgugagcuguuggacgagcgaggacauauucgagcgcacggaauugauccauugggugcgacaggcaccgggccagggcuuggaauggaucggguggaugaaaauagucucgggcgcggucaauuucgggagcccgaacuuucgccagcgcgugagcuugaccagggacagggacuuguucacggcccauauggauaucaggggcuugacccagggcgauaccgcgaccuauuucugugccaggcaaaaguucgagcgcgggggccagggauggaucuuugacuugugggggcgcgggaccuugaucgcggucucgagcgcgagcacgaaagggccaucgguauuuccccaugacuugcga

SEQ ID NO: 57119 - RNA, 417 nt, Artificial Sequence
  derived and/or modified sequence opt11 from anti-HIV-1_HeavyChain
caggcccaucucgagcaaucgggcucgggcgugaaaaagcccggagccucggucagagucucgugcuggaccucggaagauaucucagaagggagcgagcucauacacugggucaggcaagcgcccgggcaagggcucgaguggauaggcugggucaagaccgugaccggggccgugaacuuuggcucggccuauuucagacacagggucucgcucacgcgcgaucgcgaucucuuuaccgcgcacauggacauacgcgggcucacgcaaggggacacggccacguacuuuugcgcgcgccagaaauuuuacaagggcgggcaagggugguauuucgaucucuggggcaggggcacgcuaauagucgugagcucggccucgaccaagggcccgagcguguucccgaccauaugcgug

SEQ ID NO: 57120 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaccgugaccggggccgugaacuauggcucgcucgauuucaggcacagggucucgcucacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucggccucgaccaagggcccgagcguguucccgcacgaucucagg

SEQ ID NO: 57121 - RNA, 417 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggucgagcgaggacauauucgagcgcacggaauugauccauugggugcgacaggccccgggccagggccuggaauggaucgggugggugaaaauagucucgggcgcggucaauuucgggagcccgaacuuccgccagcgcgugagcuugaccagggacagggacuuguucacggcccauauggauaucaggggccugacacagggcgauaccgcgaccuauuucugugcaaggcaaaaguucgagcgcggaggccagggcuggaucuuugacuugugggggcgcgggaccuugauagcggucucgagcgcgagcacgaaagggcccucgguauuucccacgaucuauguc

SEQ ID NO: 57122 - RNA, 417 nt, Artificial Sequence
  derived and/or modified sequence opt11 from anti-HIV-1_HeavyChain
caggcccaucucgagcaaucgggcucgggcgugaaaaggcccggggccucagucagggucucgugcuggaccucggaagauaucuuugaaacgaccgagcucauacacugggucagacaagcgcccgggcaagggcucgaguggauaggcugggucaagaccgugagcggggccgugaacuucggcucacucaauuucaggcacagggucucgcucacgcgcgaccgagaccucuuuaccgcgcacauggacauacgcgggcuaacgcaaggggacacggccacguacuuuugcgcgcgacagaaauuugccaggggcgaucaagggugguuuuucgaucucuggggcaggggcacgcucauagucgugagcucggccucgaccaagggcccgagcguguucccgaccauaugcgug

SEQ ID NO: 57123 - RNA, 417 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggaccucugaagacaucuucgaacgcaccgaacucauccacuggguccgccaagcccccggccaaggccucgaauggaucggcugggucaaaaccgucaccggcgccgucaaccucggcucccccaacuuccgccaccgcgucucccucacccgagaccgcgaccuauucaccgcccacauggacauccgaggccuaacccaaggcgacacagccaccuacuucugcgcccgccaaaaauucgaacgcggcggccaaggcugguacuucgaccucuggggaagaggcacccucaucguagucuccuccgccuccaccaaaggccccuccgucuucccccacgaccuccgc

SEQ ID NO: 57124 - RNA, 417 nt, Artificial Sequence
  derived and/or modified sequence opt11 from anti-HIV-1_HeavyChain
caggcccaucucgagcaaucaggcucgggcgugaaaaagcucggggccucggucagggucucgugcuggaccucagaagauaucuuugaaaggacagagcucauacacugggucaggcaagcgcccgggcaagggcucgaguggauaggcugggucaaggccgugagcggggccgugaacuauggcucgcucgauuucaggcacaggguaucgcucacgcgagaucgcgaucuaucgaccgcgcacauggacauacgcgggcucacgcaagaugacacggccacguacuuuugcgcgcgccagaaauuugaaaggggcgggcaaggguggauauucgaucucuggggcaggggcacgcucauagccgugagcucggccucgaccaagggcccgagcguguucccgaccauaugcgug

SEQ ID NO: 57125 - RNA, 417 nt, Artificial Sequence
  derived and/or modified sequence opt11 from anti-HIV-1_HeavyChain
caggcccaucucgagcaaucgggcucgggcgugaaaaagcccggggccucggucaggguaucgugcuggaccucggaagauaucuuugaaaggacagagcucauacacugggucaggcaagcgcccgggcaagggcucgaguggauaggcugggucaagaccgugaccggggccgugaacuuuggcucgcccaauuucaggcacagagucucgcuaacacgagaucgcgaucucuuuaccgcgcacauggacauacgcgggcuaacgcaaggggacacggccacguacuucugcgcgcgccagaaauuugaaaggggcgggcaagggugguauuucgaucucuggggcaggggcacgcucauagucgugagcucagccucgaccaagggcccgagcguguucccgcacgaucucgug

SEQ ID NO: 57126 - RNA, 417 nt, Artificial Sequence
  derived and/or modified sequence opt11 from anti-HIV-1_HeavyChain
caggcccaucucgagcaaucgggcucgggcgugaaaaagcccggggccucggucagagucucgugcuggagcucggaagauaucuuugaaaggaccgagcucauacacugggucaggcaagcgcccgggcaagggcucgaguggauaggcugggucaaggccgugagcggggccgugaacuacggcucgcucgauuucaggcacagagucucacucacgcgcgaucgcgaccucuuuaccgcgcacauggacauacgcgggcucacgcaagaugacacagccacguacuuuugcgcgcgccagaaauuugccaggggcgaucaaggaugguuuuucgaucucuggggcaggggcacgcucauagucgugagcucggccucgaccaagggcccgagcguauucccgaccauauacgug

SEQ ID NO: 57127 - RNA, 420 nt, Artificial Sequence
  derived and/or modified sequence opt11 from anti-HIV-1_HeavyChain
cagguccaucucgagcaaucgggaucaggcgugaaaaagccaggggccccgguaaggguaucgugcuggagcagugaagauauauuugaaaggaccgagcuaauacacugggucaggcaagcgccagggcaagggcuagaguggauaggauggguaaagacagugacaggggccgugaacuuuggaucgcuagacuucaggcacaggauaucgcuaacgcgagauagagaucuauuuacagcgcacauggacauaagggggcuaacgcaaggggacacggcaacguacuuuugcgcgagacagaaauuuuacgcgggcgggcaagggugguauuucgaucuguggggcaggggcacgcuaauaguagugagcucggccucgacaaaggcacauagcgugcuaccgcccaggagcaggguc

SEQ ID NO: 57128 - RNA, 417 nt, Artificial Sequence
  derived and/or modified sequence opt11 from anti-HIV-1_HeavyChain
caggcccaucucgagcaaucgggcucgggagugaaaaagcccggggcccuggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacacgcgaucgcgaucucuuuaccgcgcacauggacauacgcgggcucacgcaaggggacacggccacguacuucugcgcgcgccagaaauuuuacgcgggcgggcaagggugguauuucgaucucuggggcaggggcacgcucauagucgugagcucggccucgaccaagggcccgagcguguucccgcacgaucucagg

SEQ ID NO: 57129 - RNA, 414 nt, Artificial Sequence
  derived and/or modified sequence opt11 from anti-HIV-1_HeavyChain
caagugcaacugguccagagcggggccgaggucaagaaaccgggcgcgagcguaaaaguaagcugucaagugagcggguacacgcucacggaauugagcaugcacugggucaggcaagcgcccgggcaagggcucgaguggauaggcugggucaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgacagaaauuugaaaggggcgggcaagggugguauuucgaucucuggggcaggggcacgcuaauagucgugagcucggccucgaccaagggcccgagcguguucccgcacgaucuaagg

SEQ ID NO: 57130 - RNA, 414 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucaagaccgagcucauacacugggucaggcaagcgcccgggcaagggcucgaguggauaggcugggucaagauagugagcggggccgugaacuuuggcucgcccaauuucaggcaaagggucucgcucacgcgcgaucgcgaucucuuuaccgcgcacauggacauacgcgggcucacgcaaggggacacggccacauacuuuugcgcgcgccagaaauuugaaaggggcgggcaaggguggauauucgaucucuggggcaggggcacgcucauagccgugagcucggccucgaccaagggcccgagcguguucccgcacgaucuaagg

SEQ ID NO: 57131 - RNA, 417 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcaagggcucgaguggauaggcuggguaaaggccgugagcggggccgugaacuauggcucgcucgauuucaggcacagggucucgcucacgcgcgaucgcgaucucuuuaccgcgcacauggacauacgcgggcucacgcaagaugacacggccacguacuuuugcgcgagacagaaauuugccaggggcgaucaagggugguuuuucgaucucuggggcagaggcacgcucauagucgugagcucggccucgaccaagggcccgagcguguucccgaccauaugcgug

SEQ ID NO: 57132 - RNA, 417 nt, Artificial Sequence
  derived and/or modified sequence opt11 from anti-HIV-1_HeavyChain
caggcccaucucgagcaaucgggcucgggcgugaaaaagccaggggccucggucagggucucgugcuggaccucggaagauaucuuugaaaagagcgagcucauacacugggucaggcaagcgcccgggcaagggcucgagugggugggcugggucaaaaccgugaccggggccgugaacuuuggcucgagcgauuucaggcaaagggucucgcucacgcgcgaucgcgaucuauuuaccgcgcacauggacauacgcgggcuaacgcaaggggacacggccacguacuuuugcgcgcgccagaaauuuuacgcgggcgggcaagggugguauuucgaucucuggggcaggggcacgcucauagucgugagcucggccucgaccaagggcccgagcguguucccgcacgaucucagg

SEQ ID NO: 57133 - RNA, 417 nt, Artificial Sequence
  derived and/or modified sequence opt11 from anti-HIV-1_HeavyChain
caggcgcacuuggagcagagcgggagcggggugaagaagccgggggcgagcgugagagugagcuguuggacgagugaggacauauucgagaagagugaguugauacauugggugaggcaggcgccggggcagggguuggaguggauagggugggugaagacggugacgggggcggugaauuucgggagcagugacuuuaggcagagggugagcuugacgagggacagggacuuguucacggcgcauauggauauaaggggauugacgcagggggauacggcgacguauuucugugcgaggcagaaguucgagaggggagggcaggggugguacuuugauuugugggggagggggacguugauaguggugaguagcgcgagcacgaaggggccgaguguguuuccgacgauaugugug

SEQ ID NO: 57134 - RNA, 417 nt, Artificial Sequence
  derived and/or modified sequence opt11 from anti-HIV-1_HeavyChain
caagcgcaccuggaacagagcgggagcggggucaagaaauugggcgcgagcgugcgcgugagcuguuggacgagcgaggacauauucgagcgaacggaacugauccauugggugcgacaggccccgggccagggcuuggaauggaucggaugggugaaagcggucucgggagcggucaauuacgggagcuuggacuuucgccaucgcgugagcuugaccagggacagggacuugagcacggcccauauggauaucaggggccugacccaggacgauaccgcgacauauuucugugcaaggcaaaaguucgcgcgaggggaccagggcugguucuuugacuugugggggcgcgggaccuugaucguggucucgagcgcgagcacgaaagggcccucgguauuuccacagaucuguguc

SEQ ID NO: 57135 - RNA, 414 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccacugggugcgccaggccccgggccagggcuuggaauggaucgggugggugaaaacggucacaggcgcggucaauuucgggcaccagaucucggacagggucucgcucacgcccgaucgcgaucucuuuaccgcgcacauggacauacgcgggcucacacaaggggacacggccacguacuuuugcgcgcgccagaaauuuuacgcgggcgggcaagggugguauuucgaucucuggggcaggggaacgcucauagucgugagcucggccucgaccaagggcccgagcguguucccgaccauaugcgug

SEQ ID NO: 57136 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggacaucggaagauaucuuugaaaagagcgagcucauacacugggucaggcgcgcgcccgggcaagggcucgaguggauaggcugggucaagaccgugaccggggccgugaacuuuggcucgagcgauuucaggcaaagggucucgcucacgcgcgaucgcgaucucuuuaccgcacacauggacauacgcgggcucacgcaaggggacacggccacguacuuuugcgcgcgccagaaauuuuacgcgggcgggcaagggugguauuucgaucucuggggcaggggcacgcucauagucgugagcucggccucgaccaaggcccaucgcucgagcccgaccauaugcgug

SEQ ID NO: 57137 - RNA, 417 nt, Artificial Sequence
  derived and/or modified sequence opt11 from anti-HIV-1_HeavyChain
caggcccaucucgagcaaucaggcucgggcgugaaaaagcucggggccucggucagggucucgugcuggaccucggaagauaucuuugaaaggaccgagcucauacacugggucaggcaagcgcccgggcaaggacucgaguggauaggcugggucaaggccgugagcggggccgugaacuauggcucgcucgauuucaggcacagggucucgcucacgcgcgaucgcgaucucuuuaccgcgcacauggacauacgagggcucacgcaagaugacacggccacguacuuuugcgcgcgccagaaauucgccaggggcgaucaagggugguuuuucgaucuauggggcaggggcacgcucauagucgugagcucggccccgaccaagggcccgagcguguucccgaccauaugcgug

SEQ ID NO: 57138 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggaaggggcacgcucauagucgugagcucggccucgaccaagggcccgagcguguucccgcaaauauacgug

SEQ ID NO: 57139 - RNA, 417 nt, Artificial Sequence
  derived and/or modified sequence opt11 from anti-HIV-1_HeavyChain
caggcccaucucgagcaaucaggcucgggcgugaaaaagcccggggccucagucagggucucgugcuggaccucggaagauaucuuugaaaagagcgagcucauacacugggucaggcaagcgcccgggcaagggcucgaguggauaggcuggguaaagaccgugaccggggccgugaacuucggcucgagcgauuucaggcaaagggucucgcuaacgcgcgggcgcgaucucuuuaccgcgcacauggacauacgcggacucacgcaaggggacacggccacguacuuuugcgcgcgccagaaauuuuacgcgggcgggcaagggugguauuucgaucucuggggcaggggcacgcucauagucgugagcucggccucgaccaagggaccgagcguguucccgaccauaugcgug

SEQ ID NO: 57140 - RNA, 417 nt, Artificial Sequence
  derived and/or modified sequence opt11 from anti-HIV-1_HeavyChain
caagcccaccucgaacaauccggcuccggcgucaaaaaacccggcgccuccguccgagucuccugcuggaccuccgaagacaucuucgaacgcaccgaacucauccacuggguccgccaagcccccggacaaggccucgaauggaucggcugggucaaaaccgucaccggcgccgucaacuucggcucaccaaacuuccgacacagagucucccucacccgcgaccgcgaccucuccaccgcccacauggacauccgcggccucacccaagacgacaccgccaccuacuucugcgcccgccaaaaauucgcccgcggcgaccaaggcugguucuucgaccucuggggccgcggcacccucaucgucgucuccuccgccuccaccaaaggccccuccgucuucccccacgaccacguc

SEQ ID NO: 57141 - RNA, 417 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggccuggaauggaucgggugggugaaaacggucacgggcgcggucaauuucgggagcccgaacuuucgccaucgcgugagcuugaccagggacagggacuuguucacggcccauauggauaucaggggcuugacccagggcgacaccgcgaccuauuucugugccaggcaaaaguucuaugccgggggccagggcugguacuuugacuugugggggcgcgggaccuugaucguggucucgagcgcgagcacgaaagggcccucggucuucccccagaucuguguc

SEQ ID NO: 57142 - RNA, 417 nt, Artificial Sequence
  derived and/or modified sequence opt11 from anti-HIV-1_HeavyChain
caggcccaucuagagcaaucgggcucgggcgugaaaaagcccggggccucggucagggucucaugcuggaccucggaagauaucuuugaaaggaccgagcucauacacugggucaggcaagcgcccgggcaagggcucgaguggauaggcugggucaagaucgugagcggggccgugaacuucggcucgcccaauuucaggcaaagggucucgcucacgcgcgaucgagaucuauuuaccgcgcacauggacauacgcgggcucacgcaaggggacacggccacguacuuuugcgcgcgacagaaauuugaaagaggcgggcaaggguggauauucgaucucuggggcaggggcacgcucauagucgugagcucggccucgaccaagggcccgagcguguucccgaccauaugcgug

SEQ ID NO: 57143 - RNA, 417 nt, Artificial Sequence
  derived and/or modified sequence opt11 from anti-HIV-1_HeavyChain
caggcccaucucgagcaaucgggcucgggcgugaaaaagcccggggccucgguaagggucucgugcugggcaucggaagauaucuuugaaaggaccgagcuaauacacugggucaggcaagcgcccgggcaagggcucgaguggauaggaugggucaagaccgugaccggggcagugaacuuuggcucgcccaauuucaggcacagggucucgcuaacgcgcgaucgcgaucucuuuaccgcgcacauggacauacgcgggcucacgcaaggggacacggccacguacuuuugcgcgcgacagaaauuuuacgcgggcgggcaagggugguauuucgaucucuggggcaggggcacgcucauagucguaagcucggccucgaccaagggcccgagcguguucccgcacgaucucuug

SEQ ID NO: 57144 - RNA, 417 nt, Artificial Sequence
  derived and/or modified sequence opt11 from anti-HIV-1_HeavyChain
caggcccaucuagagcaaucaggcucgggcgugaaaaagccaggggccucggucagagucucgugcuggaccucggaagauaucuucgaaaagagcgagcucauacacugggucaggcaagcgcccgggcaagggcucgaguggauaggaugggucaagaccgugacaggggccgugaacuucggaucgagcgacuucaggcaaagggucucgcucacgcgcgaucgcgaucucuuuaccgcgcacauggacauaagagggcucacgcaaggggacacggccacguacuuuugcgcgcgccagaaauuugaaaggggcgggcaaggguggauauucgaucucuggggcaggggcacgcucauagccgugagcucggccucgaccaagggcccgagcguguucccgcacgaucucagg

SEQ ID NO: 57145 - RNA, 417 nt, Artificial Sequence
  derived and/or modified sequence opt11 from anti-HIV-1_HeavyChain
caagcgcacuuggaacagagcgggagcggggucaagaaaccgggagcgagcgugcgagugagcuguuggacgagcgaggacauauucgagcgcacggaauugauccauugggugcgccaggccccgggccagggccuggaauggaucgggugggugaaagcggucucgggcgcgguaaauuacgggagcuuggacuuucgacaucgcgugagcuugaccagggacagggacuugagcacggcccauauggauaucaggggcuugacccaggacgauacagcgaccuauuucugugccaggcaaaaguucgcgcgcggggaccagggcugguucuuugacuugugggggcgcgggaccuugaucguggucucgagcgcgagcacgaaagggcccucggucuuuccccaugacuugcgc

SEQ ID NO: 57146 - RNA, 417 nt, Artificial Sequence
  derived and/or modified sequence opt11 from anti-HIV-1_HeavyChain
caggcccaucucgagcaaucgggcucgggcgugaaaaagcccggggccucggucagagucucgugcuggaccucggaagauaucuuugaaaggagcgagcucauacacugggucaggcaagcgcccgggcaagggcucgaguggauaggcugggucaagaccgugaccggggccgugaacuuuggcucgcccaauuucaggcacagggucucgcucacgcgcgaucgagaucucuuuaccgcgcacauggacauacgcgggcucacgcaaggggacacggccacguacuuuugcgcgcgacagaaauauuacgcgggcgggcaagggugguauuucgaucucuggggcaggggcacgcucauagucguaagcucggccucgaccaagggcccgagcguguucccgaccauaugcagg

SEQ ID NO: 57147 - RNA, 417 nt, Artificial Sequence
  derived and/or modified sequence opt11 from anti-HIV-1_HeavyChain
caggcccaucucgagcaaucgggcucgggcgugaaaaagcccggagccucggucagagucucgugcuggaccucggaagauaucuuugaaaagagcgagcucauacacugggucaggcaagcgcccgggcaagggcucgaguggauaggcugggucaagacagugaccggggccgugaacuuuggcucaagcgauuucaggcaaagggucucgcucacgcgcgaucgcgaucucuuuacagcgcacauggacauacgcgggcucacgcaaggggacacggccacguacuuuugcgcgcgccagaaauucgaaaggggcgggcaagggugguauuucgaucuauggggcaggggcacgcucauagucgugagcucggcaucgaccaagggaccgagcguguucccgcacgaucucagg

SEQ ID NO: 57148 - RNA, 417 nt, Artificial Sequence
  derived and/or modified sequence opt11 from anti-HIV-1_HeavyChain
caggcccaccucgagcaaucgggcucgggcgugaaaaagcucggggccucgguccgggucucgugcuggaccucggaagacaucuuugaaaggacagagcuaauacacugggucaggcaagcgccagggcaagggcuagaguggauaggcugggucaaggccgugagcggggccgugaacuauggcucgcucgauuucaggcacagggucucgcucacgcgcgaucgcgaucucuuuaccgcgcacauggacauacgcggacuaacgcaagaugacacggcaacguacuucugcgcgcgccagaaauuugccaggggcgaccaagggugguuuuucgaucucuggggcaggggcacgcucauagucgugagcucggccucgaccaagggcccgagcguguucccgaccauauacgug

SEQ ID NO: 57149 - RNA, 417 nt, Artificial Sequence
  derived and/or modified sequence opt11 from anti-HIV-1_HeavyChain
caggcccaucucgagcaaucgggcucgggcgugaaaaagcccggggccucagucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaccgcgaucucuuuaccgcgcacauggacauacgcggacucacgcaaggggacacggccacguacuuuugcgcgcgccagaaauuuuacaagggcgggcaagggugguauuucgaucucuggggcaggggcacgcucauagucguaagcucggccucgaccaagggcccgagcguguucccgcacgaucucagg

SEQ ID NO: 57150 - RNA, 417 nt, Artificial Sequence
  derived and/or modified sequence opt11 from anti-HIV-1_HeavyChain
caagcacaccuagaacagagcggaagcggggucaaaaaaccaggagcgagcguacgcgugagcugcuggacaagcgaagacauauucgaacgcacagaacugauccacugggugcgccaggccccaggccaaggccuagaauggaucggauggguaaaaacggucacaggcacagucaacuucggaagccuaaacuuccgccagcgcguaagccugaccagggacagagaccuauucacagcccacauggacaucagaggccugacccaggacgacaccgcgaccuacuucugcgccaggcaaaaauucgcacgcggagaccagggcugguucuucgaccuauggggacgcgggacccuaaucguagucucaagcgcaagcacgaaaggacccucggucuucccccacgaccuacga

SEQ ID NO: 57151 - RNA, 417 nt, Artificial Sequence
  derived and/or modified sequence opt11 from anti-HIV-1_HeavyChain
caggcccaccucgagcaaucgggcucgggcgugaaaaagcccggggccucggucagggucucgugcuggcccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgagaucucuuuacagcgcacauggacauacgcgggcucacgcaaggagacacggccacguacuuuugcgcgcgccagaaauuugaaaggggcgggcaaggguggauauucgaucuauggggcaggggcacgcucauagccgugagcucggccucaaccaagggcccgagcguguucccgcacgaucucagg

SEQ ID NO: 57152 - RNA, 417 nt, Artificial Sequence
  derived and/or modified sequence opt11 from anti-HIV-1_HeavyChain
caagcgcacuuggaacagagcgggagcggggucaagcgcccgggcgcgagcgugcgagugagcuguuggacgagcgaggacauauucgagaccacggaauugauccauugggugcgccaggccccgggccagggcuuggaauggaucgggugggugaaaacggucucgggcgcggucaauuucgggagcuugaacuuucgccaucgcgugagcuugaccagggacagggacuuguucacggcccauauggauaucaggggcuugacccagggcgauaccgcgaccuauuucugugccaggcaaaaguucgcgcgcggggaccagggcugguucuuugacuugugggggcgcgggaccuugaucguggucucgagcgcgagcacgaaagggcccucggucuuuccccaugacuugcgc

SEQ ID NO: 57153 - RNA, 417 nt, Artificial Sequence
  derived and/or modified sequence opt11 from anti-HIV-1_HeavyChain
caggcacaccuagagcaaaguggaagcggaguggaaaagccaggggcaucaguaagggugagcugcuggacaagcgaagauauauuugaaaggagcgagcugauacacuggguaaggcaagcgccagggcaagggcuagaguggauaggauggguaaagaccgugacaggggcagugaacuucggaucgccaaacuucaggcacaggguaagccuaacgagagacagagaccuauuuacagcgcacauggacauaagagggcugacgcaaggggacacggcaacguacuucugcgcgagacagaaauacuacgcgggagggcaagggugguacuucgaucuauggggaaggggaacgcuaauagucgugagcagcgcaagcacaaaggggccgagcguguucccgcacgaccuaagg

SEQ ID NO: 57154 - RNA, 417 nt, Artificial Sequence
  derived and/or modified sequence opt11 from anti-HIV-1_HeavyChain
caagcgcaccuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaauagucucaggcgcgguaaauuucgggagcccgaacuuucgccagcgcgugagcuugaccagggacagggacuuguucacggcccauauggauaucaggggcuugacccagggcgacaccgcgaccuauuucugugccaggcaaaaguucgagcgcgggggccagggcuggaucuuugacuugugggggcgagggacccugaucgcggucucgagcgcgagcacgaaagggcccucggucuuuccccaugacuugcgc

SEQ ID NO: 57155 - RNA, 417 nt, Artificial Sequence
  derived and/or modified sequence opt11 from anti-HIV-1_HeavyChain
caagcgcaccuggaacagagcgggagcgggguaaagaaaccgggcgcgagcgugcgcgugagcuguuggacgagcgaggacauauucgagcgcacggaacugauccauugggugcgccaggccccgggccagggcuuggaauggaucgggugggugaaaacggucacgggcgcggucaauuucgggagcccgaacuuucgccaucgcgugagcuugaccagggacaggaacuuguucacggcccauauggauaucaggggcuugacccagggcgauaccgcgaccuauuucugugccagacaaaaauucgagcgcgggggccagggcugguacuuugacuugugggggcgcgggaccuugaucguggucucgagcgcgagcacgaaagggcccucggucuuuccccaugacuugcgc

SEQ ID NO: 57156 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggaugggucaagaucgugagcggggccgugaacuuuggcucgccaaauuucaggcaaagggucucgcucacgcgcgaucgcgaucucuuuaccgcgcacauggacauacgcgggcucacgcaaggggacacggcaacauacuuuugcgcgcgccagaaauuuuacgcgggcgggcaagggugguauuucgaucuauggggcaggggcacgcucauagucgugagcucggccucgaccaagggcccgagcguguucccgcacgaucucagg

SEQ ID NO: 57157 - RNA, 417 nt, Artificial Sequence
  derived and/or modified sequence opt11 from anti-HIV-1_HeavyChain
caggcacaccuagagcaaagcggaagcggagugaaaaagccaggggcaagcguaaggguaagcugcuggacaagcgaagacauauucgaaaggacagagcugauacacuggguaaggcaggcgccagggcaagggcuagaguggauaggauggguaaagacagugacaggggcagugaacuacggaagccuaaacuucagaagcaggauaagccugacgagggacagggaccuauucacagcgcacauggacauaagagggcugacgcaaggggacacggcaacguacuucugcgcgagacagaaauucgaaaggggagggcaaggguggauauucgaccuauggggaaggggaacgcuaauagcagugagcagcgcaagcacaaagggaccgagcguguucccgcacgaccuaaga

SEQ ID NO: 57158 - RNA, 417 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcuaauauacuggguaaggcaagcgcccgggcaagggcucgaguggauaggcugggucaagaucgugagcgggaccgugaacuuugccucgcuagauuucaggaacaggaucucgcucucgcgcgaucgcgaccucucgaccgcgcacauggacauacgcgggcuaacgcaaggggacacggccacguacuuuugcgcgagacagaaauuuuacgcgggcgggcaagggugguauuucgaucucuggggcagaggcacgcucauagucgugagcucggccucgaccaagggcccgagcguguucccgcacgaucucagg

SEQ ID NO: 57159 - RNA, 417 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggaccuccgaagacaucuucgaacgcaucgaacucauccacuggguccgccaagcccccggccaaggccucgaauggaucggcugggucaaaaccgucaccggagccgucaacuucggcucccccaacuuccgccaccgcgucucccucacccgcgaccgcgaccucuucaccgcccacauggacauccgaggccucacccaaggcgacaccgccacauacuucugcgcccgccaaaaauucgaacgcggcggccaaggcugguacuucgaccucuggggccgcggcacccuaaucgucgucuccuccgccuccaccaaaggccccucagucuucccccacgaccuccgc

SEQ ID NO: 57160 - RNA, 417 nt, Artificial Sequence
  derived and/or modified sequence opt11 from anti-HIV-1_HeavyChain
caggcccaucucgagcaaucaggcucgggcgugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcaaagggucucgcucacgcgcgaucgagaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucggccucgaccaagggaccgagcguguucccgcacgaucucaga

SEQ ID NO: 57161 - RNA, 417 nt, Artificial Sequence
  derived and/or modified sequence opt11 from anti-HIV-1_HeavyChain
caagcccaccucgaacaauccggauccggcgucaaaaaacccggagccuccguccgcgucuccugcugguccuccgaagacaucuucgaacgcgccgaacucauccacuggguccgccaagcccccggccaaggccucgaauggaucggcugggucaaaaccgucaccggcgccgucaacuucggcucccccaacuuccgccaacgcgucucccucacccgcgaccgcgaccucuucaccgcccacauggacauccgcggccucacccaaggcgacaccgccaccuacuucugcgcccgccaaaaauucgaacgcggcggccaaggcuggaucuucgaccucuggggccgcggcacccucaucgccgucuccuccgccuccaccaaaggccccuccgucuucccccacgaccuccga

SEQ ID NO: 57162 - RNA, 417 nt, Artificial Sequence
  derived and/or modified sequence opt11 from anti-HIV-1_HeavyChain
caagcccaccucgaacaaucaggcuccggcgucaaaaaacccggcgcauccguccgcgucuccugcuggaccucagaagacaucuucgaacgcaccgaacucauccacuggguccgccaagcccccggccaaggccucgaauggaucggcugggucaaagccgucuccggcgcagucaacuacggcucccucgacuucagacaccgagucucccucacacgcgaccgcgaccucuucaccgcccacauggacauccgcggccucacccaagacgacacagccaccuacuucugcgcccgccaaaaauucgcccgcggcgaccaaggcugguucuucgaccucuggggccgcggcacccuaaucgucgucuccuccgccuccaccaaaggccccuccgucuucccacacgaccuacgc

SEQ ID NO: 57163 - RNA, 417 nt, Artificial Sequence
  derived and/or modified sequence opt11 from anti-HIV-1_HeavyChain
cagagccaucucgagcaaucgggcucggccaugaaaaagcccggggccucggucagggucucaugcuggaccucggaagauaucuuugacacgaccgagcucauauacugggucagacaagcgcccgggcaaggacucgaguggauaggcugggucaagaucgugagcgggaccgugaacuuugccucacucgauuucaggaacaggaucucgcucucgcgcgaucgcgaucucucgaccgcgcacauggacauacgcgggcucacgcaagaugacacggccacguacuuuugcgcgcgccagaaauuugaaaggggcgggcaagggugguauuucgaucucuggggcaggggcacgcucauagucgugagcucggccucgaccaagggcccgagcguguucccgcacgaucucagg

SEQ ID NO: 57164 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggagcucggaagauaucuuugaaaggaccgagcuaauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgacagaaauuuuacgcgggcgggcaagggugguauuucgaucucuggggcaggggcacgcucauagucgugagcucggccucgaccaagggcccgagcguguucccgcacgaucucagg

SEQ ID NO: 57165 - RNA, 417 nt, Artificial Sequence
  derived and/or modified sequence opt11 from anti-HIV-1_HeavyChain
caggcccaucuagagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaagaugacacggccauauacuuuugcgcgcgccagaaauuugccaggggcgaucaagggugguuuuucgaccucuggggcaggggcacgcucauagucgugaguucggccucgaccaagggcccgagcguguucccgcacgaucucagg

SEQ ID NO: 57166 - RNA, 417 nt, Artificial Sequence
  derived and/or modified sequence opt11 from anti-HIV-1_HeavyChain
caagcacacuuggaacagagcgggagcggggucaagggcccgggcgcgagcgugcgagugagcuguuggacgagcgaggacauauucgagaccacggaauugauccauugggugcgccaggccccgggccagggcuuggaauggaucgggugggugaaaacggucucgggcgcggucaauuucgggagcuugaacuuucgccaucgcgugagcuugaccagagacagggacuuguucacggcccauauggauaucaggggcuugacccagggcgauaccgcgaccuauuucugcgccaggcaaaaguucgcgcgcggggaccagggcugguucuuugaccugugggggcgcgggacccugaucguggucucgagcgcgagcacgaaagggcccucggucuuuccccaugacuugcgc

SEQ ID NO: 57167 - RNA, 417 nt, Artificial Sequence
  derived and/or modified sequence opt11 from anti-HIV-1_HeavyChain
caggcccaccucgagcaaucaggcucgggcgugaaaaagcccggggccucggucagggucucgugcuggaccucggaagauaucuuugaagggagcgagcucauacacugggucaggcaagcgcccgggcaaggacucgaguggauaggcugggucaagacagugaccggggccgugaacuuuggcucggccuauuucaggcacagggucccgcucacgcgagauagagaucucuuuaccgcgcacauggacauacgagggcucacgcaaggggacacggccacguacuuuugcgcgcgccagaaauuuuacaagggcgggcaagggugguauuucgaucucuggggcaggggcacgcucauagucgugagcucggccucgaccaagggcccgagcguguucccgcacgaucuaagg

SEQ ID NO: 57168 - RNA, 417 nt, Artificial Sequence
  derived and/or modified sequence opt11 from anti-HIV-1_HeavyChain
caagcacacuuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgacaucgcgugagcuugaccagggacagggacuuguucacggcccauauggauaucaggggcuuaacccagggagauacagcgaccuauuucugugccaggcaaaaguucgagcgcgggggccagggcugguacuuugacuugugggggcgcgggaccuugaucguggucucgagcgcgagcacgaaagggcccucggucuuuccacaugacuugcgc

SEQ ID NO: 57169 - RNA, 417 nt, Artificial Sequence
  derived and/or modified sequence opt11 from anti-HIV-1_HeavyChain
caggcccaucucgagcaaucgggaucgggagugaaaaaggucggggccucggucagggucucgugcuggaccucagaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaccgcgaucucuuuaccgcgcacauggacauacgagggcucacgcaaggagacacggccacguacuuuugcgcgcgccagaaauuuuacgcgggcgggcaaggaugguauuucgaucucuggggcaggggcacgcucauugucgugagcucggccucgaccaagggcccgagcguguucccgcacgaucuaagg

SEQ ID NO: 57170 - RNA, 417 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggacagggcuuggaauggaucgggugggugaaaacggucacgggcgcagucaauuucgggagcccgaacuuucgccaucgcgugagcuugaccagggacagggacuuguucacggcccauauggauaucaggggcuugacccaggacgauaccgcgaccuauuucugugccaggcaaaaguucgcgcgcggggaccagggcugguucuuugaccugugggggcgcgggaccuugaucguggucucgagcgcaagcacgaaagggccaucggucuuuccccaugaccugcgc

SEQ ID NO: 57171 - RNA, 417 nt, Artificial Sequence
  derived and/or modified sequence opt11 from anti-HIV-1_HeavyChain
cagagccaucucgagcaaucgggcucggccaugaaaaagcccggggccucggucagggucucgugcuggacaucggaagauaucuuugaaaggaccgagcucauauacugggucaggcaagcgcccgggcgcgggcuagaguggauaggcugggucaagaccgugagcgggacagugaacuuuggcucgagcgauuucaggaacaggaucucgcucacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucggccucgaccaagggcccgagcguguucccgcacgaucucaga

SEQ ID NO: 57172 - RNA, 417 nt, Artificial Sequence
  derived and/or modified sequence opt11 from anti-HIV-1_HeavyChain
caagcgcaccuggaacagagcgagagcgggguaaagaaauugggcgcgagcguacgcgugagcuguuggacgagcgaggacauauucgagcgcacggaauugauccauugggugcgccaggccccgggccagggauuggaauggaucgggugggugaaagcgguaucgggcgcggucaauuacgggagcuuggacuuucgccaucgcgugagcuugaccagggacagggacuuguucacggcccauauggauaucaggggccugacccaggacgauaccgcgaccuauuucugugccaggcaaaaguucgcgcgcggggaccagggcugguucuuugacuugugggggcgcgggaccuugaucgugguaucgagcgcgagcacgaaagggcccucggucuuuccccaugacuugcgc

SEQ ID NO: 57173 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcuaacgcgcgaucgcgaucucuuuaccgcgcacauggacauacgagggcucacgcaaggggacacggccacguacuuuugcgcgcgccagaaauuuuacgcgggcgggcaagggugguauuucgaucucuggggcaggggaacgcuaauagucgugagcucggccucgaccaagggcccgagcguguucccgaccacgcucagg

SEQ ID NO: 57174 - RNA, 417 nt, Artificial Sequence
  derived and/or modified sequence opt11 from anti-HIV-1_HeavyChain
caggcccaucucgagcaaucgggcucaggcgugaaaaaggucggggccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucggccucgaccaagggcccgagcguguucccgcacgaucucagg

SEQ ID NO: 57175 - RNA, 420 nt, Artificial Sequence
  derived and/or modified sequence opt11 from anti-HIV-1_HeavyChain
caagcgcgcccgggcgcgaacaggggcucgggcgugaaaaagcccggggccucggucagggucucgugcuggaccucagaagauaucuuugaaaggaccgagcucauacacugggucaggcaagcgcccgggcaagggcucgaguggauaggcugggucaagaucgugagcggggccgugaacuuuggcucgcccaauuucaggcaaagggucucgcucacgcgagaucgcgaucucuuuaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucggccucaacaaagggcccgagcguguucccgcacgaucucagg

SEQ ID NO: 57176 - RNA, 417 nt, Artificial Sequence
  derived and/or modified sequence opt11 from anti-HIV-1_HeavyChain
caagcccaccucgaacaauccggcuccggcgucaaaaaacccggcgccuccguacgcgucuccugcuggaccuccgaagacaucuucgaacgcuccgaacucauccacuggguccgccaagccccaggccaaggccuagaauggaucggcugggucaaaaccgucaccggcgccgucaacuucggcucccccaacuuccgccaccgcgucucccucacccgcgaccgagaccucuucaccgcccacauggacauccgcggccucacccaaggcgacaccgccaccuacuucugcgcccgccaaaaauacuacgcaggcggccaaggcugguacuucgaccucuggggccgcggcacccucaucguagucuccuccgccuccaccaaaggacccucagucuucccccacgaccuccgc

SEQ ID NO: 57177 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucagaagauaucuuugaagggagcgagcucauacacugggucaggcaagcgcccgggcaagggcucgaguggauaggcugggucaagaccgugaccggggccgugaacuuuggcucggccuauuucaggcacagggucucgcuaacgcgcgaucgcgaucucuuuaccgcgcacauggacauacgagggcucacgcaaggggacacggccacguacuuuugcgcgcgccagaaauuuuacaagggcgggcaagggugguauuucgaucucuggggcaggggcacgcucauagucguaagcucggccucgaccaagggcccgagcguguucccgcacgaucucagg

SEQ ID NO: 57178 - RNA, 417 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucagacaagcgcccgggcaagggcucgaguggauaggcugggucaaggccguaagcggggcagugaacuauggcucacucgauuucaggcacagggucucgcucacgcgcgaccgcgaucucucgaccgcgcacauggacauacgcgggcucacgcaagaugacacggccacguacuuuugcgcgcgccagaaauuugccaggggcgaucaagggugguuuuucgaucucuggggcaggggcacacucauagucgugagcucggccucgaccaagggcccgagcgugcucccgcccaggagcgcg

SEQ ID NO: 57179 - RNA, 417 nt, Artificial Sequence
  derived and/or modified sequence opt11 from anti-HIV-1_HeavyChain
caggcacaccuagagcaaagcggaucaggcaugaaaaagccaggggcaucaguaaggguaagcugcuggagcucggaagacaucuuugaaaggacagagcuaauacacugggucagacaagcgccagggcaagggcuagaguggauaggauggguaaagacagugacaggggcagugaacuucggcucgagcgacuucaggcaaaggguaucgcuaacgcgcgaccgagaccuauucaccgcgcacauggacauaagagggcuaacgcaaggggacacggcaacguacuucugcgcgcgccagaaauuuuacgcgggagggcaagggugguacuucgaccucuggggaaggggaacgcuaauaguagugagcagcgccagcaccaaaggaccgagcguguucccgcacgaccucagg

SEQ ID NO: 57180 - RNA, 417 nt, Artificial Sequence
  derived and/or modified sequence opt11 from anti-HIV-1_HeavyChain
caggcccaucucgagcaaucgggcucaggcgugaaagagcccgggaccucggucaggguaucgugcuggaccucggaagauaucuuugaaaggaccgagcucauacacugggucaggcaagcgcccgggcaagggcucgaguggauaggcugggucaagaccgugaccggggccgugaacuucggcucgcccaauuucagacacagggucucgcucacacgcgaccgcgaccucuucaccgcgcacauggacauacgcgggcuaacgcaaggggacacggccacguacuuuugcgcgagacagaaauuugaaaggggcgggcaaggguggauauucgaucucuggggcaggggcacgcucauagccgugagcucggccucgaccaagggcccgagcguauucccgcaaacgcucagg

SEQ ID NO: 57181 - RNA, 417 nt, Artificial Sequence
  derived and/or modified sequence opt11 from anti-HIV-1_HeavyChain
caaucccaccucgaacaauccggcuccgccaugaaaaaacccggcgccucaguccgcgucucaugcuggacauccgaagacaucuucgacaccaccgaacucaucuacuggguccgccaagcccccggccaaggccucgaauggaucggcuggguaaaaaucgucuccggcaccgucaacuucgccucccucgacuuccgccaccgagucucccucacccgcgaccgcgaccucucaaccgcccacauggacauccgcggccucacccaagacgacaccgccaccuacuucugcgcccgccaaaaauucgcccgcggcgaccaaggcugguucuucgaccucuggggccgaggcacccuaaucgucgucuccuccgccuccaccaaaggccccuccgucuucccccacgaccuccgc

SEQ ID NO: 57182 - RNA, 417 nt, Artificial Sequence
  derived and/or modified sequence opt11 from anti-HIV-1_HeavyChain
caagcccaccucgaacaauccggcuccggagucaaaaaacccggcgccuccguccgcgucuccugcuggaccuccgaagacaucuucgaaaccaccgaacucauccacuggguccgccaagcccccggccaaggacuagaauggaucggcugggucaaaaccgucuccggcgccgucaacuucggcucccucaacuuccgccaccgcgucucacucacacgcgaccgcgaccucuucaccgcccacauggacauccgcggccucacccaaggcgacaccgccaccuacuucugcgcacgacaaaaauucgcccgcggcgaccaaggcugguucuucgaccucuggggccgcggcacacucaucgucgucuccuccgccuccaccaaaggccccuccgucuucccccacgaccuccgc

SEQ ID NO: 57183 - RNA, 417 nt, Artificial Sequence
  derived and/or modified sequence opt11 from anti-HIV-1_HeavyChain
caagcccaccucgaacaauccggcuccggcgucaaaaaagucggcgccucaguccgcgucuccugcuggaccucagaagacaucuucgaacgcaccgaacucauccacuggguccgccaagcccccggccaaggccucgaauggaucggcugggucaaaaccgucaccggcgccgucaacuucggcucccccaacuuccgccaccgagucucccucacccgcgaccgagaccucuucaccgcccacauggacauccgcggccucacccaaggcgacaccgccaccuacuucugcgcccgccaaaaauucgaacgcggcggacaaggcugguacuucgaccuauggggccgcggcacccucaucgucgucucaucagccuccaccaaaggccccuccgucuucccacacgaccuccga

SEQ ID NO: 57184 - RNA, 417 nt, Artificial Sequence
  derived and/or modified sequence opt11 from anti-HIV-1_HeavyChain
caggcccaccuagagcaaucgggagcgggagugaaaaagcccggggcaucggucaggguaucgugcuggaccucggaagauaucuuugaaaggacagagcuaauacacugggucaggcaagcgcccgggcaagggcuagaguggauaggcuggguaaagacagugagcggggccgugaacuuuggcucacccaauuucaggcacagggucucgcuaacgcgcgaucgcgaucuauuuaccgcgcacauggacauacgggggcuaacgcaaggggacacggcaacguacuuuugcgcgcgacagaaauuugaaaggggagggcaagggugguauuucgaucuauggggcaggggcacgcuaauaguagugagcucggccucaaccaagggcccgagcguguucccgcacgaucuaagg

SEQ ID NO: 57185 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaccgugaccggggccgugaacuauggcucgcucaauuucagaagcaggaucucgcucacgcgcgaucgagaucucuuuaccgcgcacauggacauacgcgggcuaacggaaggggacacggccacguacuuuugcgcgcgccagaaauuuuacgcgggcgggcaagggugguauuucgaucucuggggcaggggcacgcucauagucgugagcucggccucgaccaagggcccgagcguguucccgcacgaucucagg

SEQ ID NO: 57186 - RNA, 417 nt, Artificial Sequence
  derived and/or modified sequence opt11 from anti-HIV-1_HeavyChain
caagcgcaccuggaacagagcgggagcggggucaagaaaccaggcgcgagcgugcgcguaagcugucucgcgagcgaggacauauucgagcgcacggaauugauccauugggugcgccaggccccgggccagggcuuggaauggauagggugggugaaaacggucacgggcgcggucaauuucgggagcccgaacuuucgccaucgcgugagcuugaccagggacagggaccuguucacggcccauauggauaucagaggcuugacccagggcgauacagcgaccuauuucugugccaggcaaaaguucgagcgcgggggccagggcugguacuuugacuugugggggcgcgggacccugaucguggucucgagcgcgagcacgaaagggcccucggucuuuccccaugacuugcgc

SEQ ID NO: 57187 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggagcucggaagauaucuuugaaaggaccgagcucauacacugggucaggcaagcacccgggcaagggcuagaguggauaggcugggucaagaccgugaccggggccgugaacuuuggcucgcucgauuucagacacaggaucucgcucacgcgagaucgcgaucucuuuaccgcgcacauggacauacgagggcucacgcaaggggacacggccacguacuuuugcgcgcgccagaaauuugaaaggggcgggcaaggguggauauucgaucuauggggcaggggcacgcuaauagccgugagcucggccucgaccaagggcccgagcguguucccgcacgaucuaagg

SEQ ID NO: 57188 - RNA, 417 nt, Artificial Sequence
  derived and/or modified sequence opt11 from anti-HIV-1_HeavyChain
caagcgcacuuggaacaaagcgggagcgggguaaagaaaccgggcgcgagcgugcgagugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccagcgcgugagcuugaccagggacagggacuuguucacggcccacauggauaucaggggcuuaacacagggcgauaccgcgaccuauuucugugccaggcaaaaguucgagcgcgggggccagggcugguacuuugacuugugggggcgagggaccuugaucguggucucgagcgcaagcacgaaagggcccucggucuuuccccaugacuugcgc

SEQ ID NO: 57189 - RNA, 417 nt, Artificial Sequence
  derived and/or modified sequence opt11 from anti-HIV-1_HeavyChain
caaguacaccuagaacagagcggaagcggagucaaaaaaccaggcgcgagcguacgcgugagcugcuggacaagcgaagacauauucgaacgcacagaacuaauccacuggguacgccaggccccaggccaaggccuagaauggaucggauggguaaaaacagucacaggcgcagucaacuucggaagcccaaacuuccgccaccgcguaagccuaaccagagacagggaccuauucacagcccacauggacaucagaggccuaacccaaggcgacaccgcaacauacuucugcgccagacaaaaauucgaacgcggaggccagggcugguacuucgaccuguggggacgcggaacccuaaucguagucucaagcgcaagcacaaaaggacccucagucuucccccacgaccuacgc

SEQ ID NO: 57190 - RNA, 417 nt, Artificial Sequence
  derived and/or modified sequence opt11 from anti-HIV-1_HeavyChain
caagcgcaccuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucucaggcgcggucaauuucgggagcccgaacuuucgccagcgcgugagcuugaccagggacagggacuuguucacggcacauauggauaucaggggcuugacccagggcgauaccgcgaccuaucucugugccaggcaaaaguucgagcgcgggggccagggcuggaucuuugacuugugggggcgcgggaccuugaucgcggucucaagcgcgagcacgaaagggcccucgguauuuccccaugacuugcgc

SEQ ID NO: 57191 - RNA, 417 nt, Artificial Sequence
  derived and/or modified sequence opt11 from anti-HIV-1_HeavyChain
cagagccaccucgagcaaucgggcucggccaugaaaaagcccggggccucggucagggucucgugcuggacaucggaagauaucuuugaaaggaccgagcucauauacugggucagacaagcgcccgggcgcgggcucgaguggauaggcuggguaaagaccgugagcgggaccgugaacuuuggcucgagcgauuucaggcacagggucucgcuaacgcgcgaucgcgaucucuuuaccgcgcacauggacauacgcggacucacgcaaggggacacggccacguacuuuugcgcgcgacagaaauuuuacaagggcgggcaagggugguauuucgaucucuggggcaggggcacgcuaauagucgugagcucggccucgaccaagggcccgagcguguucccgcacgaucucagg

SEQ ID NO: 57192 - RNA, 417 nt, Artificial Sequence
  derived and/or modified sequence opt11 from anti-HIV-1_HeavyChain
caggcccaucucgagcaaucgggcucgggagugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcccgaucgcgaucucuuuaccgcgcacauggacauacgagggcucacgcaaggggacacggccacguacuuuugcgcgcgccagaaauucuacgcgggcgggcaagggugguauuucgaucuauggggcaggggcacgcucauaguagugagcucggccucgaccaagggcucgagcguguucccgcacgaucucagg

SEQ ID NO: 57193 - RNA, 417 nt, Artificial Sequence
  derived and/or modified sequence opt11 from anti-HIV-1_HeavyChain
caggcccaucucgagcaaucgggcucgggcgugaaaaagcccggggcaucggucagagucucgugcuggaccucggaagauaucuuugaaaagagcgagcucauacacugggucaggcaagcgcccgggcaaggacucgaguggauaggcugggucaagacagugaccggggccgugaacuuuggcucgagcgauuucaggcaaagagucucgcucacgcccgaucgagaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucggccucaaccaagggcccgagcguguucccgcacgaucucagg

SEQ ID NO: 57194 - RNA, 417 nt, Artificial Sequence
  derived and/or modified sequence opt11 from anti-HIV-1_HeavyChain
caggcgcaccuagagcaaagcggaagcggagugaaaaagcuaggggcaagcguaaggguaagcugcuggacaagcgaagacauauucgaaaggacagagcuaauacacuggguaagacaagcgccagggcaagggcuagaguggauaggauggguaaaggcagugagcggggcagugaacuacgggagccuagacuucaggcacagaguaagccuaacgagggacagagaccuaagcacagcgcacauggacauaagaggacuaacgcaagacgacacggcaacguacuucugcgcgagacagaaauucgcaaggggagaccaagggugguucuucgaccuauggggaaggggaacgcuaauaguagugagcagcgcaagcacaaagggaccgagcguguucccgcacgaccugagg

SEQ ID NO: 57195 - RNA, 417 nt, Artificial Sequence
  derived and/or modified sequence opt11 from anti-HIV-1_HeavyChain
caaguacaccucgaacaaagcggcagcggagucaaaaaacuaggcgcauccguacgcgucagcugcuggacaagcgaagacauauucgaacgcacagaacuaauccacuggguccgccaagccccaggccaaggccuagaauggaucggcuggguaaaagcagucucaggcgcagucaacuacggcagccucgacuuccgccaccgcgucagccuaaccagagacagagaccucuucacagcccacauggacauccgcggccugacccaagacgacaccgcaaccuacuucugcgccagacaaaaauucgcccgcggagaccaaggcugguucuucgaccuauggggacgcggaacccuaaucguaguaucaagcgccagcacaaaaggacccucagucuucccccaccgcucaacc

SEQ ID NO: 57196 - RNA, 420 nt, Artificial Sequence
  derived and/or modified sequence opt11 from anti-HIV-1_HeavyChain
cagguguauauggagcaggcgggggcgggggugaaaaagccgggggcgucggugacgcugaguugcaagacggcggacgaggacguguucgaugcggcguacaugcacuggguaagacaggcgccggggcagacguucgagugguugggauggaugaagccggugacaggggcagugagcuaugcgaggaaauuucaggggagggugagcuuuuacaugacaagggaguuggggauggcauauauggaucugaggaaccugagauuugacgauacggcgguauauuucugugcaaggaagacggcgggggacgugagcggggacaauagaggguacuuuuucgaucuaugggggaggggaaguagagugauagugagcagugcgaguacgaaggggccgagcguauucacgauauaugua

SEQ ID NO: 57197 - RNA, 417 nt, Artificial Sequence
  derived and/or modified sequence opt11 from anti-HIV-1_HeavyChain
caggcacaucucgagcaaucgggcucaggcgugaaaaagcucggggccucgguaagggucucaugcuggaccucggaagauaucuuugaaagaaccgagcucauacacugggucaggcaagcgcccgggcaagggcucgaguggauaggcugggucaaggccgugagcggggccgugaacuacggcucgcucgauuucaggcacagggucucgcucacgcgcgaucgcgaucucuuuaccgcgcacauggacauacgcgggcuaacgcaagaugacacggccacguacuuuugcgcgcgccagaaauuugccaggggcgaucaagggugguuuuucgaucucuggggcaggggcacgcucauagucgugagcucggccucgacaaagggcccgagcguguucccgcacgaucccgcg

SEQ ID NO: 57198 - RNA, 417 nt, Artificial Sequence
  derived and/or modified sequence opt11 from anti-HIV-1_HeavyChain
caagcacacuuggaacagagcggaagcggggucaagaaauugggcgcgagcgugcgcgugagcuguuggacgagcgaggacauauucgagcgcacggaauugauccauugggugcgccaggccccgggccagggcuuggaauggaucgggugggugaaagcggucucgggcgcggucaauuacgggagcuuggacuuucgccaucgcgugagcuugaccagggacagggacuugagcacggcccauauggauaucagaggcuugacccaggacgauaccgcgaccuauuucugugccaggcaaaaguucgcgcgcggggaccagggcugguucuuugacuugugggggcgcgggaccuugaucguggucucgagcgcgagcacgaaagggcccucggucuugcccccgcgcucgacc

SEQ ID NO: 57199 - RNA, 417 nt, Artificial Sequence
  derived and/or modified sequence opt11 from anti-HIV-1_HeavyChain
caagcgcaccuggaacagagcgggagcggggucaagaaaccgggcgcgagcgugcgcgugagcuguuggucgagcgaggacauauucgagcgcacagaauugauccauugggugcgacaggccccgggccagggcuuggaauggaucgggugggugaaagcggucucgggagcggucaauuacgggagcuuggacuuucgccaccgcgugagcuugaccagggacagggacuuguucacggcccauauggauaucaggggccugacccaggacgauaccgcgaccuauuucugugccagacaaaaguucgcgcgcggggaccagggcugguucuuugacuugugggggcgcggaaccuugaucguggucucgagcgcgagcacgaaagggcccucggucuuuccccaugaccuacga

SEQ ID NO: 57200 - RNA, 417 nt, Artificial Sequence
  derived and/or modified sequence opt11 from anti-HIV-1_HeavyChain
caagcgcacuuggaacagagcgggagcgaguggaagaaauugggcgcgagcgugcgcgugagcugcuggacgagcgaggacauauucgagcgcacggaauugauccauugggugcgccaggccccgggccagggccuggaauggaucgggugggugaaagcggucucgggcgcggucaauuacgggagcuuggacuuucgccaucgcgugagcuugaccagggacagggaccugagcacggcccauauggauaucaggggccugacccaggacgauaccgcgaccuauuucugugccaggcaaaaguucgcgcgcggggaccagggcugguucuuugacuuauggggacgcgggacccugaucguggucucgagugcgagcacgaaagggcccucggucuuuccacaugacuugcgc

SEQ ID NO: 57201 - RNA, 417 nt, Artificial Sequence
  derived and/or modified sequence opt11 from anti-HIV-1_HeavyChain
caggcccaucucgagcaaucgggcucggaagugaaaaagcccggggccucggucagggucucgugcuggaccucggaagauaucuuugaaaagagcgagcucauacacugggucaggcaagcgcccgggcaagggcuagaguggauaggcugggucaagaccgugaccggggccgugaacuuuggcucgagcgauuucaggcaaagggucucgcucacgcgagaucgcgaucucuuuaccgcgcacauggacauacgcgggcucacgcaaggggacacggcaacguacuuuugcgcgcgccagaaauuuuacgcgggcgggcaagggugguauuucgaucucuggggcagaggcacgcucauagucgugagcucggccucgacaaagggaccgagcguguucccgcacgaucucagg

SEQ ID NO: 57202 - RNA, 417 nt, Artificial Sequence
  derived and/or modified sequence opt11 from anti-HIV-1_HeavyChain
caggcccaucuagagcaaucaggcucgggcgugaaaaagcucggggccucggucagggucucgugcuggaccucggaagauaucuuugaaaggaccgagcucauacacugggucaggcaagcgcccgggcaagggcuagaguggauaggcugggucaagaccgugaccggggccgugaacuucggcucgcccaauuucagacacagggucucgcucacgcgcgaucgcgaucuauuuaccgcgcacauggacauacgagggcucacgcaaggggacacggccacguacuuuugcgcgcgccagaaauuugaaaggggcgggcaaggaugguauuucgaccucuggggcaggggcacgcucauagucgugagcucggccucgaccaagggcccgagcguguucccgcacgaucucagg

SEQ ID NO: 57203 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuugcgcaagagcgagcucauacacugggucaggcaagcgcccgggcaaggacucgaguggauaggcugggucaagaccgugaccggggccgugaacuuuggcucgagcgauuucaggcaaagagucucgcucacgcgcgaucgcgaucucuuuacagcgcacauggacauacgcgggcucacgcaaggggacacggccacguacuuuugcgcgcgccagaaauucuacgcgggcgggcaagggugguauuucgaucucuggggcaggggcacgcucauagucgugagcucggccucgaccaagggcccgagcguguucccgcacgaucucagg

SEQ ID NO: 57204 - RNA, 417 nt, Artificial Sequence
  derived and/or modified sequence opt11 from anti-HIV-1_HeavyChain
caagcgcaccuggaacagagcgcgagcggggucaagcgcccgggcgcgagcgugcgcgugagcugucucgcgagcgaggacauauucgagcgaucggaauugaucuauuggguacgccaggccccgggccagggcuuggaauggaucgggugggugaaaauagucucaggcgcggucaauuucgggagcccgaacuuucgccagcgcgugagcuugaccagggacagggacuuguucacggcccauauggauaucaggggcuugacccagggcgauaccgcgaccuauuucugugccaggcaaaaguucgagcgcgggggccagggcuggaucuuugacuugugggggcgcgggaccuugaucgcggucucgagcgcgagcacgaaagggcccucggucuuuccccaugacuugcgc

SEQ ID NO: 57205 - RNA, 417 nt, Artificial Sequence
  derived and/or modified sequence opt11 from anti-HIV-1_HeavyChain
caagcccaccucgaacaauccggcuccggcgucaaaagacccggcgccuccguccgcgucucaugcuggaccuccgaagacaucuucgaaaccaccgaacucauccacuggguccgccaagcccccggccaaggccucgaauggaucggcugggucaaaaccgucaccggcgccguaaacuucggcuccgccuacuuccgccaccgagucucccucacccgcgaccgcgaccuauucaccgcccacauggacauccgcggccucacccaaggcgacacagccaccuacuucugcgcccgccaaaaauucuacaaaggcggccaaggcugguacuucgaccucuggggccgcggcacacucaucgucgucucauccgccuccaccaaaggccccucagucuucccccacgaccuccgc

SEQ ID NO: 57206 - RNA, 417 nt, Artificial Sequence
  derived and/or modified sequence opt11 from anti-HIV-1_HeavyChain
caagcgcacuuggaacagagcgcgagcggggucaagcgcccgggcgcgagcguacgcgugagcuguuggacgagcgaggacauauucgagcgcucggaauugaucuauugggugcgccaggccccgggacagggcuuggaauggaucgggugggugaaaacggucucgggagcggucaauuucgggagcacggacuuucgccaucgcgugagcuugaccagggacagggacuuguucacggcacauauggauaucaggggcuugacccagggcgauaccgcgaccuauuucugugccaggcaaaaguucgagcgcgggggccagggcugguacuuugacuugugggggcgcgggaccuugaucguggucucgagcgcgagcacgaaagggcccucggucuuuccccaugacuugcga

SEQ ID NO: 57207 - RNA, 417 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaacugauccauugggugcgccaggccccgggccagggcuuggaauggaucgggugggugaaagcggucucgggcgcggucaauuacgggagcuuggacuuucgccaucgcgugagcuugaccagggacagagacuugagcacggcccauauggauaucagaggcuugacacaggacgauaccgcgaccuauuucugugccaggcaaaaguucgcgcgcggggaccagggcugguucuuugacuugugggggcgcgggaccuugaucguggucucgagcgcgagcacgaaagggcccucgggcuugcccccgcgcucggcc

SEQ ID NO: 57208 - RNA, 417 nt, Artificial Sequence
  derived and/or modified sequence opt11 from anti-HIV-1_HeavyChain
cagagccaucucgagcaaucgggcucggccaugaaaaagcccggggcaucggucagggucucgugcuggaccucggaagauaucuuugacacgaccgagcucauauacugggucaggcaagcgcccgggcaagggcucgaguggauaggcugggucaagaucgugagcgggaccgugaacuuugccucgcucgauuucaggaacaggauaucgcuuucgcgcgaucgcgaucucucgaccgcgcacauggacauacgagggcucacgcaaggggacacggccacguacuuuugcgcgcgccagaaauuugaaaggggcgggcaaggguggauauucgaucucuggggcaggggcacgcucauagccgugagcucggccucgaccaagggcccgagcguguucccgcucaggagcgcg

SEQ ID NO: 57209 - RNA, 423 nt, Artificial Sequence
  derived and/or modified sequence opt11 from anti-HIV-1_HeavyChain
cagguacagauggagcaagcgggcgcgggaaugaaaaagcccggggccucgaugacggucucgugcaagacagcggacgaggacauauucgaugccgcguacaugcacugggucaggcaagcgcccgggcaaacguucgaguggcugggcuggaugaagcccgugaccggggccgugaacuaugcaaggcaauuucaagggcgcgcgagcuuuuacaggacaagagaauugggcauagcauauauggaucucagagacuugaaauuugacgauacagcgguauauuucugugccaggaaaacgaaaggggacgugagcggggacgauagaggguucuuuuucgaucuauggggaaggggaacgcgcgugaucgugagcucggcaucaaccaagggaccgagcguguucccgcacgaucuaaga

SEQ ID NO: 57210 - RNA, 417 nt, Artificial Sequence
  derived and/or modified sequence opt11 from anti-HIV-1_HeavyChain
caggcccaucucgagcaaucgggcucgggcgugaaaaagccaggggccucagucagggucucgugcuggagcucggaagauaucuuugaaaggaccgagcucauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauacgagggcucacgcaaggggacacggccacguacuuuugcgcgcgccagaaauuuuacaagggcgggcaaggaugguauuucgaucucuggggcaggggcacgcucauagucgugagcucggccucaaccaagggcccgagcguguucccgcaaauaugcagg

SEQ ID NO: 57211 - RNA, 414 nt, Artificial Sequence
  derived and/or modified sequence opt11 from anti-HIV-1_HeavyChain
caagcgcacuuggaacagagcggggccggggucaagaaaccgggcgcgagcgugcgcgugagcuguuggacgagcgaggacauauucgagaaaucggaauugauccauugggugcgccaggccccgggccagggccuggaauggaucgggugggugaaaacggucacgggcgcggucaaucucgugcaccagaucucggacagggucucgcucacgcgcgaucgcgaucucucaaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucggccucgaccaagggcccgagcguguucccgcacgaucucagg

SEQ ID NO: 57212 - RNA, 420 nt, Artificial Sequence
  derived and/or modified sequence opt11 from anti-HIV-1_HeavyChain
caagcgcacuuggaacagagcggaagcggggucaagaaauugggcgcgagcgugcgcgugagcuguuggacgagcgaggacauauucgagcgcacggaauugauccauugggugcgacaggccccgggccagggcuuggaauggaucgggugggugaaagcggucucgggcgcggucaauuacgggagccuggacuuucgccaucgcgugagcuugaccagggacagggacuugagcacggcccauauggauaucaggggcuugacccaggacgauaccgcgaccuauuucugugccagacaaaaguucgcgagaggggaccagggcugguucuuugacuugugggggcgagggaccuugauaguggucucgagcgcgagcacgaaagggcccucgggcuugccaccgcgcuugugcgua

SEQ ID NO: 57213 - RNA, 417 nt, Artificial Sequence
  derived and/or modified sequence opt11 from anti-HIV-1_HeavyChain
caggccaggcucgagcaaucgggcucgggcgugaaaaagcccggggccucggucagggucucgugcuggaccucggaagauaucuuugaagggagcgagcucauacacugggucaggcaagcgcccgggcaagggcucgaguggauaggcugggucaagaccgugaccggggccgugaacuucggcucggccuauuucaggcacagggucucgcuaacgcgcgaucgcgaucucuuuaccgcgcacauggacauacgcgggcucacgcaaggggacacggccacguacuuuugcgcgcgccagaaauuugccaggggcgaucaagggugguuuuucgaucucuggggcaggggcacgcucauagucgugagcucggccucgaccaagggcccgagcguguucccgcacgauagcgca

SEQ ID NO: 57214 - RNA, 414 nt, Artificial Sequence
  derived and/or modified sequence opt11 from anti-HIV-1_HeavyChain
caagugcaauugguccagagcggggccgaggucaagaaaccgggcucgagcgugaaagugagcuguaaagugagcgggggcguguucacgagcuaugccgugaccugggucagacaagcgcccgggcaagggcucgaguggauaggcugggucaaggccgugagcggggccgugaacuauggcucgcucgauuucaggcacagggucucgcucacgcgcgaucgcgaucucuuuaccgcgcacauggacauacgcgggcucacgcaagaugacacggccauauacuuuugcgcgcgacagaaauuugccaggggagaucaagggugguuuuucgaucucuggggcaggggcacgcucauagucgugagcucggccucgaccaagggcccgagcguguucccgcacgaucucagg

SEQ ID NO: 57215 - RNA, 417 nt, Artificial Sequence
  derived and/or modified sequence opt11 from anti-HIV-1_HeavyChain
caggcccaucucgagcaaucgggcucgggagugaaaaagcccggggccucggucagggucucgugcuggaccucggaagauaucuuugaaaggaccgagcucauacacugggucaggcaagcgcccgggcaaggacucgaguggauaggcuggguaaagaccgugagcggggccgugaacuuuggcucgcccaauuucaggcaaagggucucgcucacgcgcgaucgcgaucucuuuaccgcgcacauggacauacgcgggcuaacgcaaggggacacggccacguacuuuugcgcgcgccagaaauuugaaaggggcgggcaaggguggauauucgaucuauggggcaggggcacgcuaauagccgugagcucggccucgaccaagggcccgagcguguucccgcacgaucucagg

SEQ ID NO: 57216 - RNA, 417 nt, Artificial Sequence
  derived and/or modified sequence opt11 from anti-HIV-1_HeavyChain
caaucccaccucgaacaauccggcuccgccaugaaaaaacccggcgccuccgucaccgucuccugcuggaccucagaagacaucuucgacacaaccgaacucaucuacuggguccgccaagcccccggccaaggccuagaauggaucggcugggucaaaaucgucuccggcaccgucaacuucgccucccucgacuuccgcaaccgcaucucccucucccgcgaccgcgaccucuccaccgcccacauggacauccgcggccucacacaagacgacaccgccaccuacuucugcgcccgacaaaaauucgccucccgcuacuccggcgaccaaggauccuacuucgaccucuggggccgcggcacccucaucaucgucucauccgccucaaccaaaggccccuccgacgaccuccgc

SEQ ID NO: 57217 - RNA, 414 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaaucgagcggguacucguucacgcgcuuugacauaaccugggucaggcaagcgcccgggcaagggcucgaguggauaggcugggucaagaccgugagcggggccgugaacuuuggcucgcucaauuucaggcacagggucucgcucacgcgcgaucgcgaucucuuuaccgcgcacauggacauacgcgggcucacgcaaggggacacggccacguacuuuugcgcgcgacagaaauuugccaggggcgaucaagggugguuuuucgaucucuggggcaggggaacgcucauagucgugagcucggccucgaccaagggcccgaguguguucccgcacgaucucagg

SEQ ID NO: 57218 - RNA, 420 nt, Artificial Sequence
  derived and/or modified sequence opt11 from anti-HIV-1_HeavyChain
caggcacaccuagagcaaagcggaagcggagugaaaaagccaggggcaagcguaaggguaagcugcuggacaagcgaagacauauucgaaaagagcgagcuaauacacuggguaaggcaagcgccagggcaagggcuagaguggauaggauggguaaagacagugacaggggcagugaacuucggaagcagcgacuucaggcaaaggguaagccuaacgagagacagagaccuauucacagcgcacauggacauaagagggcuaacacaaggggacacggcaacguacuucugcgcgagacagaaauucuacgcaggagggcaagggugguacuucgaccuauggggaaggggaacgcuaauaguagugagcagcgcaagcacaaagggaccgauagggcugccaccaaggcuaugcgua

SEQ ID NO: 57219 - RNA, 417 nt, Artificial Sequence
  derived and/or modified sequence opt11 from anti-HIV-1_HeavyChain
caagcacaccuagaacaaagcggagccggagucaaaaaaccaggcgcaagcguacgcguaagcugcuggacaagcgaagacauauucgaacgcacagaacuaauccacuggguacgccaggccccaggccagggccuagaauggaucggauggguaaaaacagucacgggcgcggucaacuucgggagcccaaacuuccgccaccgcguaagccuaaccagagacagagaccuguucacagcccacauggacaucaggggccugacccaaggcgacaccgcaaccuacuucugcgccagacaaaaauucgaacgcggaggccaaggcugguacuucgaccugugggggcgcgggacccuaaucguggucucaagcgcaagcacaaaaggacccucagucuucccccacgaccuacgc

SEQ ID NO: 57220 - RNA, 420 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaauugauacauugggugcgccaggccccgggccagggcuuggaauggaucgggugggugaaagcagucucgggcgcggucaauuacgggagcuuggacuuucgccaucgagugagcuugaccagggacagggacuuguucacggcccauauggauaucaggggcuugacccaggacgauaccgcgaccuauuucugugccaggcaaaaguucgcgcgcggagaccagggcugguucuuugacuugugggggcgcgggaccuugaucguggucucgagcgcaagcacgaaagggcccucgggcccgagcccggaaauaugcgug

SEQ ID NO: 57221 - RNA, 417 nt, Artificial Sequence
  derived and/or modified sequence opt11 from anti-HIV-1_HeavyChain
caggcccaucucgagcaaucgggcgcgggcgugaaaaggcccggggccucggucagggucucgugcuggaccucggaagauaucuuugaaacgaccgagcucauacacugggucaggcaagcgcccgggcaagggcuagaguggauaggcugggucaagaccgugagcggggccgugaacuuuggcucgcucaauuucagacacagggucucgcucacgcgagaucgcgaucucuuuaccgcgcacauggacauacgcggacucacgcaaggggacacggccacguacuuuugcgcgcgccagaaauuugccaggggcgaucaagggugguuuuucgaucucuggggcaggggcacgcucauagucgugagcucggccucgaccaagggcccgagcguguucccgcacgaucucaga

SEQ ID NO: 57222 - RNA, 417 nt, Artificial Sequence
  derived and/or modified sequence opt11 from anti-HIV-1_HeavyChain
agggcccaccucgagcaaucgggcucgggcgucaaaaagcucggggccucaguaagaguaucgugcuggaccucggaagauaucuuugaaaggaccgagcucauacacuggguaaggcaagcgcccgggcaagggcucgaguggauaggcugggucaaggccgugagcggggccgcgaacuauggcucgcccaauuucaggcaaagggucucgcucacgcgcgaucgcgaucucuuuaccgcgcacauggacauacgcgggcucacgcaaggagacacggccacguacuucugcgcgcgccagaaauuugaaaggggcgggcaaggguggauauucgaucucuggggcaggggcacgcucauagccgugagcucggccucgaccaagggcccgagcguguucccgcacgaucucagg

SEQ ID NO: 57223 - RNA, 417 nt, Artificial Sequence
  derived and/or modified sequence opt11 from anti-HIV-1_HeavyChain
caagugcaccuggaacagagcggaagcggaguaaaaaaacuaggcgcaagcguacgcguaagcugcuggacaagcgaagacauauucgaacgcacagaacugauccacuggguaagacaggccccgggccagggccuggaauggaucggauggguaaaagcagucucgggcgcagucaacuacgggagccuagacuuccgacaccgaguaagccugacaagagacagagaccuauucacggcccacauggacaucagaggccugacccaggacgacaccgcaaccuacuucugcgccagacaaaaauucgcacgcggagaccagggcugguucuucgaccuguggggacgagggacccugaucguagucucaagcgcaagcacgaaagggcccucggucuucccccacgaccugcgc

SEQ ID NO: 57224 - RNA, 417 nt, Artificial Sequence
  derived and/or modified sequence opt11 from anti-HIV-1_HeavyChain
cgcgcgcacuuggaacagagcgggagcggggucaagaaaccgggcgcgagcgugcgcgugagcuguuggacgagcgaggacauauucgagcgaacggaauugauccauugggugcgacaggccccgggccagggcuuggaauggaucgggugggugaaaauagucucgggcgcggucaauuucgggagcccgaacuuucgccagcgcgcgagccugaccagggacagggacuuguucacggcccauauggauaucaggggcuugacccagggcgauacagcgaccuauuucugugccaggcaaaaguucgagcgcgggggccagggcuggaucuuugacuugugggggcgcgggaccuugaucgcggucucgagcgcgagcacgaaagggccaucggucuuucccacgaucuauguc

SEQ ID NO: 57225 - RNA, 414 nt, Artificial Sequence
  derived and/or modified sequence opt11 from anti-HIV-1_HeavyChain
caagugcaacugguccagagcgaggccgaggucaagaaaccaggcgcgagcgugaaaauaagcugcgccacaagcggguacgcguucacgcucuacuacuugcacugggucaggcaagcgcccggccaaggacucgaguggauaggcuggguaaaaaccgugaccggggccgugaacuucggcucggccuacuucaggcacagggucucacucacgcgcgaccgcgaccucuucaccgcgcacauggacauacgcgggcucacgcaaggagacacagccacguacuucugcgcacgccagaaauucuacaagggcgggcaagggugguacuucgaccucuggggcagaggcacgcucauagucgugagcucggccucgaccaagggcccgagcguguucccacacgaccucaga

SEQ ID NO: 57226 - RNA, 420 nt, Artificial Sequence
  derived and/or modified sequence opt11 from anti-HIV-1_HeavyChain
caggcacacccggagcaaagcggaagcggagugaaaaagccgggggcaagcguaaggguaagcugcuggacaagcgaagacauauucgaaaggacggagcugauacacuggguaaggcaggcgccggggcaggggcuggaguggauaggauggguaaagauagugagcggggcagugaacuucggaagcccgaacuucaggcagaggguaagccugacgagagacagagaccuguucacggcgcacauggacauaagagggcugacgcagggggacacggcgacguacuucugcgcgagacagaaauucgaaaggggagggcagggguggauauucgaccuguggggaagggggacgcugauagcagugagcagcgcaagcacaaaggggccgagcgggcugccgccgaggcuaugcgug

SEQ ID NO: 57227 - RNA, 417 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaccgugagcggggccguaaacuuuggcucgcccaauuucaggcacagggucucgcucacgcgcgaucgcgaucucuuuaccgcgcacauggacauacgcgggcucacgcaaggggacacggccacauacuucugcgcgcgccagaaauuugaaaggggcgggcaagggugguauuucgaucucuggggcaggggcacgcucauagucgugagcucggccucgaccaagggcccgagcguguucccgcccaggagcacg

SEQ ID NO: 57228 - RNA, 417 nt, Artificial Sequence
  derived and/or modified sequence opt11 from anti-HIV-1_HeavyChain
caagcgcacuuggaacagagcggaagcggggucaagcgcccgggcgcgagcgugcgagugagcuguuggacgagcgaggacauauucgagaaaucagaauugauccauugggugcgccaggccccgggccagggcuuggaauggaucgggugggugaaaacggucacaggcgcggucaauuucgggagcccgaacuuucgccaucgcgugagcuugaccagagacagggaccuguucacggcccauauggauaucaggggcuugacccagggcgauaccgcgaccuauuucugugccaggcaaaaguucgagcgcgggggccagggcugguacuuugacuugugggggcgaggaaccuugaucguggucucgagcgcgagcacgaaagggcccucggucuuuccccaugaccugcgc

SEQ ID NO: 57229 - RNA, 417 nt, Artificial Sequence
  derived and/or modified sequence opt11 from anti-HIV-1_HeavyChain
ggggcccaucucgagcaaucgggcucgggcgugaaaaagcccggggccucagucagggucucgugcuggaccucagaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgagggcucacgcaaggggacacggccacguacuuuugcgcgcgccagaaauuuuacgcgggcgggcaagggugguauuucgaucucuggggcaggggcacgcucauagucgugagcucggccucgaccaagggcccgagcguguucccgcacgaucucagg

SEQ ID NO: 57230 - RNA, 417 nt, Artificial Sequence
  derived and/or modified sequence opt11 from anti-HIV-1_HeavyChain
aggcacgaucucgagcaaucgggcucgggcgugaaaaagcccggggccucggucagggucucgugcuggaccucggaagacaucuuugaaaggaccgagcucauacacugggucaggcaagcgcccgggcaagggcucgaguggauaggcugggucaagaucgugagcggggccgugaacuucggcucgcccaauuucaggcaaagggucucgcucacgcgcgaccgcgaucucuucaccgcgcacauggacauacgcgggcucacgcaaggggacacggccacguacuucugcgcgcgccagaaauuugaaaggggcgggcaaggguggauauucgaucucuggggcaggggcacgcuaauagccgugagcucggccucgacaaagggcccgagcguguucccgcacgaccucagg

SEQ ID NO: 57231 - RNA, 420 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggucgagcgaggacauauucgagcgcacggaauugauccauugggugcgccaggccccgggccagggcuuggaauggauagggugggugaaaacggucacgggcgcggucaauuucgggagcuuggacuuucgccaucgcaucagcuugaccagggacagggacuuguucacggcccauauggauauaaggggacugacccagggcgauaccgcgaccuauuucugcgccaggcaaaaguucgagagcagguacacgggcgggcaagggugguauuucgaucucuggggcaggggcacgcacauagucgugagcucggccucgaccaagggcccgagcgugaccauauacgug

SEQ ID NO: 57232 - RNA, 414 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauagucgugagcucggccucgcccgggcccauaggcccgagcccgcgcucggcc

SEQ ID NO: 57233 - RNA, 417 nt, Artificial Sequence
  derived and/or modified sequence opt11 from anti-HIV-1_HeavyChain
caggcccaucucgagcaaucggccucgggagugaaaaggcccggggccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucgagcgauuucaggcaaagggucucgcucacacgagaucgcgaucucuuuaccgcgcacauggacauacgcgggcucacgcaaggggacacggccacguacuuuugcgcgcgccagaaauuuuacgcgggcgggcaaggaugguauuucgaucuauggggcaggggcacgcucauagucgugagcucggccucgaccaagggcccgagcguguucccgcacgaucucagg

SEQ ID NO: 57234 - RNA, 417 nt, Artificial Sequence
  derived and/or modified sequence opt11 from anti-HIV-1_HeavyChain
cagguccagcucgugcaaucgggcgcggaagugaaaaagcccggggccucggucagggucucgugcuggaccucggaagauaucuuugaaaagagcgagcucauacacugggucagacaagcgcccgggcaagggcucgaguggauaggcugggucaagaccgugaccggggccgugaacuuuggcucgagcgauuucaggcaaaggguaucgcucacgcgcgaucgagaucucuuuaccgcgcacauggacauacgcgggcucacgcaaggggacacggccacguacuuuugcgcgcgacagaaauuuuacgcgggcgggcaagggugguauuucgaucucuggggcaggggcacgcucauagucgugagcucggccucgaccaagggcccgagcguguucccgaccauauacgug

SEQ ID NO: 57235 - RNA, 417 nt, Artificial Sequence
  derived and/or modified sequence opt11 from anti-HIV-1_HeavyChain
caagcccaccucgaacaauccggcucaggcgucaaaaaacccggcgcauccguccgcgucuccugcuggaccucagaagacaucuucgaacgcaccgaacucauacacuggguccgccaagcccccggccaaggccucgaacgaaucggcugggucaaaaccgucaccggcgccgucaacuucggcucccccaacuuccgccaccgcgucucccucacccgcgaccgcgaccucuucaccgcccacauggacauccgcggccuaacccaaggcgacaccgccaccuacuucugcgcccgacaaaaauucgaacgcggcggccaaggcugguacuucgaccuauggggccgcggcacccucaucgucgucuccuccgccuccaccaaaggccccuccgucuuccccaccaucugcguc

SEQ ID NO: 57236 - RNA, 420 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucauccacuggguccgccaagcccccggccaaggccucgaauggaucggcugggucaaaaccgucuccggcgccgucaacuucggcucccuaaacuuccgccaccgcgucucccucacccgcgaccgcgaccuauucaccgcccacauggacauccgaggccucacccaaggcgacaccgccaccuacuucugcgcccgccaaaaauucgcccgcggcgaccaaggcugguucuucgaccucuggggccgcggcacccuaaucgucgucuccuccgcauccaccaacggccccaucggccccucccccaccgaccuccgc

SEQ ID NO: 57237 - RNA, 417 nt, Artificial Sequence
  derived and/or modified sequence opt11 from anti-HIV-1_HeavyChain
caggcacaccuagagcaaagcggaagcggagugaaaaagcuaggggcaagcguaaggguaagcugcuggacaagcgaagacauauucgaaaggacagagcuaauacaauggguaagacaagcgccgggacaaggacuagaguggaugggauggguaaaggcggugagcggggcagugaacuacggaagccuagacuucaggcacaggguaagccuaacgagagacagagaccuauucacagcgcacauggacauaagagggcuaacacaagacgacacggcgacguacuucugcgcgagacagaaauucgcaaggggagaccaagggugguucuucgaccuauggggaagaggaacgcuaauaguagugagcagcgcaagcacaaagggaccgagcguguucccacacgaccuaagg

SEQ ID NO: 57238 - RNA, 417 nt, Artificial Sequence
  derived and/or modified sequence opt11 from anti-HIV-1_HeavyChain
caaucccaccucgaacaauccggcuccgccaugaaaaaacccggcgccucaguccgcgucuccugcuggaccuccgaagacaucuucgacaccaccgaacucaucuacuggguccgccaagcccccggccaaggacuagaauggaucggcugggucaaagccgucuccggcgccgucaacuacggcucccucgacuuccgccaccgagucucccucacccgcgaccgcgaccuauccacagcccacauggacauccgcggccucacccaagacgacacagccaccuacuucugcgcccgccaaaaauucgcacgcggcgaccaaggcugguucuucgaccucuggggccgcggcacccucaucgucgucuccuccgccuccaccaaaggccccuccgucuucccccacgaccuccgc

SEQ ID NO: 57239 - RNA, 417 nt, Artificial Sequence
  derived and/or modified sequence opt11 from anti-HIV-1_HeavyChain
caagcccaccucgaacaauccggcuccggcgucaaaaaacucggcgccuccguccgcgucuccugcuggaccucagaagacaucuucgaacgcaccgaacucauccacuggguacgccaagcccccggccaaggacucgaauggaucggcugggucaaagccgucuccggcgccgucaacuacggcucccucgacuuccgccaccgcgucucccucacccgcgaccgcgaccuauccaccgcccacauggacauccgcggccuaacccaagacgacaccgccaccuacuucugcgcccgccaaaaauucgcccgcggcgaccaaggcugguucuucgaccucuggggccgcggcacccucaucgucgucuccuccgccuccacaaaaggacccuccgucuuccccaccaucuacguc

SEQ ID NO: 57240 - RNA, 417 nt, Artificial Sequence
  derived and/or modified sequence opt11 from anti-HIV-1_HeavyChain
caagcgcaccuggaacaaagcggaagcggagucaaaaaaccaggcgcaagcguacgcguauccugcuggacaagcgaagacauauucgaacgcacagaacuaauccacuggguacgccaggccccaggccaaggccuagaauggaucggauggguaaaaacagucacaggcgcagucaacuucggaagcccaaacuuccgccaccgcguaagccuaaccagagacagagaccuauucacagcccacauggacaucagaggccugacccaaggcgacaccgcaaccuacuucugcgccagacaaaaauucgaacgcggaggccaaggcugguacuucgaccuauggggacgcggaacccuaaucguagucucaagcgcaagcacaaaaggacccucagucuucccccacgacccacgc

SEQ ID NO: 57241 - RNA, 423 nt, Artificial Sequence
  derived and/or modified sequence opt11 from anti-HIV-1_HeavyChain
caggucuauauggagcaagcgggcgcgggcaugaaaaagcccggggccucgaugacggucucgugcaagaccgcggacgaggacauauucgaugccgcguacaugcacugggucaggcaagcgcccgggcaaacguucgagugguugggcuggaugaagcccgugaccggggcagugaacuaugccaggcaauuucaagggcgcgugagcuuuuacaggaccagggaauugggcauagccuauauggaucuaagggacuugaaauuugacgauaccgcggucuauuucugugccaggaaaacgaaaggggacgugagcggggacgaucgcggguucuuuuucgaucucuggggcaggggcacgcgcgugaucgugagcucggccucgaccaagggcccgagcguguucccgcacgaucucagg

SEQ ID NO: 57242 - RNA, 423 nt, Artificial Sequence
  derived and/or modified sequence opt11 from anti-HIV-1_HeavyChain
cagguguauauggagcaggcggggggggggaugaagaagccgggggcgaguaugacggugaguuguaagacggcggaugaggauauauuugaugcggcguauaugcauugggugaggcaggcaagggggcagacguuugagugguugggguggaugaagccggugacgggggcggugaauuaugcgagacaguuccaggggagggugaguuuuuauaggacgagggagcuggggauagcguauauggauuugagggaucugaaguuugaugacacggcgguguauuuuugugcgaggaagacgaagggggaugugaguggggaugauaggggguuuuuuuuugauuugugggggagggggacgagggugauagugaguagugcgaguacgaaggggccgaguguguuuccgacgauauaugug

SEQ ID NO: 57243 - RNA, 423 nt, Artificial Sequence
  derived and/or modified sequence opt11 from anti-HIV-1_HeavyChain
caggucuauauggagcaagcgggcgcgggcgugaaaaagcccggggccucgguaacgcucucaugcaaaaccgcagacgaggacguguucgaugccgcguacaugcacugggucaggcaagcgcccgggcaaacguucgagugguugggcuggaugaagcccgugaccggggccgugagcuaugccaggaaauuucaagggcgagugagcuuuuacaugacaagggaauugggcauggccuauauggaucucaggaaccugcgcuuugacgauaccgcggucuauuucugugccaggaaaacggccggggacgugagcggggacaaucgcggguacuuuuucgaucuauggggcaggggcucacgcgugaucgugagcucggccucgaccaagggcccgagcguguucccgaccauauacgug

SEQ ID NO: 57244 - RNA, 423 nt, Artificial Sequence
  derived and/or modified sequence opt11 from anti-HIV-1_HeavyChain
caaguguacucgggcgcgggcaggggcggggucaagaaaccgggcgcgagcgugacccugagcuguaaaacggccgaugaagaugucuuugacgcggccuauaugcauugggugcgccaggccccgggccagaccuuugaauggcucggguggaugaaaccggucacgggcgcggucaauuacgcgcgcaaguuccagggcagggucucguucuaucgcacgcgcgagcucgggaucgcguacauggaccugcgcaaucucagguucgaugacacggccguguacuuuugcgcgcgcaagaccgcgggcgaugucucaggcgauaaaaggggcuuuuucuuugacuugugggggcgcggaagcagggucauagucucgagcgcgagcacgaaagggcccucggucuuucccacgaucuauguc

SEQ ID NO: 57245 - RNA, 417 nt, Artificial Sequence
  derived and/or modified sequence opt11 from anti-HIV-1_HeavyChain
caggcccaucucgagcaaucgggaucgggcgugaaaaagcccggggccucggucagggucucgugcuggaccucggaagauaucuuugaaagaaccgagcucauacacuggguccggcaagcgcccgggcaagggcucgaguggauaggcugggucaagaccgugagcggggccgugaacuuuggcucgcccaauuucaggcacagggucucgcuaacgcgcgaucgcgaucucuuuaccgcgcacauggacauacgcgggcuaacgcaaggggacacggccacguacuuuugcgcgcgccagaaauuugaaaggggcgggcaagggugguauuucgaucucuggggcaggggcacgcucauagucgugagcucggccuuuaccaagggcccaagcguguucccgcacgaucuaagg

SEQ ID NO: 57246 - RNA, 414 nt, Artificial Sequence
  derived and/or modified sequence opt11 from anti-HIV-1_HeavyChain
caagugcaacugggacagagcggggccgagaugaagaaaccgggcucaagcgugaaagugagcuguaaagcgagcgggggcacguucaggcacucgcccauaagcugggucaggcaagcgcccgggcaagggcucgaguggauaggcugggucaaggccgugagcggggccgugaacuauggcucgcucgauuucaggcacagggucucgcucacgcgcgaucgcgaucuaucgaccgcgcacauggacauacgcgggcucacgcaagaugacacggccacguacuuuugcgcgcgccagaaauuugccaggggcgaucaagggugguuuuucgaucuauggggcaggggcacgcucauagucgugagcucggccucgaccaagggcccgagcguguucccgcacgaucucagg

SEQ ID NO: 57247 - RNA, 417 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagccccaggccaaggccuagaauggaucggcugggucaaaaccgucaccggcgcagucaacuucggcagcccaaacuuccgccaccgcgucagccucacccgcgaccgcgaccucuucaccgcccacauggacauccgcggacucacacaaggcgacaccgccaccuacuucugcgccagacaaaaauucgaacgcggcggccaaggcugguacuucgaccucuggggccgcggcacccucaucgucgucuccuccgccagcacaaaaggccccucagucuucccccacgaccuccga

SEQ ID NO: 57248 - RNA, 423 nt, Artificial Sequence
  derived and/or modified sequence opt11 from anti-HIV-1_HeavyChain
caggucuauauggagcaagcgggcgcgggcgugaaaaagcccggggccucagucacgcuaucgugcaagacagcagacgaggacguguucgaugccgcguacaugcacugggucaggcaagcgcccgggcaaacguucgagugguugggcuggaugaagcccgugaccggggcagugagcuaugccaggaaauuucaagggcgagugagcuuuuacaugaccagggaacugggcauggccuauauggaucucaggaacuugcgauuugacgauaccgcggucuauuucugugccaggaaaacggccggggacgugagcggggacaaucgcggguacuuuuucgaucuauggggcagaggcucgugggugaucgugagcucggccucgaccaagggcccgagcguguucccgcacgaucuaagg

SEQ ID NO: 57249 - RNA, 423 nt, Artificial Sequence
  derived and/or modified sequence opt11 from anti-HIV-1_HeavyChain
cagguguauauggagcaggcagggggaggggugaagaagccgggggcgagcgugacgcugaguugcaagacggcggacgaggacguguucgaugcggcguacaugcacugggugaggcaggcgccggggcagacguucgaguggcugggguggaugaagccggugacgggggcggugaacuaugcgaggaaguuucaggggagggugagcuuuuacaggacgagagaauuggggauagcguauauggaccuaagaaaccugagauuugacgauacggcgguguauuucugugcaaggaagacggcgggggacgugagcggggacaagaggggguucuuuuucgaucuaugggggagggggagcagaguaauagugagcagcgcaaguacgaagggaccgagcguguucccgacgauaugcgug

SEQ ID NO: 57250 - RNA, 417 nt, Artificial Sequence
  derived and/or modified sequence opt11 from anti-HIV-1_HeavyChain
caagcccaccuagaacaauccggcucaggcgucaaaaaacucggcgccuccguacgcgucuccugcuggaccuccgaagacaucuucgaacgcaccgaacucauccacuggguccgccaagccccaggccgcggccucgaauggaucggcugggucaaagccgucuccggcgccgucaacuacggcucccucgacuuccgccaccgcgucucccucacccgagaccgcgaccuauucaccgcccacauggacauccgcggccucacccaagacgacaccgccaccuacuucugcgcccgccaaaaauucgcccgcggcgaccaaggcugguucuucgaccucuggggccgcggcacccucaucgucgucuccuccgccucaaccaaaggccccuccgucuucccccacgaccuccgc

SEQ ID NO: 57251 - RNA, 423 nt, Artificial Sequence
  derived and/or modified sequence opt11 from anti-HIV-1_HeavyChain
cagguguauauggagcaggcgggggggggggugaagaagccgggggcgagcgugacguugaguuguaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagagaguuggggauagcguauauggaucugaggaauuugagguuugaugauacggcgguguauuuuugugcgaggaagacggcgggagaugugaguggggauaagaggggguuuuuuuuugaucugugggggagggggagcagggugauagugaguagugcgaguacgaaggggccgaguguguuuccgacgauauaugug

SEQ ID NO: 57252 - RNA, 423 nt, Artificial Sequence
  derived and/or modified sequence opt11 from anti-HIV-1_HeavyChain
caaguguucauggaacaggccggggccgggaugaagaaaccgggcgcgagcaugaccgugagcuguaaaacggccgaugaagaugucuuugacgcggcauauaugcauugggugcgacaggccccgggccagaccuuugaauggcucggguggaugaaaccggucacgggcgcggucaauuacgcgcgcaaguuccagggcaggguaucguucuaucgcacgcgagagcucgggaucgcguacauggacuugcgcaaucucagguucgaugacacggccguguacuuuugcgcgcgcaagaccgcgggcgaugucucgggcgauaaaaggggcuuuuucuuugacuugugggggcgcgggagcagggucauagucucgagcgcgagcacgaaagggcccucggucuuuccccaugacuugcgc

SEQ ID NO: 57253 - RNA, 423 nt, Artificial Sequence
  derived and/or modified sequence opt11 from anti-HIV-1_HeavyChain
caaguguacauggaacaggccggggccggggucaagaaaccgggcgcgagcgugacacugagcuguaaaacggccgaugaagaugucuuugacgcggccuauaugcacugggugcgccaggccccgggccagacauuugaauggcucggguggaugaaaccggucacgggcgcggucaauuacgcgcgcaaguuccagggcagggucucguucuaucgcacgcgcgagcucgggaucgcauacauggaccugcgcaaucucaggcucgaugacacggccguguacuuuugcgcgcgcaagaccgcaggcgaugucucgggcgauaaaaggggcuuuuucuuugacuugugggggcgagggagcagggucauagucucgagcgcgagcacgaaagggcccucggucuuuccccaugacuugcgc

SEQ ID NO: 57254 - RNA, 420 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgaacgcaccgaacucaucuacuggguccgccaagcccccggccgcggccucgaauggaucggcugggucaaaaccgucuccggcaccgucaacuucggcucauccgacuuccgcaaccgcaucucccucacccgcgaccgagaccucuccaccgcccacauggacauccgaggccucacccaagacgacaccgccaccuacuucugcgcccgccaaaaauucgaaucccucuacuccgacgaccaaggcuccuacuucgaccucuggggccgaggcacccucaucaucgucuccucagccuccaccaaaggccccucagucuuccccaccauc

SEQ ID NO: 57255 - RNA, 423 nt, Artificial Sequence
  derived and/or modified sequence opt11 from anti-HIV-1_HeavyChain
caggucuauauggagcaagcgggcgggggcgugaaaaagcccggggccucggucacgcuaucgugcaagaccgcggacgaggacguguucgaugccgcguacaugcacugggucaggcaagcgccagggcaaacguucgagugguugggcuggaugaagcccgugaccggggccgugagcuaugccaggaaauuucaagggcgcgugagcuuuuacaugacaagggaauugggcauggccuauauggaucucaggaacuugcgcuuugacgauacagcggucuauuucugugccaggaaaacggccggggacgugagcggggacaaucgcggguacuuuuucgaucuauggggcaggggcucgcgcgugaucgugagcucggccucgaccaagggcccgagcguguucccgaccauaugcgug

SEQ ID NO: 57256 - RNA, 417 nt, Artificial Sequence
  derived and/or modified sequence opt11 from anti-HIV-1_HeavyChain
caggcccaucuagagcaaucgggcucgggcgugaaaaagcccggggccucggucagggucucgugcuggaccucagaagauaucuuugaaaagagcgagcucauacacuggguaaggcaagcgcccgggcaagggcucgaguggauaggcugggucaagacagugaccggggccgugaacuuuggcucgagcgauuucaggcaaagggucucgcucacgcgcgaucgcgaucuauuuaccgcgcacauggacauacgcgggcucacgcaaggggacacggccacguacuuuugcgcgcgccagaaauauuacgcgggcgggcaagggugguauuucgaucucuggggcaggggcacgcucauagucgugagcucggccucgaccaagggcccgagcguguucccgcacgaucucagg

SEQ ID NO: 57257 - RNA, 426 nt, Artificial Sequence
  derived and/or modified sequence opt11 from anti-HIV-1_HeavyChain
caagcgcaccuggaacagagcgggagcggagucaagaaaccgggcgcgagcgugagagugagcuguuggucgagcgaggacauauucgagcgcacggaauugauccauugggugcgacaggccccgggccagggcuuggaauggaucgggugggugaaaacggucacgggcgcggucaauuucgggagcuuggacuuucgccaucgcaucagcuugaccagggacagagacuuguucacggcccauauggauauaaggggcuugacacagggcgauacagcgaccuauuucugugcaaggcaaaaguucgagagcagguacacgggcgggcaagggugguauuucgaucucuggggcaggggcacgcacauagucgugagcucggccucgaccaagggcccgagcguguucccgcacgaucucagg

SEQ ID NO: 57258 - RNA, 423 nt, Artificial Sequence
  derived and/or modified sequence opt11 from anti-HIV-1_HeavyChain
caaguguacaugggcgcgggcaggggcggggucaagaaaccgggcgcgagcgugaccuugagcuguaaaacggccgaugaagaugucuuugacgcagccuauaugcauugggugcgccaggccccgggccagaccuuugaauggcuaggguggaugaaaccggucacgggcgcgguaaauuacgcgcgcaaguuccagggcagggucucguucuaucgcacgcgcgagcucgggaucgcguacauggacuugcgcaaucucagguucgaugacacggccguguacuuuugcgcgcgcaagaccgcgggcgaugucucgggcgauaaaaggggauuuuucuuugaccugugggggcgcgggagcagggucauaguaucgagcgcgagcacgaaagggcccucggucuuucccacgaucuauguc

SEQ ID NO: 57259 - RNA, 423 nt, Artificial Sequence
  derived and/or modified sequence opt11 from anti-HIV-1_HeavyChain
cagguguacauggagcaggcgggaggggggaugaagaagccgggggcgaguaugacggugagcuguaagacggcggaugaggauauauuugaugcggcguauaugcauugggugagacaggcgccggggcagacguuugaguggcugggguggaugaagccggugacgggggcggugaauuaugcgaggcaguuucaggggagggugaguuuuuauaggacgagggagcuggggauagcguauauggauuugagggaucugaaguuugaugauacggcgguguauuuuugugcgagaaagacgaagggggaugugaguggggaugauaggggguuuuuuuuugauuugugggggagagggacgagggugauagugaguagcgcgagcacgaaggggccgaguguguuuccgacgauaugugua

SEQ ID NO: 57260 - RNA, 423 nt, Artificial Sequence
  derived and/or modified sequence opt11 from anti-HIV-1_HeavyChain
caaguguacauggaacaggccgggggcgggaugaagaaaccgggcgcgagcaugacagugagcuguaaaacggccgaugaagauaucuuugacgcggccuauaugcacugggugcgccaggccccgggccagaccuuugaauggcuuggguggaugaaaccggucacgggcgcggucaauuacgcgcgacaguuccagggcagggucucguucuaucgcacgcgagagcucgggaucgcguacauggacuugcgagaucucaaguucgaugacacggccguguacuuuugcgcgcgaaagaccaagggcgaugucucgggcgaugacaggggcuuuuucuuugacuugugggggcgcgggaccagggucauagucucgagcgcgagcacgaaagggcccucggucuuuccccacgacuugcgc

SEQ ID NO: 57261 - RNA, 423 nt, Artificial Sequence
  derived and/or modified sequence opt11 from anti-HIV-1_HeavyChain
caggucuauauggagcaagcgggcgcgggcgugaaaaagcccggggccucggucacgcucucgugcaagaccgcggacgaggacguguucgaugccgcguacaugcacugggucaggcaagcgcccgggcaaacguucgagugguugggcuggaugaagccagugaccggggccgugaacuaugccaggaaauuucaagggaaagugagcuuuuacaggaccagggaauugggcauagcauauauggaucucaggaacuugcgcuuugacgauaccgcggucuauuucugugccagaaaaacggccggggacgugagcggggacaagcgcggguucuuuuucgaucucuggggcaggggaucgcgcgugaucgugagcucggccucgacaaagggaccgagcguguucccgcacgaucucagg

SEQ ID NO: 57262 - RNA, 423 nt, Artificial Sequence
  derived and/or modified sequence opt11 from anti-HIV-1_HeavyChain
caggucuauauggagcaagcgggcgcgggcgugaaaaagccaggggccucggucacgcucucgugcaagaccgcggacgaggacguguucgaugccgcguacaugcacugggucaggcaagcgcccggacaaacguucgaguggcugggcuggaugaagcccgugaccggggccgugaacuaugcaaggaaauuucaaucgcgcgugagcuuuuacgggaccagggaauugggcauagccuauauggaucuaaggaacuugcgcuuugacgauaccgcggucuauuucugugcaaggaaaacggccggggacgugagcggggacaagcgcggguucuuuuucgaucucuggggcagaggcucgcgagugaucgugagcucggccucgaccaagggcccgagcguguucccgcacgaucucagg

SEQ ID NO: 57263 - RNA, 420 nt, Artificial Sequence
  derived and/or modified sequence opt11 from anti-HIV-1_HeavyChain
caagggcacacggucgagcaaucgggcucgggcgugaaaaagcucggggccucggucagggucucgugcuggaccucggaagauaucuuugaaacgaccgagcuaauacacugggucagacaagcgcccgggcaagggcucgaguggauaggcugggucaagaccgugagcggggcagugaacuuuggcucgcucaauuucaggcacagggucucgcucacgcgcgaucgagaucucuuuaccgcgcacauggacauaagagggcucacgcaaggggacacggccacguacuuuugcgcgcgccagaaauuugccaggggcgaucaagggugguuuuucgaucucuggggcaggggcacgcucauagucgugagcucggccucgaccaagggcccgagcguguucccgcacgaucucagg

SEQ ID NO: 57264 - RNA, 420 nt, Artificial Sequence
  derived and/or modified sequence opt11 from anti-HIV-1_HeavyChain
caagcgaccccguggucgaacuugggcaggggcgugaaaaagcucggggccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucaccaaauuucagacacagggucucgcuaacgcgcgaucgcgaucucuuuaccgcgcacauggacauacgcgggcucacgcaaggggacacggccacguacuuuugcgcgcgccagaaauuugaaaggggcgggcaagggugguauuucgaucucuggggcaggggcacgcucauagucgugagcucagccucgaccaagggcccgagcguguucccgcacgaucucagg

SEQ ID NO: 57265 - RNA, 423 nt, Artificial Sequence
  derived and/or modified sequence opt11 from anti-HIV-1_HeavyChain
caggucuuuauggagcaagcgggcgcgggcaugaaaaagcccggggccucaaugacggucucgugcaagaccgcggacgaggacguguucgaugccgcguacaugcacugggucaggcaagcgcccgggcaaacguucgagugguugggcuggaugaagccagugaccggggccgugagcuaugccaggaaauuucaagggcgagugagcuuuuacaugaccagggaauugggcauggccuauauggaucucaggaacuugcgcuuugacgauacagcggucuauuucugugccaggaaaacggccggggacgugagcggggacaaucgcggguacuuuuucgaucucuggggcaggggcucgcgcgugaucgugagcucggccucgaccaagggcccgagcguguucccgcacgaucuaagg

SEQ ID NO: 57266 - RNA, 423 nt, Artificial Sequence
  derived and/or modified sequence opt11 from anti-HIV-1_HeavyChain
caaguguacauggaacagagcgggggcggggucaagaaaccgggcgcgagcgugaccuugagcuguaaaacggccgaugaagaugucuuugacgcggccuauaugcauugggugcgccaggccccgggccagaccuuugaauggcucggguggaugaaaccggucacgggcgcggucucguacgcgcgcaaguuccagggcagggucucguucuaucgcacgcgcgagcucgggaucgcguacauggacuugcgcaaucucagguucgaugacacggccguguacuuuugcgcacgcaagaccgcgggagaugucucgggcgauaaaaggggcuuuuucuuugacuugugggggcgagggagcagggucauagucucgagcgcgagcacgaaagggccaucggucuuuccccaugaccugcgc

SEQ ID NO: 57267 - RNA, 423 nt, Artificial Sequence
  derived and/or modified sequence opt11 from anti-HIV-1_HeavyChain
cagguauacauggagagggggagggggggggugaagaagccgggggcgagugugacgcugagcugcaagacggcggacgaggacguguuugaugcggcguacaugcacugggugaggcaggcgccggggcagacguucgagugguugggguggaugaagccagugacaggggcggugaauuacgcgaggaaguuucaggggagggugagcuuuuacaggacgagggaguuggggauagcguauauggaucugaggaauuugagguuugacgauacggcgguguauuucugugcgaggaagacggcgggggacgugagcggggauaagaggggguuuuuuuuugauuugugggggagggggaguagggugauagugagcagugcgagcacgaaggggccgaguguguuuccgcaugauuugagg

SEQ ID NO: 57268 - RNA, 423 nt, Artificial Sequence
  derived and/or modified sequence opt11 from anti-HIV-1_HeavyChain
caggucuauauggagcaagcgggcgggggcgugaaaaagcccggggccucggucacgcucucgugcaagaccgcggacgaggacguguucgaugccgcguacaugcacugggucaggcaagcgcccgggcaaacguucgagugguugggcuggaugaagcccgugacaggggccgugagcuaugccaggcgauuucaagggcgcgugagcuuuuacaugaccagggaauugggcauggccuauauggaucucaggaacuugcgcuuugacgauaccgcggucuauuucugugccaggaaaacggccggggacgugagcggggacaaucgcggguacuuuuucgaucucuggggcaggggcucgcgcgugauagugagcucggccucgaccaagggcccgagcguguucccgaccauaugcgug

SEQ ID NO: 57269 - RNA, 423 nt, Artificial Sequence
  derived and/or modified sequence opt11 from anti-HIV-1_HeavyChain
cagguguauauggagcaagcgggggggggggugaagaagccgggggcgagugugacguugaguuguaagacggcggaugaggauguguuugaugcggcguauaugcauugggugaggcaggcgccggggcagacguuugagugguugggguggaugaagccggugacgggggcggugaguuaugcgaggaaguuucaggggagggugaguuuuuauaugacgagggaguuggggauggcguauauggauuugaggaauuugagguuugaugauacggcgguguauuuuugugcgaggaagacggcgggggaugugaguggggauaauaggggguauuuuuuugauuugugggggagggggaguagggugauagugaguagugcgaguacgaaggggccgaguguguuuccgcaugauuugagg

SEQ ID NO: 57270 - RNA, 423 nt, Artificial Sequence
  derived and/or modified sequence opt11 from anti-HIV-1_HeavyChain
caaguauucauggaacaggccgggggcgggaugaagaaaccgggagcgagcaugaccgugagcuguaaaacggccgaugaagauauauuugacgcggccuauaugcauugggugcgccaggccccgggccagaccuuugaauggcucggguggaugaaaccggucacgggcgcggucaauuacgcgcgccaguuccagggcagggucucguucuaucgcacgcgcgagcucgggaucgcguacauggacuugcgcgaucucaaguucgaugacacggccguguacuuuugcgcgcgaaagacaaagggcgaugucucgggcgaugacaggggcuuuuucuuugacuugugggggcgcgggaccagggucauaguaucgagcgcgagcacgaaagggcccucggucuuuccccaugacuugcgc

SEQ ID NO: 57271 - RNA, 423 nt, Artificial Sequence
  derived and/or modified sequence opt11 from anti-HIV-1_HeavyChain
caagcccaccucgaacaauccggcucaggcgucaaaaaacccggcgccuccguccgcgucuccugcuggaccuccgaagacaucuucgaacgcaccgaacucauccacuggguccgccaagcccccggccaaggccucgaauggaucggcugggucaaaaccgucaccggcgcagucaacuucggcucccucgacuuccgccaccgcaucucccucacccgcgaccgcgaccucuucaccgcccacauggacauccgaggccucacccaaggcgacaccgccaccuacuucugcgcccgccaaaaauucgccucccgcuacuccggcgaccaaggcucauacuucgaccuauggggccgcggcacccucaucgucgucuccuccgccuccaccaaaggccccucagucuucccccacgaccua

SEQ ID NO: 57272 - RNA, 423 nt, Artificial Sequence
  derived and/or modified sequence opt11 from anti-HIV-1_HeavyChain
caaguguucauggaacaggccggggccggaaugaagaaaccgggcgcgagcaugaccgugagcuguaaaacggccgaugaagaugucuuugacgcggccuauaugcauugggugcgccaggccccgggcccggacuuggaauggcucggguggaugaaaccggucacgggcgcggucaauuacgcgcgcaaguuccagggcagggucucguucuaucgcacgcgcgagcucgggaucgcguacauggacuugcgcgaucucagauucgaugacacggccguguacuuuugcgcgcgcaagaccgcgggcgaugucucgggcgauaaaaggggcuuuuucuuugacuugugggggcgcgggagcagagucauagucucgagcgcgagcacgaaagcgcacaggagcucgcccacgaucuguguc

SEQ ID NO: 57273 - RNA, 426 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggaccuccgaagacaucuucgaacgcaccgaacuaauccacuggguccgccaagcccccggccaaggccucgaauggaucggcugggucaaaacagucaccggcgccgucaacuucggcucccccaacuuccgccaccgcaucucccuaacccgcgaccgcgaccucuucaccgcccacauggacauccgaggccucacccaaggcgacaccgccaccuacuucugcgcccgccaaaaauucgaaucccgcuacaccggcggccaaggcugguacuucgaccucuggggccgcggcacccacaucgucgucuccuccgcaucaaccaaaggccccucagucuucccccacgaccuacgc

SEQ ID NO: 57274 - RNA, 423 nt, Artificial Sequence
  derived and/or modified sequence opt11 from anti-HIV-1_HeavyChain
caggucuauauggagcaagcgggcgggggcgugaaaaagcccggggccucggucacgcucucgugcaagaccgcggacgaggacguguucgacgccgcguacaugcacugggucaggcaagcgccagggcaaacguucgaguggcugggcuggaugaagccagugaccggggccgugagcuaugccaggaaauuucaagggcgagugagcuuuuacaugaccagggaauugggcauggccuauauggaucucaggaacuugcgcuuuaacgauaccgcggucuauuucugugcaaggaaaacggccggggacgugagcggggacaaucgcggguacuuuuucgaucuauggggcaggggcucgcgagugaucgugagcucggccucgaccaagggcccgagcguguucccgcacgaucucagg

SEQ ID NO: 57275 - RNA, 423 nt, Artificial Sequence
  derived and/or modified sequence opt11 from anti-HIV-1_HeavyChain
caaguguacauggaacaggccgggggcggggucaagaaaccgggcgcgagcgugaccuugagcuguaaaacggcagaugaagauguauuugacgcggccuauaugcauugggugagacaggcaccgggacagaccuuugaauggcuaggguggaugaaaccggucacgggagcgguaaauuacgcgagaaaguuccagggcaggguaucguucuaucgaacgagagagcuagggauagcguacauggacuugcgcaaucugagguucgaugacacggcaguguacuuuugcgcgagaaagacagcgggagaugucucgggagauaacaggggauauuucuuugaccugugggggagagggagcaggguaauaguaucaagcgcgagcacgaaagggccaucgggauugccacaugacuugagg

SEQ ID NO: 57276 - RNA, 423 nt, Artificial Sequence
  derived and/or modified sequence opt11 from anti-HIV-1_HeavyChain
caaguguacauggaacaggccgggggcggggucaagaaaccgggcgcgagcguaaccuugagcuguaaaacggccgaugaagaugucuuugacgcggccuauaugcauugggugcgccaggccccgggccagaccuuugaauggcucggguggaugaaaccggucacgggcgcggucaauuacgcgcgcaaguuccagggcagggucucguucuaucgcacgcgcgagcucgggaucgcguacauggacuugcgcaaucucagguucgauggcacggccguguacuuuugcgcgcgaaagaccgcgggcgaugucucgggcgauaaaaggggcuuuuucuuugacuugugggggcgcgggagcagggucauagucucgagcgcgagcacgaaagggcccucggucuuuccccaugacuugcgc

SEQ ID NO: 57277 - RNA, 423 nt, Artificial Sequence
  derived and/or modified sequence opt11 from anti-HIV-1_HeavyChain
cagguguauauggagcaggcgggggggggggugaagaagccgggggcgagcgugacguugagcuguaagacggcggaugaggauguguuugaugcggcguauaugcauugggugagacaggcgccggggcagacauuugagugguugggguggaugaagccggugacgggggcagugaauuaugcgagaaaguuucaggggaggguaaguuuuuauaggacgagagaguuggggauagcguauauggauuugaggaauuugagguucgaugauacggcgguguauuuuugugcgaggaagacggcgggggaugugaguggggauaagaggggguuuuuuuuugaucugugggggagggggagcagggugauagugaguagugcgagcacgaaggggccgaguguguuuccgcaugauuugagg

SEQ ID NO: 57278 - RNA, 423 nt, Artificial Sequence
  derived and/or modified sequence opt11 from anti-HIV-1_HeavyChain
caaguccaacucguccaauccggcgccgaggucaaaaaaccuggcgccucccucaaagucuccugcaaagccuccggcuacaccuucaccgacuacuacauccacuggguccgccaagcccccggacaaggccucgaauggaucggcugggucaaaaucgucuccggcaccgucaacuucgccucccucgacuuccgcaaccgcaucucccucucccgcgaccgcgaccucuccaccgccuacauggacauccgcggccucacccaagacgacaccgccacauacuucugcgcccgccaaaaauucgccucccgcuacuccggcgaccaaggcuccuacuucgaccucuggggccgcggcacccucaucgucgucuccuccgccuccaccaaaggccccucagucuucccccacgaccuacga

SEQ ID NO: 57279 - RNA, 423 nt, Artificial Sequence
  derived and/or modified sequence opt11 from anti-HIV-1_HeavyChain
caggcacaucucgagcaaucgggcucgggcgugaaaaagcccggggccucggucagaguaucgugcuggagcucggaagauaucuuugaaaggaccgagcucauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggaccuugaucguggucucgagcgcgagcacgcgcgcgcacaggagcccgcacgaucucagg

SEQ ID NO: 57280 - RNA, 426 nt, Artificial Sequence
  derived and/or modified sequence opt11 from anti-HIV-1_HeavyChain
caagcgcacuuggaacagagcgggagcgggguaaagaaaccgggcgcaagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccagcgcgugagcuugaccagggacagggacuuguucacggcccauauggauaucaggggcuugacccagggcgauaccgcgaccuauuucugugccaggcaaaaguucgagagcagauacacgggcgggcaagggugguauuucgaucucuggggaaggggcacgcacauagucgugagcucggccucgaccaagggcccgagcguguucccgcacgaucucagg

SEQ ID NO: 57281 - RNA, 426 nt, Artificial Sequence
  derived and/or modified sequence opt11 from anti-HIV-1_HeavyChain
caagugcaauugguccagagcggggccgaggucaagaaaccgggcgcaagugugcgcgugagcuguuggacgagcgaggacauauucgauaccacggaacugaucuauugggugcgccaggccccgggccagggacuggaauggaucgggugggugaaaauagucucaggcacggucaauuucgcgagcuuggacuuccgcaaucgcauaagccugagcagggacagggacuugagcacggccuauauggauaucaggggcuugacccaggacgauaccgcgaccuauuucugcgccaggcaaaaauucgcgagcagguacucgggcgaucaagggagcuauuucgaucucuggggcaggggcacgcucauagucgugagcucggccucaaccaagggcccgagcguguucccgcaaauaugcgug

SEQ ID NO: 57282 - RNA, 426 nt, Artificial Sequence
  derived and/or modified sequence opt11 from anti-HIV-1_HeavyChain
cagagccaucucgagcaaucgggcucggccaugaaaaagcccggggccucagucagggucucgugcuggaccucggaagauaucuuugaaaggaccgagcucauauacugggucaggcaagcgcccgggcgcgggcucgaguggauaggcuggaugaagaccgugagcgggaccgugaacuuuggcucgagcgauuucagaaacaggaucucgcucacgagagaucgcgaccucucgaccgcgcacauggacauacgcgggcuaacgcaagaugacacggccacguacuuuugcgcgcgccagaaauucgaaucgcucuauagcgaugaccagggcucguacuuugacuugugggggcgcgggaccuugaucauagucucgagcgcgagcacgaaagcgcacaggagcucgcccacgaccuugcgc

SEQ ID NO: 57283 - RNA, 423 nt, Artificial Sequence
  derived and/or modified sequence opt11 from anti-HIV-1_HeavyChain
caaucccaccuagaacaauccggcuccgccaugaaaaaacccggcgcauccguccgcgucucaugcuggaccuccgaagacaucuucgacaccaccgaacucaucuacuggguccgccaagcccccggccaaggccucgaauggaucggcugggucaaaaucguaucaggcaccgucaacuucgccucacucgacuuccgaaaccgcaucucccucucccgcgaccgcgaccucuccaccgcccacauggacauccgcggccucacccaagacgacaccgccaccuacuucugcgcccgccaaaaauucgccucccgcuacuccggcgaccaaggcuccuacuucgaccucuggggccgcggcacccucaucaucgucucauccgccuccaccaaaggccccuccgucuucccccgcuccgcc

SEQ ID NO: 57284 - RNA, 423 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccauugggugcgccaggccccgggccagggcuuggaauggaucgggugggugaaaacggucacgggcgcggucaauuucgggcaccagaucucggacagggucucgcuaucgcgcgaucgcgaucucucgaccgcguacauggacauacgcgggcucacgcaagaugacacggccacguacuuuugcgcgcgccagaaauucgccucgcgcuauagcggggaccagggcucguacuuugaccugugggggcgcgggaccuugaucguggucucgagcgcgagcacgaaagggcccucggucuuuccccaugacuugcga

SEQ ID NO: 57285 - RNA, 423 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcucauauacugggucaggcaagcgcccgggcaagggcucgaguggauaggcugggucaagaucgugagcgggaccgugaacuucgccucgcucgauuucagaaacagaaucucgcucucacgcgaccgcgaucucucgaccgcgcacauggacauacgcgggcucacgcaagaugacacggccacguacuuuugcgcgcgccagaaauuugccucgcgcuauagcggggaccagggcucguacuuugacuugugggggcgcgggacccugaucauaguaucgagcgcgagcacgcgcgcgcacaggagcucacccaggagcgcg

SEQ ID NO: 57286 - RNA, 426 nt, Artificial Sequence
  derived and/or modified sequence opt11 from anti-HIV-1_HeavyChain
caagcgcacuuggaacagagcgggagcggggucaagaaaccgggagcgagcgugcgcgugagcuguuggacgagcgaggacauauucgagaaaucggaauugauccauugggugcgccaggccccgggccagggcuuggaauggaucgggugggugaaaacggucacgggcgcggucaauuucgggagcucggacuuucgccaucgcaucagcuugacaagggacagagacuuguucacggcccauauggauauaaggggcuugacccagggcgauaccgcgaccuauuucugugccaggcaaaaguucgagagcagguacacgggcgggcaagggugguauuucgaucucuggggcaggggcacgcacauagucgugagcucggccucgaccaagggcccgagcguguucccgcacgaucucagg

SEQ ID NO: 57287 - RNA, 426 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucgucuccggcaccgucaacuucggcuccuccgacuuccgcaaccgcaucucccucacccgagaccgcgaccucucaaccgcccacauggacauccgcggccucacccaagacgacaccgccaccuacuucugcgcccgccaaaaauucgaaucccucuacuccgacgaccaaggcuccuacuucgaccucuggggccgcggcacccucaucaucgucuccucagccuccaccaaaggccccuccgucuuccccaccaucuacguc

SEQ ID NO: 57288 - RNA, 426 nt, Artificial Sequence
  derived and/or modified sequence opt11 from anti-HIV-1_HeavyChain
cagagccaucucgagcaaucgggcucggccaugaaaaagcccggggccucgguccgggucucaugcuggaccucggaagauaucuuugacacgaccgagcucauauacugggucaggcaagcgcccgggcaagggcucgaguggauaggcugggucaagaucguaagcgggaccgugaacuuugccucgcucgacuucaggaacaggaucucacucucgcgcgaucgcgaucucucaacagcguacauggacauacgcgggcucacgcaagaugacacggccacguacuuuugcgcgcgccagaaauuugccucacgcuauagcggagaccagggcucguacuuugaccugugggggcgcgggaccuugaucguggucucgagcgcgagcacgaaagggcccucggucuuuccccaugacuugcgc

SEQ ID NO: 57289 - RNA, 423 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucgucuccggaaccguaaacuucgccucccucgacuuccgcaaccgcaucucccucucccgagaccgcgaccucuccaccgcccacauggacauccgcggccucacccaagacgacaccgccaccuacuucugcgcccgccaaaaauucgccucccgcuacuccggcgaccaaggcucauacuucgaccucuggggccgcggcacccucaucaucgucuccuccgccuccaccaaaggccccucagucuuccccaccaucugc

SEQ ID NO: 57290 - RNA, 417 nt, Artificial Sequence
  derived and/or modified sequence opt11 from anti-HIV-1_HeavyChain
caagcacaccuagaacaaagcggaagcggagucaaaaaaccaggcgcaagcguacgagucagcugcuggacauccgaagacauauucgaacgcacagaacuaauccacuggguccgccaagcccccggccaaggccuagaauggaucggcuggguaaaaacagucacaggcgcagucaacuucggcagcccaaacuuccgccaccgcguaagccuaaccagagacagagaccuaagcacagcccacauggacauccgaggccuaacccaagacgacaccgcaaccuacuucugcgccagacaaaaauucgcacgcggagaccaaggcugguucuucgaccuauggggccgcggaacccuaauaguagucucaagcgcacuccaccaaggacccaucggccuacccccacgcucaacc

SEQ ID NO: 57291 - RNA, 423 nt, Artificial Sequence
  derived and/or modified sequence opt11 from anti-HIV-1_HeavyChain
caaguguacauggaacaggccgggggcggggucaagaaaccgggcgcgagcgugaccuugagcuguaaaacggccgaugaagaugucuuugacgcggccuauaugcauugggugcgccaggccccgggccagaccuuugaauggcucggguggaugaaaccggucacgggcgcggucaauuacgcgcgcaaguuccagggcagggucucguucuaucgcacgcgcgagcucgggaucgcguacauggaccugcgcaaccucagauucgaugacacggccguguacuuuugcgcgcgcaagaccgcgggcgaugucucaggcgauaaaaggggcuuuuucuuugacuugugggggcgcgggagcagggucauagucucgagcgcgagcacgaaagggcccucggucuugcccccgcgcucggcc

SEQ ID NO: 57292 - RNA, 423 nt, Artificial Sequence
  derived and/or modified sequence opt11 from anti-HIV-1_HeavyChain
caaguccaacuaguccaauccggcgccgaagucaaaaaacccggcgccuccgucaaaaucuccugcaaagccuccggcuacaccuucauccgccacggcauccacuggcuccgccaaguccccggccaacgccccgaauggaugggcuggauccgccccaaaaccggcgcccgcaaccaagcccgccaauuccaaccccgcaucucccucgcccgcgaccgcgcccucuccaccgccuaccuagaccucaacucccucaccucagccgacuccggcaccuacuucugcgcccgccaaaccuucaaacccgacuucuacuucgccgaccaaggcugguccuucaaccucuggggccgcggcgcccacuucaucgucuccuccgcccuccaccaaggccccaucggccuccccccccgcuccacc

SEQ ID NO: 57293 - RNA, 426 nt, Artificial Sequence
  derived and/or modified sequence opt11 from anti-HIV-1_HeavyChain
caaucccaccucgaacaaucaggcuccgccaugaaaaaaccaggcgccuccguccgcguauccugcuggaccuccgaagacaucuucgaacgcaccgaacucaucuacuggguccgccaagcccccggccaaggccucgaauggaucggcugggucaaaaucgucucaggcaccgucaacuucgccucccucgacuuccgcaaccgcaucucacucucccgcgaccgcgaccucuccaccgccuacauggacauccgcggccucacccaagacgacaccgccaccuacuucugcgcccgccaaaaauucgccucacgcuacucaggcgaccaaggcuccuacuucgaccucuggggccgcggcacccucaucgucgucuccuccgccuccaccaaaggccccuccgucuucccccacgaccuccgc

SEQ ID NO: 57294 - RNA, 426 nt, Artificial Sequence
  derived and/or modified sequence opt11 from anti-HIV-1_HeavyChain
caagcgcaccuggaacagagcgggagcggggucaagaaaccaggcgcgagcgugcgcgugagcuguuggacgagcgaggacauauucgagcgcacggaacugauccauugggugcgccaggccccgggccagggccuggaauggaucggaugggugaaaacggucacgggcgcggucaauuucgggagcuuggacuuucgccaucgaaucagcuugaccagggacagggacuuguucacggcccauauggauauaaggggauugacccagggcgauacagcgaccuaucucugugccaggcaaaaguucgagagcagguacacgggagggcaagggugguauuucgaucucuggggcaggggcacgcacauagucgugagcucggccucgaccaagggcccgagcguguucccgaccauaugcgug

SEQ ID NO: 57295 - RNA, 426 nt, Artificial Sequence
  derived and/or modified sequence opt11 from anti-HIV-1_HeavyChain
caagcgcacuuggaacagagcggaagcggggucaagaaaccgggcgcgagcgugcgcgugagcuguuggacgagcgaggacauauucgauaccacggaacugaucuauugggugcgccaggccccgggccagggcuuggaauggaucgggugggugaaaauagucucgggcacggucaauuucgcgagcuuggacuuucgcaaucgcauaagccugagcagggacagggacuugagcacggccuauauggauaucaggggccugacccaggacgauaccgcgaccuauuucugcgccaggcaaaaguucgcgagcagguacucaggcgaucaagggagcuauuucgaucucuggggcaggggcacgcucauagucgugagcucggccucgaccaagggcccgagcguguucccgcaaauaugcgug

SEQ ID NO: 57296 - RNA, 426 nt, Artificial Sequence
  derived and/or modified sequence opt11 from anti-HIV-1_HeavyChain
caagcacaccuagaacaaagcggaagcggggucaagaaaccaggcgcgagcguacgcgugagcugcuggacaagcgaagacauauucgagcgcacggaacuaauccacugggugcgccaagccccaggccagggccuagaauggaucgggugggugaaaacagucacaggcgcagucaacuucggaagccucgacuuccgccaccgcauaagccuaaccagggacagggaccuauucacagcccacauggacaucagaggccuaacccagggcgacaccgccaccuacuucugcgccagacaaaaguucgaaagcagauacacaggcgggcaagggugguacuucgaccuauggggcaggggcacacacauagucguaagcucggccucgaccaagggcccaagcguauucccaaccauaugcgug

SEQ ID NO: 57297 - RNA, 426 nt, Artificial Sequence
  derived and/or modified sequence opt11 from anti-HIV-1_HeavyChain
caagcccaccucgaacaauccggcuccggcguaaaaaaacccggcgccuccguacgcgucuccugcuggaccuccgaagacaucuucgaaaaauccgaacucauccacuggguccgccaagcccccggccaaggccucgaauggaucggcugggucaaaacagucaccggcgccgucaacuucggcuccagcgacuuccgccaacgcgucucccucacccgcgaccgcgaccucuucaccgcccacauggacauacgcggccucacccaaggagacaccgccaccuacuucugcgcccgacaaaaauucgaaucacucuacuccgacgaccaaggcuccuacuucgaccucuggggccgcggcacccucaucauagucuccuccgccucaaccaaaggccccuccgucuuccccaccaucugcguc

SEQ ID NO: 57298 - RNA, 426 nt, Artificial Sequence
  derived and/or modified sequence opt11 from anti-HIV-1_HeavyChain
caagcgcacuuggaacagagugggagcggggucaagaaaccgggagcgagcguacgagugagcugcuggacaagcgaggacauauucgagcgcacggaacugauccauugggugcgccaggccccaggccagggccuggaauggaucggaugggugaaaacggucucgggcgcggucaauuucgggagcccgaacuuucgccaucgcgugagccuaaccagggacagggacuuguucacggcccauauggauaucagaggcuugacccagggagauaccgcgaccuauuucugugccaggcaaaaguucgagagcagguacacgggcgggcaagggugguauuucgaucucuggggcaggggcacgcacauagucgugagcucggccucgaccaagggcccgagcguguucccgcacgaucucagg

SEQ ID NO: 57299 - RNA, 426 nt, Artificial Sequence
  derived and/or modified sequence opt11 from anti-HIV-1_HeavyChain
caaucccaccuagaacaauccggcuccgccaugaaaaaacccggcgccuccguccgugucucaugcuggacauccgaagacaucuucgacaccaccgaacuaaucuacuggguccgacaagcccccggccaaggccucgaauggaucggcugggucaaaaucgucuccggcaccgucaacuucgccucacucgacuuccgcaaccgcaucucccucucccgcgaccgagaccucuccaccgcccacauggacauccgcggccucacccaagacgacaccgccaccuacuucugcgcccgacaaaaauucgccucccgauacuccggcgaccaaggcuccuacuucgaccucuggggccgcggcacccucaucaucgucuccuccgccuccaccaaaggccccuccgucuuccccaccaucugcguc

SEQ ID NO: 57300 - RNA, 426 nt, Artificial Sequence
  derived and/or modified sequence opt11 from anti-HIV-1_HeavyChain
caagcacaccucgaacaauccggcuccggagucaaaaaacccggagccucaguccgcgucuccugcuggaccuccgaagacaucuucgaacgcaccgaacucauccacuggguccgccaagcccccggccaaggccucgaauggaucggcugggucaaaaccgucaccggcaccgucaacuucggcucccucaacuuccgccaacgcgucucccucacccgagaccgcgaccucuucacagcccacauggacauccgcggccucacacaagacgacaccgccaccuacuucugcgcccgacaaaaauucgccucccgcuacuccggcgaccaaggcuccuacuucgaccucuggggccgcggcacccucaucgucgucuccuccgccuccaccaaaggccccuccgucuuccccaccaucugcguc

SEQ ID NO: 57301 - RNA, 426 nt, Artificial Sequence
  derived and/or modified sequence opt11 from anti-HIV-1_HeavyChain
caaucccaccucgaacaauccggcuccgccaugaaaaaacccggcgccucaguccgcgucucaugcuggaccuccgaagacaucuucgacaccaccgaacucaucuacuggguccgccaagcccccggacaaggccucgaauggaucggcugggucaaaaucgucuccggcaccgucaacuucgccucccucgacuuccgcaaccgcaucucccucucacgcgaccgcgaccucuccaccgcccacauggacauccgcggccucacccaagacgacaccgcaaccuacuucugcgcccgccaaaaauucgccucccgcuacuccggcgaccaaggcucauacuucgaccucuggggccgcggcacccucaucaucgucuccuccgccuccaccaaaggccaccgcuccucccccaccaucugcguc

SEQ ID NO: 57302 - RNA, 423 nt, Artificial Sequence
  derived and/or modified sequence opt11 from anti-HIV-1_HeavyChain
caaguguacauggaacaggccggggccgggaugaagaaaccgggcgcgagcaugaccgugagcuguaaaacggccgaugaagaugucuuugacgcggccuacaugcauugggugcgacaggcaccaggccagaccuuugaauggcucggguggaugaaaccggucacgggcgcggucaauuacgcgcgcaaguuccagggcagggucucguucuaucgaacgcgcgagcucgggaucgcguacauggacuugcgcaaucucagguucgaugacacggccguguacuuuugcgcgcgcaagaccgcgggcgaugucucgggcgauaaaaggggcuuuuucuuugacuugugggggcgcgggagcagagucauagucucgagcgcgagcacgaaagggccaucggucuuuccaacgaucuaugua

SEQ ID NO: 57303 - RNA, 423 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacgagcgaggacauauucgauaccacggaacuguacugggucaggcaagcgcccgggcaaggacucgaguggauaggcugggucaagaucgugagcgggaccgugaacuuugccucgcucgauuucaggaacaggaucucgcucucgcgcgaucgcgaucucucgaccgcguacauggacauacgcgggcucacgcaagaugacacggccacguacuuuugcgcgcgccagaaauuugccucgcgcuauaguggggaccagggcucguacuuugacuugugggggcgcgggaccuugaucguggucucgagcgcgagcacgaaagggcccucggucuuuccccaugacuugcgc

SEQ ID NO: 57304 - RNA, 423 nt, Artificial Sequence
  derived and/or modified sequence opt11 from anti-HIV-1_HeavyChain
caaucgcaccuggaacagagcgggagcgcgaugaagaaaccaggcgcgagcgugcgcgugagcuguuggacgagcgaggacauauucgauaccacggaauugaucuauugggugcgccaggccccgggccagggcuuggaauggaucgggugggugaaaauagucucgggcacagucaauuucgcgcgccaguuccagggcagggucucguucuaucgcacgcgcgagcucgggaucgcguacauggacuugcgcgaucucaaguucgaugacacggccguguacuuuugcgcgcgcaagaccaagggagaugucucgggcgaugacaggggcuuuuucuucgacuugugggggcgcgggaccagggucauagucucgagcgcgagcacgaaagggcccucggucuuuccccaugacccggcc

SEQ ID NO: 57305 - RNA, 426 nt, Artificial Sequence
  derived and/or modified sequence opt11 from anti-HIV-1_HeavyChain
caagcgcacuuggaacagagcgggagcggggucaagaaaccgggcgcgagcgugcgcgugaguuguuggacgagcgaggacauauucgagaaaucggaauugauccauugggugcgacaggccccgggccagggccuggaauggaucgggugggugaaaacggucacgggagcggucaauuucgggagcucggacuuucgccagcgcgugagcuugaccagggacagggacuuguucacggcacauauggauaucaggggauugacacagggggauacagcgaccuauuucugugccaggcaaaaguucgagagcagguacacgggagggcaagggugguauuucgaucuauggggcaggggcacgcacauagucgugagcucggccucgaccaagggaccgagcguguucccgacaauaugcgug

SEQ ID NO: 57306 - RNA, 426 nt, Artificial Sequence
  derived and/or modified sequence opt11 from anti-HIV-1_HeavyChain
caagcgcaccuggaacagagcggaagcggaguaaagaaaccgggcgcgagcgugcgcguaagcugcuggacgagcgaagacauauucgagcgcucagaacugauccacugggugcgacaggccccgggccagggccuagaauggaucggaugggugaaaacggucacaggcgcggucaacuucggaagcccgaacuuccgccagcgcguaagccugaccagagacagagaccuaagcacagcccacauggacaucagaggccuaacccaagacgacaccgcgacauacuucugcgcccggcaaaaauucgaaagccuauacucagacgaccaaggaagcuacuucgaccucuggggcagaggcacgcucauaaucguaagcucagccucaacaaagggcccaagcguguucccgaccauaugcgug

SEQ ID NO: 57307 - RNA, 426 nt, Artificial Sequence
  derived and/or modified sequence opt11 from anti-HIV-1_HeavyChain
caagcgcacuuggaacagagcgcgagcggggucaagcgcccgggagcgagcgugcgagugagcuguuggacgagcgaggacauauucgagcgcacggaauugaucuauugggugcgccaggccccgggccagggcuuggaauggaucgggugggugaaaacgguaucgggcgcggucaauuucgggagccaggacuuucgcgaucgcuuuagccugaccagggacagggacuuguucacggcccauauggauaucaggggccugacccagggcgauaccgcgacauauuucugugccaggcaaaaguucgcgagcagguacucgggcgaucaagggagcuauuucgaucucuggggcaggggcacgcucauagucgugagcucggccucgaccaagggcccgagcguguucccgaccauaugcgug

SEQ ID NO: 57308 - RNA, 426 nt, Artificial Sequence
  derived and/or modified sequence opt11 from anti-HIV-1_HeavyChain
caagcccaccucgaacaauccggcuccggcgucaaaaaacucggcgccuccguccgcgucuccugcuggaccuccgaagacaucuucgaacgcaccgaacucauccacuggguccgccaagcccccggccaaggccucgaauggaucggcugggucaaagccgucuccggcgccguaaacuacggcucccucgacuuccgccacagagucucccucacccgcgaccgcgaccucuucaccgcccacauggacauccgaggccucacccaagacgacaccgccaccuacuucugcgcccgccaaaaauucgaaucacgcuacaccggcggccaaggcugguacuucgaccucuggggccgcggcacccacaucgucgucuccuccgccuccaccaaaggccccuccgucuuccccaccaucugcguc

SEQ ID NO: 57309 - RNA, 423 nt, Artificial Sequence
  derived and/or modified sequence opt11 from anti-HIV-1_HeavyChain
cagguccauauggagcaagcgggcgggggcaugaaaaagcccggggccucgaugacggucucgugcaagacagcggacgaggacauauucgaugccgcguacaugcacugggucaggcaagcgcccgggcaaacguucgagugguugggcuggaugaagccagugaccggggccgugaacuaugccaggcaauuucaagggcgcgugagcuuccuccaggaccagggcauacgcauagccuauauggaucucagggacuugaaauuugacgauaccgcggucuauuucugugccaggaaaacgaaaggggacgugagcggggacgaucgcggguucuuuuucgaucuauggggcaggggcacgcgcgugaucgugagcucgagcuugcaccagggcccgaucgggcucccgcccaggagcgcg

SEQ ID NO: 57310 - RNA, 426 nt, Artificial Sequence
  derived and/or modified sequence opt11 from anti-HIV-1_HeavyChain
caggcccaucucgagcaaucgggcucgggcgugaaaaagcccggggccucagucagggucucgugcuggaccucggaagacaucuuugaaaagagcgagcucauacacuggguccggcaagcgcccgggcaaggacuagaguggauaggcugggucaagaccgugaccggggccgugaacuuuggcucgagcgauuucaggcacaggaucucgcucacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagcgcgagcacgaaagggcccucggucuuucccacgaucuauguc

SEQ ID NO: 57311 - RNA, 426 nt, Artificial Sequence
  derived and/or modified sequence opt11 from anti-HIV-1_HeavyChain
caggucuauauggagcaagcgggcgggggcgugaaaaagcccggggccucggucacgcucucgugcaagaccgcggacgaggacguguucgaugccgcguacaugcacugggucaggcaagcgcccgggcaaacguucgagugguugggcuggaugaagcccgugaccggggccgugaacuaugccaggaacuuucaagggcgcgugagcuuuuacaggaccagggaauugggaauagccuauauggaucucaggaaccugcgcuuugacgacaccgcggucuauuucugugccaggaaaacgaaaggggacgugagcggggacgaucgcggguucuuuuucgaucucuggggcaggggcacgcgcgugaucgugagcucgggccugcaccagcgcgcacacaggagcucgcccacgaucuguguc

SEQ ID NO: 57312 - RNA, 426 nt, Artificial Sequence
  derived and/or modified sequence opt11 from anti-HIV-1_HeavyChain
caaucccaccucgaacaauccggaucagccaugaaaaaacccggcgccuccguccgcgucucaugcuggaccuccgaagacaucuucgacaccaccgaacuaauauacuggguccgccaagcccccggccaaggccucgaauggaucggcuggguaaaaauagucuccggcaccgucaacuucgccucccucgacuuccgcaaccgcaucucccucucccgcgaccgcgaccucuccaccgccuacauggacauccgcggacucacccaagacgacaccgccaccuacuucugcgcccgccaaaaauucgccucccgcuacuccggcgaccaaggcucauacuucgaccucuggggccgcggcacccucaucgucgucuccuccgccuccacaaaaggccccuccgucuuccccaccaucugcguc

SEQ ID NO: 57313 - RNA, 423 nt, Artificial Sequence
  derived and/or modified sequence opt11 from anti-HIV-1_HeavyChain
caggucuauauggagcaagcgggcgugggcgugaaaaagcccggggcaucggucacgcuaucgugcaagaccgcggacgaggacguguucgaugccgcguacaugcacuggguaaggcaagcgcccgggcccgaucucgagugguugggcuggaugaagcccgugaccggggccgugaacuaugcaaggaaauuucaagggcgcgugagcuuuuacagaaccagggaauugggcauagccuauauggaucucaggaacuugcgauuugacgauaccgcggucuauuucugugccaggaaaacggccggggacgugagcggggacaagcgcggguucuuuuucgaucucuggggcaggggcucgcgagugaucgugagcucggccucgaccaagggcccgagcguguucccgaccauaugcgug

SEQ ID NO: 57314 - RNA, 426 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucgucuccggcaccgucaacuucgccucccucgacuuccgcaaccgaaucucccucucccgcgaccgcgaccucuccaccgcccacauggacauccgcggccucacccaagacgacacagccaccuacuucugcgcccgccaaaaauucgccucccgcuacuccggcgaccaaggcuccuacuucgaccucuggggccgcggcacccuaauaaucgucuccuccgccuccaccaaaggccccuccgucuucccccacgaccuccgc

SEQ ID NO: 57315 - RNA, 426 nt, Artificial Sequence
  derived and/or modified sequence opt11 from anti-HIV-1_HeavyChain
caagcgcaccuggaacagagcgggagcggggucaagaaauugggcgcgagcgugcgcgugagcuguuggacgagcgaggacauauucgagcgcacggaauugauccauugggugcgccaggccccgggccagggcuuggaauggauagggugggugaaagcagucacgggcgcggucaauuucggcagcuuggacuuucgccaucgcauaagccugaccagggacagggacuuguucacggcccauauggauaucaggggacugacccagggcgauaccgcgaccuauuucugugccaggcaaaaguucgagagcagguacacgggcgggcaagggugguauuucgaucucuggggcaggggcacgcacauagucgugagcucggccucgaccaagggaccgagcguauucccgcacgaucucagg

SEQ ID NO: 57316 - RNA, 426 nt, Artificial Sequence
  derived and/or modified sequence opt11 from anti-HIV-1_HeavyChain
caagcccaccuagaacaauccggcuccggcgucaaaaaacccggcgccuccguccgcgucuccugcuggacaucagaagacaucuucgaacgcaccgaacucauccacuggguccgccaagcccccggccaaggccucgaacgcaucggcugggucaaaaccgucaccggcgccgucaacuucggaucccucgacuuccgccaccgcaucucccucacacgcgaccgcgaccucuucaccgcccacauggacauccgcggccucacccaaggcgacaccgccaccuacuucugcgcccgccaaaaauucgaaucccgcuacaccggcggccaaggcugguacuucgaccucuggggccgcggcacccacaucgucgucuccuccgccuccaccaaaggccccuccgucuuccccaccaucugcguc

SEQ ID NO: 57317 - RNA, 423 nt, Artificial Sequence
  derived and/or modified sequence opt11 from anti-HIV-1_HeavyChain
gagguguauauggagagggggaggggaggggugaagaagccgggggcgagugcgacgcugaguugcaagacggcggacgaggauguguuugaugcggcguacaugcauugggugaggcaggcgccggggcagacguuugaguggcugggguggaugaagccggugacgggggcggugagcuaugcgaggaaguuccaggggagggugagcuuuuauaugacgagggagcugggaauggcguacauggaucugaggaauuugagguuugaugauacggcgguguacuucugugcgaggaagacggcgggggaugugaguggggauaauaggggauauuucuuugaucuguggggaagggggagcagggugauagugaguagugcgaguacgaagggaccgagcguguuuccgcaugauuugagg

SEQ ID NO: 57318 - RNA, 426 nt, Artificial Sequence
  derived and/or modified sequence opt11 from anti-HIV-1_HeavyChain
caggcccaucucgagcaaucgggcucgggcgugaaaaagcccggggccucggccagggucucgugcuggagcucggaagauaucuuugaaaggaucgagcucauacacugggucaggcaagcgcccgggcaagggcucgaguggauaggcugggucaagaccguggccggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguagucucgagcgcgagcacgaaagggcccucggucuuuccccaugaccugcgc

SEQ ID NO: 57319 - RNA, 426 nt, Artificial Sequence
  derived and/or modified sequence opt11 from anti-HIV-1_HeavyChain
caaucccaccuagaacaauccggcuccgccaugaaaaaacccggcgccuccguccgagucuccugcuggacauccgaagacaucuucgacaccaccgaacucaucuacuggguccgccaagcccccggccaaggccucgaauggaucggcugggucaaaaucgucucaggcaccguaaacuucgccucccucgacuuccgcaaccgcaucucccuaucccgcgaccgcgaccucuccaccgcccacauggacauccgaggccuacgccaagacgacaccgccaccuacuucugcgcccgccaaaaauucgaaucccgcuacuccggcgaccaaggcuccuacuucgaccucuggggccgcggcacccucaucaucgucuccuccgccuccaccaaaggccccuccguauuccccaccaucuacguc

SEQ ID NO: 57320 - RNA, 426 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucguauccggcaccgucaacuucgccucccucgacuuccgcaacggcaucucacucucccgcgaccgcgaccucucaaccgccuacauggacauccgcggccucacccaagacgacaccgccaccuacuucugcgcccgccaaaaauucgccucccgcuacuccggcgaccaaggcuccuacuucgaccucuggggccgcggcacccucaucgucgucucauccgccuccaccaaaggccccuccgucuucccccacgaccuccgc

SEQ ID NO: 57321 - RNA, 426 nt, Artificial Sequence
  derived and/or modified sequence opt11 from anti-HIV-1_HeavyChain
cagagccaucucgagcaaucgggcucagccaugaaaaagcccggggccucggucagggucucaugcuggaccucggaagauaucuuugacacgaccgagcucauauacugggucaggcaagcgcccgggcaaggacucgaguggauaggcugggucaagaucgugagcgggaccgugaacuuugccucacucgauuucaggaacaggaucucgcucucgcgcgaucgcgaucucucgaccgcgcacauggacauacgcgggcucacgcaagaugacacggccacguacuuuugcgcgcgccagaaauuugccucgcgcuacagcggggaccagggcucguacuucgaccugugggggcgcgggacccugaucguggucucaagcgcgagcacgaaagggcccucggucuucccccacgacuugcgc

SEQ ID NO: 57322 - RNA, 426 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggacgagcggggacauacucaggaaaucggaauugauccauugggugagacaggccccgggccagggccuggaauggaucgggugggugaaaacggucacgggcgcggucaauuucgggagcuuggacuuucgccaucgaaucagcuugaccagggacagggacuuguucacggcccauauggauauaaggggcuugacccagggagauaccgcgacauauuucugugccaggcaaaaguucgagagcagauacacgggcgggcaagggugguauuucgaucucuggggcagaggcacgcacauagucgugagcucggccucgaccaagggcccgagcguguucccgcacgaucucagg

SEQ ID NO: 57323 - RNA, 426 nt, Artificial Sequence
  derived and/or modified sequence opt11 from anti-HIV-1_HeavyChain
caaguccaccuagaacaaagcggcagcggcgucaaaaaacccggagccuccguccgcgucuccugcuggucaucagaagacaucuucgaacgcaccgaacuaauccacuggguccgccaagcccccggccaaggccucgaauggaucggcugggucaaaaccgucaccggcgccgucaacuucggcucccucgacuuccgccaccgcaucucccucacccgagaccgagaccuauucacagcccacauggacauccgaggccuaacccaaggcgacaccgccaccuacuucugcgccagacaaaaauucgaaagccgcuacaccggcggacaaggcugguacuucgaccucuggggccgcggcacccacaucgucgucuccucagccugcaccaaaggccccuccgucuucccacacgaccuacgc

SEQ ID NO: 57324 - RNA, 426 nt, Artificial Sequence
  derived and/or modified sequence opt11 from anti-HIV-1_HeavyChain
caagcccaccucgaacaauccugguccggcgucaaaaaaccaggcgccuccguccgagucuccugcugguccuccgaagacaucuucgaacgcaccgaacuaauccacuggguccgccaagcccccggccaaggccucgaauggaucggcugggucaaaaccgucaccggagccgucaacuucggcucccucgacuuccgccaccgcaucucccucacccgcgaccgcgaccucuucaccgcccacauggacauacgcggccucacccaaggcgacaccgccaccuacuucugcgcccgacaaaaauucgaaucccgcuacaccggcggccaaggcugguacuucgaccuauggggccgcggcacccacaucgucgucucauccgccuccaccaaaggacccucagucuucccccacgaccuccgc

SEQ ID NO: 57325 - RNA, 426 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccucagaagacaucuucgaacgcaccgaacucaucuacuggguccgacaagcccccggccgcggccccgaauggaucggcuggguaaaaaccguauccggcaccgucaacuucggcuccuccgacuuccgaaaccgcaucucccucacccgcgaccgcgaccucuccaccgcccacauggacauccgcggccucacccaagacgacaccgccaccuacuucugcgcccgccaaaaauucgaaucccucuacuccgacgaccaaggcuccuacuucgaccucuggggccgcggcacccucaucaucgucuccucagccucaaccaaaggccccuccgucuucccccacgaccuccga

SEQ ID NO: 57326 - RNA, 426 nt, Artificial Sequence
  derived and/or modified sequence opt11 from anti-HIV-1_HeavyChain
caggcccaucucgagcaaucgggcucgggagugaaaaagcccggggccucggucagggucucgugcuggagcucagaagauaucuuugaaaggaccgagcucauacacugggucaggcaagcgcccgggcaagggcucgaguggauaggcugggucaagaccgugaccggggccgugaacuuuggcucgcuagauuucaggcacaggaucucgcucacgcgcgaucgcgaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacacauaucguggucucgagcgcgagcacgaaagggcccucggucuuucccacgaucuugcgc

SEQ ID NO: 57327 - RNA, 426 nt, Artificial Sequence
  derived and/or modified sequence opt11 from anti-HIV-1_HeavyChain
caaucccaccucgaacaauccggauccgccaugaaaaaacccggcgccuccguccgcgucucaugcuggaccuccgaagacauauucgaacgaaccgaacuaaucuacuggguccgccaagcccccggccgcggacucgaauggaucggcugggucaaaaccgucuccggcaccgucaacuucggcuccuccgacuuccgcaaccgcaucucccucacccgcgaccgcgaccucuccaccgcccacauggacauccgcggccucacccaagacgacacagccaccuacuucugcgcccgccaaaaauucgaaucccucuacuccgacgaccaaggcuccuacuucgaccucuggggccgcggaacccucaucgccgucuccuccgccuccaccaaaggccccuccgucuucccccacgaccuccgc

SEQ ID NO: 57328 - RNA, 426 nt, Artificial Sequence
  derived and/or modified sequence opt11 from anti-HIV-1_HeavyChain
caaucccaccucaaacaaucaggcuccgccaugaaaaaacccggcgccuccguccgcgucuccugcuggaccuccgaagacaucuucgaacgcaccgaacucaucuacuggguccgccaagcccccggccgcggccucgaauggaucggcugggucaaaaccgucuccggcaccgucaacuucggcucauccgacuuccgcaaccgaaucucccucaccagagaccgcgaccucuccaccgcccacauggacauccgcggccucacccaagacgacacagccaccuacuucugcgcucgccaaaaauucgaaucccucuacuccgacgaccaaggcuccuacuucgaccucuggggccgcggcacccucaucaucgucucauccgccuccaccaaaggccccuccgucuucccccacgaccuccgc

SEQ ID NO: 57329 - RNA, 426 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaacugauacauuggguacgccaggccccgggccagggcuuggaauggaucgagugggugaaagcggucucgggcgcgguaaauuacgggagcuuggacuuucgccaccgcgugagcuugaccagggacagggacuuguucacggcccauauggauaucaggggcuugacccaggacgauaccgcgaccuauuucugugccaggcaaaaguucgagagcagguacacgggcgggcaagggugguauuucgaucucuggggcaggggcacacacauagucgugagcucggccucgaccaagggcccgagcguguucccgcacgaucuaagg

SEQ ID NO: 57330 - RNA, 426 nt, Artificial Sequence
  derived and/or modified sequence opt11 from anti-HIV-1_HeavyChain
caaucccaccucgaacaauccggcucagccaugaaaaaacccggcgccuccguccgcgucuccugcuggaccuccgaagacaucuucgacaccaccgaacucaucuacuggguccgccaagcccccggccaaggccuagaauggaucggcugggucaaaaucgucuccggcaccgucaacuucgccucccucgacuuccgcaaccgcaucucccuaucccgcgaccgcgaccucucuaccgcccacauggacauccgcggccuaacccaagacgacaccgccaccuacuucugcgcccgacaaaaauucgaaucccgcuacuccggcgaccaaggcuccuacuucgaccuauggggccgaggcacccucauaaucgucucauccgccuccaccaaaggccccuccgucuucccccacgaccuccgc

SEQ ID NO: 57331 - RNA, 426 nt, Artificial Sequence
  derived and/or modified sequence opt11 from anti-HIV-1_HeavyChain
caagcgcaccuagaacagagcggaagcggggucaagaaaccgggcgcaagcgugcgcgugagcuguuggacgagcgaggacauauucgagaaaucggaacugauccauugggugcgccaggccccgggccagggcuuggaauggaucgggugggugaaaacagucacgggcgcggucaauuucgggagcuuggacuuccgcaaucgcaucagcuugagcagagacagggacuugagcacggccuauauggauauaaggggccugacccaggacgauaccgcgaccuauuucugugccaggcaaaaguucgcgagcagguacucgggcgaucaagggagcuauuucgaucucuggggcaggggcacgcucauaguagugagcucggccucgaccaagggcccgagcguguucccgcacgaucucagg

SEQ ID NO: 57332 - RNA, 426 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggaccuccgaagacauauucgaacgcuccgaacuaauccacuggguccgccaagcccccggccaaggccucgaauggaucggcugggucaaaaccgucaccggcgccgucaacuucggcucacccaacuuccgccaacgcgucucccucucccgcgaccgcgaccucuccaccgcccacauggacauccgcggccucacccaagacgacaccgccaccuacuucugcgcccgccaaaaauucgccucacgcuacuccggcgaccaaggcuccuacuucgaccucuggggccgcggcacccucaucaucgucuccuccgccuccaccaaaggccccuccgucuucccccacgaccuacga

SEQ ID NO: 57333 - RNA, 426 nt, Artificial Sequence
  derived and/or modified sequence opt11 from anti-HIV-1_HeavyChain
caaucccaccuagaacaaucaggcucagccaugaaaaaacccggcgccuccguccgcgucuccugcuggaccuccgaagacaucuucgaacgcaccgaacucaucuacuggguccgacaagcccccggccgcggccucgaauggaucggcugggucaaaaccgucuccggcaccguaaacuucggcuccuccgacuucagaaaccgcaucucccucacccgcgaccgcgaccuauccaccgcccacauggacauccgcggccucacccaagacgacaccgccaccuacuucugcgcccgccaaaaauucgaaucccucuacuccgacgaccaaggcuccuacuucgaccucuggggccgcggcacccuaaucauagucuccucagccuccaccaaaggccccuccgucuucccccacgaccuccgc

SEQ ID NO: 57334 - RNA, 426 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggacaucagaagacaucuucgaacgcaccgaacucauccacuggguccgccaagcccccggccgcggccucgaauggauaggcugggucaaaaccgucucaggcaccgucaacuucggcuccuccgacuuccgcaaccgcaucucccucacccgcgaccgcgaccucucaaccgcccacauggacauccgcggccucacacaagacgacaccgccaccuacuucugcgcccgccaaaaauucgaaucccucuacuccgacgaccaaggcuccuacuucgaccucuggggccgcggcacccucaucaucgucuccuccgccuccaccaaaggccccucagucuucccccacgaccuccgc

SEQ ID NO: 57335 - RNA, 426 nt, Artificial Sequence
  derived and/or modified sequence opt11 from anti-HIV-1_HeavyChain
caagugcacuuggaacagagcgggagcggggucaagaaaccaggcgcgagcgugcgcgugagcuguuggucgagcgaggacauauucgagcgcacggaacugauccauugggugcgccaggccccgggccagggcuuggaauggaucgggugggugaaaacggucacgggcgcggucaauuucgggagcuuggacuuucgccaucgcaucagcuugaccagggacagggacuuguucacggcccauauggauauaaggggcuugacccagggcgacaccgcgaccuauuucugugccaggcaaaaguucgagagcagguacacgggcgggcaagggugguauuucgaucucuggggaagaggaacgcacauagucgugagcucggccucgaccaagggcccgagcguguucccgcacgaucuaagg

SEQ ID NO: 57336 - RNA, 426 nt, Artificial Sequence
  derived and/or modified sequence opt11 from anti-HIV-1_HeavyChain
caaucccaccucgaacaauccggauccgccaugaaaaaacccggcgccuccguccgcgucuccugcuggacaucagaagacaucuucgacaccaccgaacuaaucuacuggguccgccaagcccccggccaaggccucgaauggaucggcugggucaaaaucgucuccggcacagucaacuucgccucccucgacuuccgcaaccgcaucucccucucccgcgaccgcgaccucucaaccgcccacauggacauccgcggccuccgccaagacgacaccgccaccuacuucugcgcccgccaaaaauucgaaucccgcuacuccggcgaccaaggcuccuacuucgaccucuggggccgaggcacccucaucaucgucuccagcgccuccacaaaaggccccuccgucuucccccacgaccuccgc

SEQ ID NO: 57337 - RNA, 423 nt, Artificial Sequence
  derived and/or modified sequence opt11 from anti-HIV-1_HeavyChain
caaguguacauggaacaggccggggccggggucaagaaaccgggcgcgagcgugaccuugagcuguaaaacagccgaugaagaugucuuugacgcggccuacaugcauugggugcgacaggccccgggccagaccuuugaauggcucggauggaugaaaccggucacgggcgcggucucguacgcgcgcaaguuccagggcagggucucguucuauaugacgcgcgagcuaggggucgcguacauggacuugcgcaaucucagguucgaugacacggccguguacuuuugcgcacgcaagaccgcgggagaugucucaggcgauaacaggggcuacuucuuugaccugugggggcgcgggagcagggucauagucucgagcgcaagcacgaaagggcccucggucuuuccccacgaccugcga

SEQ ID NO: 57338 - RNA, 426 nt, Artificial Sequence
  derived and/or modified sequence opt11 from anti-HIV-1_HeavyChain
caaucacacuuggaacagagcgggagcgcaaugaagaaaccgggcgcgagcgugcgagugagcugcuggacgagcgaggacauauucgacaccacggaacugaucuauugggugcgccaggccccgggccagggcuuggaauggaucgggugggugaaaauagucucgggcacggucaauuucgcgagccuggacuuucgcaaucgaauaagccugagcagggacaggaaccugagcacggcccauauggauaucaggggcuugcgccaggacgauaccgcgaccuauuucugcgccaggcaaaaguucgagagcagguacucgggcgaucaagggagcuauuucgaucucuggggcaggggcacgcucauaaucgugagcucggccucaaccaagggcccgagcguguucccgcacgaucucaga

SEQ ID NO: 57339 - RNA, 423 nt, Artificial Sequence
  derived and/or modified sequence opt11 from anti-HIV-1_HeavyChain
caagugcaauugguccagagcggggccgaggucaagaaaccgggcgcgagcgugaccuugagcuguaaaacggccgaugaagaugucuuugacgcggccuauaugcauugggugcgccaggccccgggccagaccuuugaauggcucggguggaugaaaccggucacgggcgcagucucguacgcgcgcaaguuccagggaagggucucguucuauaugacgcgcgagcuagggauggcguacauggacuugcgcaaucucagguucgaugacacggccguguacuuuugcgcgcgaaagaccgcgggcgaugucucgggcgauaacaggggcuauuucuuugaccugugggggcgcgggagcagggucauagucucgagcgcgagcacgaaagggcccucggucuuucccacgaucuauguc

SEQ ID NO: 57340 - RNA, 426 nt, Artificial Sequence
  derived and/or modified sequence opt11 from anti-HIV-1_HeavyChain
caagcccaccuagaacaauccggcuccggcgucaaaaaaccaggcgccuccguccgagucuccugcuggaccuccgaagacaucuucgaacgcaccgaacucguccacuggguccgccaagcccccggccaaggccucgaauggaucggcugggucaaaaccgucaccggcgccgucaacuucggcucacccaacuuccgccaacgcgucucccucacccgcgaccgcgaccucuucaccgcccacauggacauccgcggccucacccaagacgacaccgccaccuacuucugcgcccgccaaaaauucgccucacgcuacuccggcgaccaaggcuccuacuucgaccucuggggcagaggcacccucaucguugucuccuccgccuccaccaaaggccccuccgucuucccccacgaccuccgc

SEQ ID NO: 57341 - RNA, 426 nt, Artificial Sequence
  derived and/or modified sequence opt11 from anti-HIV-1_HeavyChain
caaucccaccucgaacaauccggcuccgccaugaaaaaaccaggcgccuccguccgcgucuccugcuggaccuccgaagacaucuucgacaccacugaacucauauacuggguccgacaagcccccggccaaggccucgaauggaucggcugggucaaaaucgucuccggcaccgucaacuucgccucacucgacuuccgcaaccgcaucucccucucccgagaccgcgaccucuccaccgccuacauggacauccgcggccucacccaagacgacacagccaccuacuucugcgcccgccaaaaauucgcaucccgcuacuccggcgaccaaggcuccuacuucgaccuauggggccgcggcacccucaucaucgucuccuccgccuccaccaaaggcccccucggccucccccacgaccuccga

SEQ ID NO: 57342 - RNA, 426 nt, Artificial Sequence
  derived and/or modified sequence opt11 from anti-HIV-1_HeavyChain
caagcccaccucgaacaauccggcuccggcgucaaaaaacucggcgccuccguccgcgucuccugcuggaccuccgaagacaucuucgaacgcaccgaacuaauccacuggguccgccaagcccccggccaaggccucgaauggaucggcugggucaaagccgucuccggcgcagucaacuacggcucccucgacuuccgccaccgagucagccucacccgagaccgagaccucuccaccgcccacauggacauccgcggccucacccaagacgacaccgcaaccuacuucugcgcccgacaaaaauucgccucccgauacucaggcgaccaaggcuccuacuucgaccuauggggccgcggcacccucaucgucgucuccuccgccuccaccaaaggcccaucagucuucccccacgaccuccgc

SEQ ID NO: 57343 - RNA, 426 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggaccuccgaagacaucuucgaacgcaccgaacucaucuacuggguccgccaagcccccggccaaggccuagaauggaucggcugggucaaaaucgucucaggcacagucaacuucgccucccuagacuuccgcaaccgcauaucccuaucccgcgaccgagaccucucaaccgcccacauggacauccgcggccucacccaagacgacaccgcaaccuacuucugcgcccgccaaaaauucgccucacgcuacuccggcgaccaaggcuccuacuucgaccucuggggccgcggcacccucaucaucgucuccuccgccuccaccaaaggccccuccgucuucccacacgaccuccgc

SEQ ID NO: 57344 - RNA, 426 nt, Artificial Sequence
  derived and/or modified sequence opt11 from anti-HIV-1_HeavyChain
caagcccaccucgaacaauccggcucaggcgucaaaaaacccggcgccuccguccgagucuccugcuggaccucagaagacaucuucgaacgcaccgaacucauccacuggguccgccaagcccccggccaaggccucgaauggaucggcugggucaaaaccgucaccggcgccgucaacuucggcucacccaacuuccgcaaccgcaucucccucacccgcgaccgagaccucuccaccgcccacauggacauccgcggccucacccaagacgacaccgccaccuacuucugcgcccgccaaaaauucgaaucccucuacucagacgaccaaggcuccuacuucgaccucuggggacgcggcacccucaucaucgucuccuccgccuccacaaaaggccccuccgucuucccccacgaccuccgc

SEQ ID NO: 57345 - RNA, 426 nt, Artificial Sequence
  derived and/or modified sequence opt11 from anti-HIV-1_HeavyChain
caagcgcacuuggaacagagcgggagcggagucaagaaaccgggcgcgagcgugcgcgugagcuguuggacgagcgaggacauauucgagaaaucggaauugauccauugggugcgccaggccccgggccagggcuuggaauggaucgggugggugaaaacggucacgggcgcagucaauuucggaagcucugacuuccgacagcgcgugagccugaccagggacagggaccuguucacggcccauauggauaucaggggccugacccagggcgauaccgcgaccuacuucugugccaggcaaaaguucgagagcuuguacucggacgaucaagggagcuauuucgaucucuggggcagaggcacgcucauaaucgugagcucggccucgaccaagggcccgagcguauucccgcacgaucucagg

SEQ ID NO: 57346 - RNA, 426 nt, Artificial Sequence
  derived and/or modified sequence opt11 from anti-HIV-1_HeavyChain
caagcgcacuuggaacagagcgggagcggggucaagaaaccgggcgcaagcgugcgcgugagcugcuggacgagcgaggacauauucgagcgcacggaauugauccauugggugcgccaggccccgggccagggcuuggaauggaucgggugggugaaaacgguaacgggcgcggucaauuucgggagcucggacuuucgcaaucgcauaagccugaccagagacagggacuugagcacggcccauauggauaucaggggcuugacccaggacgauaccgcgaccuauuucugcgccagacaaaaguucgagagccuguacucggacgaucaagggagcuauuucgaucucuggggcaggggcacacucauaaucgugagcucggccucgaccaagggcccgagcguguucccgcacgaccucagg

SEQ ID NO: 57347 - RNA, 426 nt, Artificial Sequence
  derived and/or modified sequence opt11 from anti-HIV-1_HeavyChain
caaucccaccucgaacaauccggcuccgccaugaaaaaacccggcgccucugcccgcgucuccugcuggaccuccgaagacaucuucgacaccacagaacucaucuacuggguccgccaagcccccggccaaggccucgaauggaucggcugggucaaaaucgucucuggcaccgucaacuucgccucccucgacuuccgaaaccgcaucucccucucccgcgaccgcgaccuauccaccgcccacauggacauacgcggccucacccaagacgacaccgccaccuacuucugcgcccgccaaaaauucgccucccgcuacuccggcgaccaaggcuccuacuucgaccucuggggccgcggcacccacauagucgucuccuccgccucaaccaaaggccccuccgucuucccccacgaccuccga

SEQ ID NO: 57348 - RNA, 426 nt, Artificial Sequence
  derived and/or modified sequence opt11 from anti-HIV-1_HeavyChain
caagcccaccuagaacaauccggcucaggcgucaaaaaacucggcgccuccguccgcgucuccugcuggaccuccgaagacaucuucgaacgaaccgaacucauccacuggguccgccaagcccccggccaaggccucgaauggaucggcugggucaaagccgucuccggcgccgucaacuacggcucccucgacuuccgccaccgagucucccucacccgcgaccgcgaccucuucaccgcccacauggacauccgcggccucacccaagacgacaccgccaccuacuucugcgccagacaaaaauucgaaucccgcuacaccggcggccaaggcugguacuucgaccucuggggccgcggcacccacaucgucgucuccuccgccucaaccaaaggccccuccgucuucccccacgaccugcgc

SEQ ID NO: 57349 - RNA, 426 nt, Artificial Sequence
  derived and/or modified sequence opt11 from anti-HIV-1_HeavyChain
caggcccaucucgagcaaucgggcucgggcgugaaaaagcucggggccucagucagggucucgugcuggaccucagaagauaucuuugaaaggaccgagcucauacacugggucaggcaagcgcccgggcaagggcuagaguggauaggcugggucaaggccgugagcggggccgugaacuauggcucgcucgacuucaggcacagggucucgcucacgcgcgaccgcgaucucucgaccgcgcacauggacauacgcgggcucacgcaagaugacacggccacguacuuuugcgcgcgacagaaauuugaaucgcgcuauaccgggggccagggcugguacuuugacuugugggggcgcgggacccacaucguggucucgagcgcgagcacgaaagggccaucggucuuuccccaugaccugcgc

SEQ ID NO: 57350 - RNA, 426 nt, Artificial Sequence
  derived and/or modified sequence opt11 from anti-HIV-1_HeavyChain
caaucccaccucgaacaauccggcuccgccaugaaaaaacccggcgccucaguccgcgucuccugcuggaccuccgaagacaucuucgaacgcaccgaacuaaucuacuggguccgccaagcccccggccgcggccucgaauggaucggcugggucaaaaccgucuccggcaccguaaacuucggcucauccgacuuccgcaaccgcaucucccucacccgcgaccgcgaccucuccaccgcccacauggacaucagaggccucacccaagacgacaccgccaccuacuucugcgcccgacaaaaauucgccucccgcuacuccggcgaccaaggcucauacuucgaccucuggggccgcggcacccucaucaucgucuccuccgccuccaccaaaggccccuccgucuucccacacgaccuccgc

SEQ ID NO: 57351 - RNA, 426 nt, Artificial Sequence
  derived and/or modified sequence opt11 from anti-HIV-1_HeavyChain
caaucccaccucgaacaauccggcuccgccaugaaaaaacccggcgccucaguccgcgucuccugcuggaccuccgaagacaucuucgaacgcaccgaacucaucuacuggguccgccaagcccccggccgcggccucgaauggaucggcugggucaaaaccgucuccggcaccgucaacuucggcuccucugacuuccgcaaccgcauaucccucacccgcgaccgcgaccucuccaccgcccgcauggacauccgcggccucacacaagacgacaccgccaccuacuucugcgcacgccaaaaauucgaaucccucuacuccgacgaccaaggcuccuacuucgaccucuggggccgcggcacccucaucauagucuccuccgccuccaccaaaggacccuccgucuuccccaccgaccuccga

SEQ ID NO: 57352 - RNA, 426 nt, Artificial Sequence
  derived and/or modified sequence opt11 from anti-HIV-1_HeavyChain
caagcccaccucgaacaauccggcuccggcgucaaaaaacccggcgccucaguccgcgucuccugcuggaccuccgaagacaucuucgaaaaauccgaacucauccacuggguccgccaagcccccggccaaggccucgaauggaucggcugggucaaaaccgucaccggcgccgucaacuucggcuccuccgacuucagacaacgcgucucccucacccgcgaccgagaccucuucaccgcccacauggacauccgcggccucacccaagacgacaccgccaccuacuucugcgcccgccaaaaauucgccucacgcuacuccggcgaccaaggcucauacuucgaccuauggggccgaggcacccucaucgucgucuccucagccuccaccaaaggccccuccgucuucccccacgaccuccgc

SEQ ID NO: 57353 - RNA, 426 nt, Artificial Sequence
  derived and/or modified sequence opt11 from anti-HIV-1_HeavyChain
caaucacaccucgaacaauccggcuccgccaugaaaaaacccggcgccucaguccgcgucuccugcuggaccuccgaagacaucuucgaacgcaccgaacucaucuacuggguccgccaagccccaggccgcggccucgaauggaucggcugggucaaaaccgucuccggcaccgucaacuucggcuccuccgacuuccgaaaccgaaucucacucacccgcgaccgcgaccucuccaccgcccacauggacauccgcggccucacccaagacgacaccgccaccuacuucugcgcccgccaaaaauucgaaucccucuacuccgacgaccaaggcuccuacuucgaccucuggggccgcggcacccuaaucaucgucuccuccgccuccaccaacggccccaucggccuaccccacgaccuccgc

SEQ ID NO: 57354 - RNA, 426 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccauugggugcgacaggccccgggccagggcuuggaauggaucgggugggugaaaacggucacgggcgcaguaaauuucgggagcucggacuuucgacagcgcgugagcuugaccagggacagggacuuguucacggcccauauggauaucaggggcuugacccagggcgauaccgcgaccuauuucugugccaggcaaaaguucgagagcagguacacgggcgggcaagggugguauuucgaucucuggggcaggggcacgcacauagucgugagcucggccucgaccaagggaccgagcguguucccgcacgaucucagg

SEQ ID NO: 57355 - RNA, 426 nt, Artificial Sequence
  derived and/or modified sequence opt11 from anti-HIV-1_HeavyChain
caagcgcaccuggaacagagcggaagcggagucaagaaaccaggcgcgagcguacgcguaagcugcuggacgagcgaggacauauucgagcgcacagaacuaauccacugggugcgccaggccccgggccagggccuggaauggaucggaugggugaaaacggucacgggcgcggucaacuucgggagcccgaacuuccgccaccgcguaagccugaccagagacagagaccuauucacagcccacauggacaucagaggccugacccaggacgacaccgcgaccuacuucugcgccaggcaaaaguucgcaagcagauacucgggcgaccaaggaagcuacuucgaccucuggggcaggggcacgcucauagucguaagcucagccucgaccaaaggcccgagcguauucccacacgaccucaga

SEQ ID NO: 57356 - RNA, 426 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgaacgcaccggccucaucuacuggguccgccaagcccccggccgcggccucgaauggaucggcugggucaaaaccguaucaggcaccgucaacuucggcuccuccgacuuccgcaaccgcaucucccucacccgcgaccgcgaccucucaaccgcccacauggacauccgcggccucacccaagacgacaccgccaccuacuucugcgcccgccaaaaauucgaaucacucuacuccgacgaccaaggcuccuacuucgaccucuggggccgcggcacccucaucaucgucuccuccgccuccaccaaaggccccucagucuucccccacgaccuccgc

SEQ ID NO: 57357 - RNA, 426 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggaccuccgaagacaucuucgaacgcaccgaacucauccacuggguccgccaagcccccggccaaggccucgaauggaucggcugggucaaaaccgucaccggcgccgucaacuucggcucacaaaucuuccgacaccgcaucucccuaacacgagaccgcgaccucuucaccgcccacauggacauccgcggccucacccaaggcgacaccgccaccuacuucugcgcccgacaaaaauucgaauccagauacaccggcggccaaggcugguacuucgaccucuggggccgcggcacccacauagucguauccucagccuccaccaaaggccccucagucuucccccacgaccuacgc

SEQ ID NO: 57358 - RNA, 426 nt, Artificial Sequence
  derived and/or modified sequence opt11 from anti-HIV-1_HeavyChain
cagagccaucucgagcaaucgggcucggccaugaaaaagcccggggccucagucagggucucgugcuggaccucggaagauaucuuugacacgaccgagcucauacacugggucagacaagcgcccgggcaagggcuagaguggauaggcugggucaagaccgugaccggggccgugaacuuuggcucgcucgauuucaggcacaggaucucgcucacacgcgaucgcgaucucuuuaccgcgcacauggacauacgcgggcucacgcaaggggacacggccacguacuuuugcgcgcgacagaaauucgaaucgcgcuauaccgggggccagggcugguacuuugacuugugggggcgcgggacccauaucguggucucgagcgcgagcacgaaagggcccucagucuuuccccaugacuugcgc

SEQ ID NO: 57359 - RNA, 426 nt, Artificial Sequence
  derived and/or modified sequence opt11 from anti-HIV-1_HeavyChain
caaucccaccuagaacaaucaggcuccgaagucaaaaaacccggcgccuccguccgagucuccugcuggaccuccgaagacaucuucgaacgaaccgaacucaucuacuggguccgacaagcccccggccgcggccucgaauggaucggcugggucaaaaccgucuccggcaccgucaacuucggcuccuccgacuuccgcaaccgaaucucccucacccgcgaccgcgaccucuccaccgcccacauggacauccgcggccucacccaagacgacaccgccaccuacuucugcgcccgacaaaaauucgaaucccuauacuccgacgaccaaggcuccuacuucgaccucuggggccgcggcacccucaucaucgucuccuccgcauccaccaaaggccccucagucuucccccacgaccuccgc

SEQ ID NO: 57360 - RNA, 423 nt, Artificial Sequence
  derived and/or modified sequence opt11 from anti-HIV-1_HeavyChain
caggucuauauggagcaagcgggcgggggcgugaaaaagcccggggccucagucacgcucucaugcaagacagcggacgaggacauauucgaugccgcguacaugcacuggguaaggcaagcgcccgggcaaacguucgaguggcugggcuggaugaagcccguaaccggggccgugaacuaugccaggcaauuucaagggcgcgugagcuuuuacaggaccagggaauugggcauagccuauauggaucucagggacuugaaauuugacgacaccgcggucuauuucugugccaggaaaacgaaaggggacgugagcggggacgaucgcggguucuuuuucgaucucuggggcaggggcacgcgcgugaucgugagcucggccucgaccaagggcccgagcguguucccgcacgaucucagg

SEQ ID NO: 57361 - RNA, 426 nt, Artificial Sequence
  derived and/or modified sequence opt11 from anti-HIV-1_HeavyChain
cagagccaccucgagcaaucgggcucagaagugaaaaagccaggggccucggucagggucucgugcuggaccucagaagacaucuucgacacgaccgagcuaauauacugggucaggcaagcgcccgggcaaggacucgaguggauaggcugggucaagaucgugagcgggaccgugaacuucgccucgcucgacuucagaaacaggaucucgcucucgcgcgaccgcgaccucucgaccgcacacauggacauacgcgggcucacgcaagacgacacggccacguacuucugcgcgcgccagaaauucgccucgcgcuacagcggggaccagggcucguacuucgaccuguggggacgcgggacccuaaucauagucucgagcgcaagcacgaaagggcccucggucuucccccacgaccugcgc

SEQ ID NO: 57362 - RNA, 426 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucucgggcgcggucaauuucgggagcccgaacuuucgacaucgagugagcuugagcagggacagggacuugagcacggccuauauggauaucagaggacugacccaggacgauaccgcgaccuauuucugugccaggcaaaaguucgcaagcagguacucgggcgaucaagggagcuauuucgaucucuggggcaggggcacgcucauagucgugagcucggccucgaccaagggcccgagcguguucccgcacgaucucaga

SEQ ID NO: 57363 - RNA, 426 nt, Artificial Sequence
  derived and/or modified sequence opt11 from anti-HIV-1_HeavyChain
caagcccaccucgaacaaucaggcucaggcgucaaaaaacccggcgccuccguccgcgucuccugcuggucauccgaagacaucuucgaacgcaccgaacucauccacuggguccgccaagcccccggccaaggccucgaauggaucggcuggguaaaaaccgucaccggcgccgucaacuucggcucccucgacuuccgacaccgcaucucccucacccgcgaccgcgaccucuucaccgcccacauggacauccgaggccucacccaaggcgacaccgcaacauacuucugcgcccgccaaaaauucgaaucacgcuacaccggcggccaaggcugguacuucgaccucuggggccgcggcacccacaucgucgucucaagcgccuccgccaaaggccccuccgucuucccccacgaccuccgc

SEQ ID NO: 57364 - RNA, 426 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugaaagaaccgagcucauauacugggucagacaagcgcccgggcgcgggcucgaguggauaggcugggucaagacagugagcgggaccgugaacuuuggcucgagcgauuucaggaacaggaucucgcucacacgcgaucgcgaccucucgacagcgcacauggacauacgcgggcucacgcaagaugacacggccacguacuuuugcgcgcgccagaaauuugaaucgcucuauagcgaugaccagggcucguacuuugacuugugggggcgcgggacccugaucguggucucgagcgcaagcacgaaagggcccucggucuuucccccgcgcucggcc

SEQ ID NO: 57365 - RNA, 426 nt, Artificial Sequence
  derived and/or modified sequence opt11 from anti-HIV-1_HeavyChain
caggugcacauggaacaggccgggggcggggucaagaaaccgggagcgagcgugaccuugagcuguaaaacggccgaugaagaugucuuugacgcggccuauaugcauugggugcgacaggcaccgggccagaccuuugaauggcucggguggaugaaaccggucacgggcgcggucaauuacgcgcgcaaguuccagggcagggucucguucuaucgcacgagagagcuugggaucgcguacauggacuugagaaaucucagguucgaugacacggccguguacuuuugcgcgcgaaagaccaagggcgaugucucgggcgaugacaggggauuuuucuuugacuugugggggagagggaccaggguaauagucucgagcgcgagcacgaaagggcccuugcgcucguucccgagaaggagcgcg

SEQ ID NO: 57366 - RNA, 426 nt, Artificial Sequence
  derived and/or modified sequence opt11 from anti-HIV-1_HeavyChain
caagcgcacuuggaacagagcgggagcggagucaagaaaccgggcgcgagcgugcgcgugagcuguuggucgagcgaggacauauucgagcgcacggaauugauccauugggugcgacaggcaccgggccagggccuggaauggaucgggugggugaaaacggucacgggcgcggucaauuucgggagcuuggacuuucgccaucgcauaagccugaccagggacagggaccuguucacggcccauauggauaucaggggcuugacccagggcgauaccgcgacauauuucugugccaggcaaaaguucgagagcagguacacgggcgggcaagggugguauuucgaucucuggggcaggggcacgcacauaguagugagcucggccucaaccaagggcccgagcguguucccgacaauauacgug

SEQ ID NO: 57367 - RNA, 426 nt, Artificial Sequence
  derived and/or modified sequence opt11 from anti-HIV-1_HeavyChain
gaaucccaccucgaacaauccggauccgccaugaaaaaacccggcgccuccguccgcgucuccugcuggaccuccgaagacaucuucgacaccaccgaacucaucuacuggguccgccaagcccccggccaaggccucgaauggaucggcugggucaaaaucgucuccggcaccgucaacuucgccucacucgacuuccgcaaccgcaucucacucucacgcgaccgcgaccucuccaccgcccacauggacauccgaggccucacccaagacgacaccgccaccuacuucugcgcccgccaaaaauucgccucccgcuacuccggcgaccaaggcucauacuucgaccucuggggccgcggcacccucaucaucgucuccuccgccuccaccaaaggccccuccgucuucccccacgaccuccgc

SEQ ID NO: 57368 - RNA, 429 nt, Artificial Sequence
  derived and/or modified sequence opt11 from anti-HIV-1_HeavyChain
caggcccaccuagaacaaucaggcucaggcgugaaaaagcccggggccucggucagggucucgugcuggaccucggaagauaucuuugaaaggaccgagcucauacacugggucaggcaagcgccagggcaagggcucgaguggauaggcugggucaagaucgugagcggggccgugaacuuuggcucgcccaauuucaggcaaagggucucgcucacgcgcgaccgcgaccucuuuaccgcgcacauggacauacgagggcuaacgcaagacgacacggccacguacuuuugcgcgagacagaaauucgccucgcgcuauagcggggaccagggcucauacuuugaccugugggggcgcgggaccuugaucguggucucgagcgcgagcacgaaagggcccucgggccugcccccgcgcucgugcgug

SEQ ID NO: 57369 - RNA, 423 nt, Artificial Sequence
  derived and/or modified sequence opt11 from anti-HIV-1_HeavyChain
caaguccaccucguccaauccggcgccgaagucaaaaaacccggcgccuccgucaaagucuccugcaaagccuccggcuacaccuucaccaccuccggcauccacuggcuccgccaaguccccggccaacgccccgaauggaugggcuggauccgcccaaaaaccggcgcccgcaaccaagcacgccaauuccaaccccgcaucucccucacccgcgaccgcgcccucuccaccgccuaccuagaccucaacucccucaccuccgccgacucaggcaccuacuucugcgcccgccaaaccuucaaacccgacuucuacuucgccgaccaaggcugguccuucaaccucuggggccgcggcgcccacuucaucgucuccuccgccucaaccaaaggccccuccgucuucccacacgaccuccgc

SEQ ID NO: 57370 - RNA, 429 nt, Artificial Sequence
  derived and/or modified sequence opt11 from anti-HIV-1_HeavyChain
caggcccaucucgagcaaucgggcucgggcgugaaaaagcccggggccucggucagggucucgugcuggagcucggaagauaucuuugaaaggaccgagcucauacacugggucaggcaagcgccagggcaagggcucgaguggauaggcugggucaagaccguaacaggggccgugaacuuuggcucgcucgauuucagacacaggaucucgcucacgcgcgaucgcgaucucuuuaccgcgcacauggacauacgcgggcucacgcaaggggacacggccacguacuuuugcgcgcgacagaaauuugaaucgcgcuauaccgggggccagggcugguacuuugacuugugggggcgcgggacccauaucguagucucgagcgcgagcacgcaagggcccauaggccugccaccgcgcuugugcgug

SEQ ID NO: 57371 - RNA, 426 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacucaucuacuggguccgccaagcacccggccaaggccucgaauggaucggcugggucaaaaucguauccggcaccgucaacuucgccucccuagacuuccgaaaccgcaucucccucucccgcgaccgcgaccuauccaccgcccacauggacauccgcggccucacccaagacgacaccgccaccuacuucugcgcccgccaaaaauucgccucccgcuacuccggcgaccaaggcucauacuucgaccucuggggccgcggcacccucaucaucgucuccucugcaucaaccaaaggccccaucggccuccccccccgcucaacc

SEQ ID NO: 57372 - RNA, 426 nt, Artificial Sequence
  derived and/or modified sequence opt11 from anti-HIV-1_HeavyChain
caagcccaccucgaacaauccggcuccggcguaaaaaaacccggcgccuccguccgaguauccugcuggaccuccgaagacaucuucgaaaaauccgaacucauccacuggguccgccaagcccccggccaaggccucgaauggaucggcuggguaaaaaccgucacaggcgccgucaacuucggcucccucgacuuccgccaccgcaucucccucacccgcgaccgcgaccucuucaccgcccacauggacauacgaggccucacccaaggcgacaccgccaccuacuucugcgcccgccaaaaauucgaaucccgcuacaccggcggccaaggaugguacuucgaccucuggggccgcggcacccacaucgucgucuccuccgccuccaccaaaggccccuccgucuuccccaccaucugcguc

SEQ ID NO: 57373 - RNA, 426 nt, Artificial Sequence
  derived and/or modified sequence opt11 from anti-HIV-1_HeavyChain
caagcgcacuuggaacagagcgggagcggggucaagaaauugggcgcgagcgugcgagugagcuguuggacgagcgaggacauauucgagcgaacggaacugauccauugggugcgccaggccccgggccagggcuuggaauggauagggugggugaaagcggucucgggcgcggucaauuacgggagcuuggacuuucgccaucgcgugagcuugaccagggacagggacuuguucacggcccauauggauaucaggggcuugacccagggcgauaccgcgaccuauuucugugccaggcaaaaguucgagagcagguacacgggcgggcaagggugguauuucgaucucuggggcaggggcacgcacauaguagugagcucggccuugcaccagggcccgaucgggcucccgcccaggagcacg

SEQ ID NO: 57374 - RNA, 429 nt, Artificial Sequence
  derived and/or modified sequence opt11 from anti-HIV-1_HeavyChain
caaucccaccucgaacaauccggcuccgccaugaaaaaacccggcgccucaguccgcgucuccugcuggaccuccgaagacaucuucgacaccaccgaacucaucuacuggguccgccaagcacccggacaaggccucgaauggaucggcugggucaaaaucgucucaggcaccgucaacuucgccucccuagacuuccgcaaccgagucucacucucccgcgaccgcgaccucuccaccgccuacauggacauccgcggccucacccaagacgacaccgccaccuacuucugcgcccgccaaaaauucgccucccgcuacuccggcgaccaaggcuccuacuucgaccucuggggccgcggcacccucaucgucgucuccuccgcccuccaccaaggccccaucggccccucacccaccauccucaga

SEQ ID NO: 57375 - RNA, 426 nt, Artificial Sequence
  derived and/or modified sequence opt11 from anti-HIV-1_HeavyChain
caaucccaccucgaacaauccggcuccgcaaugaaaaaacccggagccuccguccgcgucuccugcuggaccuccgaagacaucuucgacaccaccgaacucaucuacuggguccgccaagcccccggccaaggccucgaauggaucggcugggucaaaaucgucuccggcaccgucaacuucgcaucccucgacuuccgcaaccgcaucucccucucccgcgaccgcgaccucuccaccgcccacauggacauacgcggccucacccaagacgacaccgccaccuacuucugcgcccgccaaaaauucgccucccgcuacuccggcgaccaaggcuccuacuucgaccucuggggacgcggcacacucaucaucgucuccuccgccucaaccaaaggccccuccgucuuccccaccaucuacguc

SEQ ID NO: 57376 - RNA, 426 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacaagcgaggacauauucgauaccacggaauugaucuauugggugcgccaggccccaggccagggauuggaauggaucgggugggugaaaauagucucgggaacggucaauuucgcgagcuuggacuuucgcaaucgcaucagcuugagcagggacagggacuugagcacggccuauauggauauaaggggcuugacccaggacgauaccgcgaccuauuucugugccaggcaaaaguucgagagcagguacacgggcgggcaagggugguauuucgaucucuggggcaggggcacgcacauagucgugagcucggccucgaccaagggcccgagcguguucccgacaauaugcgug

SEQ ID NO: 57377 - RNA, 426 nt, Artificial Sequence
  derived and/or modified sequence opt11 from anti-HIV-1_HeavyChain
caaguccaacuaguccaauccggcgccgaagucaaaaaacccggcgccucaguccgcgucuccugcuggaccuccgaagacaucuucgacaccaccgaacucauauacuggguccgccaagcccccggccaaggccucgaauggaucggcugggucaaaaucgucuccggcaccgucaacuucgccucacucgacuuccgcaaccgcaucucccucucccgcgaccgcgaccucuccaccgcccacauggacauccgaggccucacccaagacgacaccgccaccuacuucugcgcccgccaaaaauucgaaucccgcuacaccggcggccaaggcugguacuucgaccucuggggccgcggcacccacaucgucgucuccucagccuccaccaaaggccccuccgucuuccccaccaucugcguc

SEQ ID NO: 57378 - RNA, 426 nt, Artificial Sequence
  derived and/or modified sequence opt11 from anti-HIV-1_HeavyChain
aggcgccaucucgagcaaucgggcucgggcgugaaaaagcccggggccucggucagggucucaugcuggagcucggaagauaucuuugaaaggaccgagcucauacacuggguaaggcaagcgcccgggcaagggcucgaguggauaggcuggguaaagaccgugaccggggccgugaacuuuggcucgcucgauuucaggcacaggaucucgcucacgcgcgaucgcgaucucuuuaccgcgcacauggacauacgcgggcucacgcaaggagacacggccacguacuuuugcgcgcgccagaaauuugaaucgcgcuauaccgggggacagggcugguacuuugaccugugggggcgcgggacucauaucguggucucgagcgcgagcacgaaagggcccucggucuuuccccaugacuugcgc

SEQ ID NO: 57379 - RNA, 426 nt, Artificial Sequence
  derived and/or modified sequence opt11 from anti-HIV-1_HeavyChain
caaucccaccucgaacaauccggcucagccaugaaaaaacccggcgccuccguccgcgucuccugcuggaccuccgaagacaucuucgacacaaccgaacucaucuacuggguccgccaagcccccggccaaggccucgaauggaucggcugggucaaaaucgucuccggcaccguaaacuucgccucccuagacuuccgcaaccgcaucucccucucccgagaccgcgaccucuccaccgccuacauggacauccgcggccucacacaagacgacaccgccaccuacuucugcgcccgccaaaaauucgaaucccgcuacuccggcgaccaaggcuccuacuucgaccucuggggccgcggcacccucaucaucgucuccagcgccuccaccaaaggccccuccgucuuccccaccaucugcguc

SEQ ID NO: 57380 - RNA, 429 nt, Artificial Sequence
  derived and/or modified sequence opt11 from anti-HIV-1_HeavyChain
caagcccaccucgaacaauccggcuccggcgucaaaaaacccggcgccucaguccgcgucuccugcuggaccuccgaagacaucuucgaacgcaccgaacucauacacuggguccgccaagcccccggccaaggccucgaauggaucggcugggucaaaaccgucaccggcgccgucaacuucggcucccucgacuuccgccaccgcaucucccucacccgcgaccgcgaccucuucaccgcacacauggacauccgcggccucacccaaggcgacacagccaccuacuucugcgcccgccaaaaauucgaaucccgcuacaccggcggccaaggcugguacuucgaccucuggggccgcggcacccacaucgucgucuccuccgccagcaccaaaggcccccaccccgucuucccccacgaccuacca

SEQ ID NO: 57381 - RNA, 426 nt, Artificial Sequence
  derived and/or modified sequence opt11 from anti-HIV-1_HeavyChain
caagcacaccucgaacaauccggcuccggcgucaaaaaacucggcgccuccguccgcgucuccugcuggaccuccgaagacaucuucgaacgcaccgaacucaucuacuggguccgccaagcccccggccaaggccucgaauggaucggcugggucaaaaucgucuccggcaccgucaacuucgccucccucgacuuccgcaaccgcaucucccucucccgcgaccgcgaccucuccacagccuacauggacauccgcggccucacccaagacgacaccgccaccuacuucugcgcccgccaaaaauucgccucacgcuacucaggcgaccaaggcuccuacuucgaccucuggggccgcggcacccuaaucgucgucuccuccgccuccaccaaaggccccuccgucuuccccaccaucuacguc

SEQ ID NO: 57382 - RNA, 429 nt, Artificial Sequence
  derived and/or modified sequence opt11 from anti-HIV-1_HeavyChain
caagcccaccucgaacaauccggcuccggcgucaaaaaacccggcgccuccguacgcgucuccugcuggaccuccgaagacaucuucgaacgcaccgaacuaauccacugggcccgccaagcacccggccaaggccucgaauggaucggcugggucaaaaccgucaccggcgccgucaacuucggcucccucgacuuccgccaccgcaucucacuaacccgcgaccgagaccucuucaccgcccacauggacauccgcggccuaacacaaggcgacaccgccaccuacuucugcgcccgccaaaaauucgaaucccgauacaccggcggccaaggcugguacuucgaccucuggggccgcggcacccacaucgucgucuccuccgccuccaccaaaggaccccucggccuccccccccgccucucacgc

SEQ ID NO: 57383 - RNA, 426 nt, Artificial Sequence
  derived and/or modified sequence opt11 from anti-HIV-1_HeavyChain
cagagccaucucgagcaaucgggcucggccaugaaaaagcccggggccucagucagggucucgugcuggaccucggaagauaucuuugacacgacagaacucauauacugggucaggcaagcacccgggcaagggcucgaguggauaggcugggucaagaucgugagcgggaccgugaacuuugccucgcucgauuucaggaacaggaucucgcucucgcgcgaucgcgaucucucgaccgcgcacauggacauacgagggcucacgcaagaugacacggccacguacuuuugcgcgcgccagaaauuugccucgcgcuacagcggggaccagggcucauacuuugaccuguggggacgcgggaccuugaucauagucucgagcgcgagcacgaaagggcccucgggcuugcccccgcgcucggcc

SEQ ID NO: 57384 - RNA, 426 nt, Artificial Sequence
  derived and/or modified sequence opt11 from anti-HIV-1_HeavyChain
cagguccagcucgugcaaucgggcgcggaagugaaaaagcccggggccucggucagggucucgugcuggaccucggaagauauauuugacacgaccgagcucauauacugggucaggcaagcacccgggcaagggcucgaguggauaggcugggucaagaucgugagcgggaccgugaacuuugccucgcucgauuucaggaacaggaucucgcucucgcgcgaucgcgaucucucgaccgcgcacauggacauacgcgggcucaggcaagaugacacggccacguacuuuugcgcgcgccagaaauuugaaucgcgcuauaguggggaccagggcucguacuuugacuuaugggggcgagggaccuugaucauagucucgagcgcgagcacgaaagggcccucggucuuuccccaugaccugcgc

SEQ ID NO: 57385 - RNA, 426 nt, Artificial Sequence
  derived and/or modified sequence opt11 from anti-HIV-1_HeavyChain
gaggcccaucucgagcaaucgggcucgggcgugaaaaagcccggggccucggucagggucucaugcuggaccucggaagauaucuuugaaagaaccgagcucauacacugggucaggcaagcgccagggcaagggcucgaguggauaggcugggucaagaucgugagcgggaccgugaacuuugccucgcucgauuucaggaacaggaucucgcucucacgcgaucgcgaucucucaaccgcguacauggacauacgcgggcucacgcaagacgacacggccacguacuuuugcgcgcgccagaaauuugccucgcgauauagcggagaccagggcucguacuuugacuugugggggcgcgggacccugaucguggucucgagcgcgagcacgaaagggcccucggucuuuccccaugaccugcgc

SEQ ID NO: 57386 - RNA, 423 nt, Artificial Sequence
  derived and/or modified sequence opt11 from anti-HIV-1_HeavyChain
caaguccaacucguccaauccggcgccgaagucaaaaaacccggcgccucagucaaagucuccugccgcgccuccggcuacaccuucggcaaccacgccaucuccuggguccgccaagcccccggccaaggccucgaauggaugggcuggauccgccccaaaaccggcgcccgaaaccaagcccgccaauuccaaccccgcaucucacucacccgcgaccgcgcccucucaaccgccuaccucgaccucaacucccucaccucagccgacuccggcaccuacuucugcgcccgccaaacauucaaacccgacuucuacuucgccgaccaaggcuggucauucaaccucuggggccgcggcgcccacuucaucgucuccucagccuccaccaaaggccccuccgucuucccccacgaccuccgc

SEQ ID NO: 57387 - RNA, 429 nt, Artificial Sequence
  derived and/or modified sequence opt11 from anti-HIV-1_HeavyChain
cagggacacaaccuagagcagagcggaagcgaagugaaaaagccgggggcaagcguaagaguaagcugcuggacaagcgaagacauauucgaaaggacagagcugauacacuggguaaggcaggcgccagggcaggggcuagaguggauaggauggguaaagacagugacaggggcagugaacuucggaagucuagacuucagacacaggauaagucugacgagagacagagaccuauucacggcgcacauggacauaagagggcuaacgcagggggacacggcgacguacuucugcgcgaggcagaaauucgaaagcagauacacaggaggacagggaugguacuucgaccugugggggagagggacacacauaguaguaagcagcgcgagcacgaaagggccaagcguauucccacacgaccugaga

SEQ ID NO: 57388 - RNA, 426 nt, Artificial Sequence
  derived and/or modified sequence opt11 from anti-HIV-1_HeavyChain
cccacgaccuggaacaagagcgggagcgauguaaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccaucgcgugagccugaccagggacagggaccugagcacggcccauauggauaucaggggauugacccaggacgauaccgcgaccuauuucugugccagacaaaaguucgagagcuuguacucggacgaucaagggagcuauuucgaucucuggggcaggggcacgcucauaaucgugagcucggccucgaccaagggcccgagcguguucccacacgaucucagg

SEQ ID NO: 57389 - RNA, 432 nt, Artificial Sequence
  derived and/or modified sequence opt11 from anti-HIV-1_HeavyChain
caugucacgcccuggaacgaguacgugggcagggccaugaaaaagcccgggcgcucggucaggguaucaugcuggaccucggaagauaucuuugacacgaccgagcucauauacugggucaggcaagcacccgggcaagggcucgaguggauaggcugggucaagaucgugagcgggaccgugaacuuugccucgcucgauuucaggaacaggaucucgcuaucgcgcgaucgcgaucucucgaccgcguacauggacauacgcgggcucacgcaagaugacacggccacguacuuuugcgcgcgccagaaauuugccucgcgcuauagcggggaccagggcucguacuuugaccugugggggcgcgggacacugaucguagucucgagcgcgagcacgaaaggacccucggucuuuccccaugacuugcgc

SEQ ID NO: 57390 - RNA, 372 nt, Artificial Sequence
  derived and/or modified sequence opt11 from anti-HIV-1_HeavyChain
caagugcaauugguccagagcggggccgagguaaggcgcccgggcgcgagcgugaaaguaagcuguaaagcgagcggguucucguucuugggccauuacauacacugggucaggcaagcgcccgggcaagggcucgaguggauaggcugggucaaggccgugagcggggccgugaacuauggcucgcucgauuucaggcacagggucucgcucacgcgcgaucgcgaucucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 57391 - RNA, 372 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcggguacacguucacgagcuauggcauaagcugggucaggcaagcgcccgggcaagggcucgaguggauaggcugggucaagaucgugagcggggccgugaacuuuggcucgcccaauuucaggcaaagggucucgcucacgcgcgaucgcgaucucuuuaccgcgcacauggacauacgagggcucacgcaaggggacacggccacguacuuuugcgcgcgacagaaauuugaaagaggcgggcaaggguggauauucgaucucuggggcaggggcacgcucauagccgugagcucg

SEQ ID NO: 57392 - RNA, 372 nt, Artificial Sequence
  derived and/or modified sequence opt11 from anti-HIV-1_HeavyChain
caagugcaauugguccagagcgaggccgaggucaagaaaccgggcgcgagcgugaaaauaagcugugccacgagcggguacgcguucacgcucuauuacuugcacuggguaaggcaagcgcccgggcaagggcucgaguggauaggcugggucaagaccgugaccggggccgugaacuuuggcucggccuauuucaggcacagggucucgcucacgcgcgaucgcgaucucuuuaccgcgcacauggacauacgcgggcucacgcaaggggacacggccacguacuuuugcgcgcgccagaaauuuuacaagggcgggcaagggugguauuucgaucucuggggcaggggcacgcuaauaguagugagcucg

SEQ ID NO: 57393 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggacgagcgaggacauauucaagaccgagcucauacacugggucaggcaagcgcccgggcaagggcucgaguggauaggcugggucaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgccagaaauuugaaaggggcgggcaagggugguauuucgaucuauggggcaggggcacgcucauagucgugagcucg

SEQ ID NO: 57394 - RNA, 375 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaauugauccauugggugcgccaggccccgggcaggggcuuggaauggaucgggugggugaaagcggucucgggcgcggucaauuacgggagcuuggacuuucgccaucgcgugcccuugacaagggacagggacuuguucacggcccauauggauaucaggggcuugacccaggacgauaccgcgaccuauuucugugccaggcaaaaguucgcgcgcggggaccagggcugguucuuugacuugugggggcgcgggaccuugauaguggucucgagc

SEQ ID NO: 57395 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgccggaggacauauucgagaggacggaguugauacauugggugaggcaggcgccggggcagggguuggaguggauagggugggugaagauagugaguggggcggugaauuucgggagcccgaacuuuaggcagagggugagcuugacgagggacagggacuuauucacggcgcauauggauauaaggggguugacgcagggggauacggcgacguauuucugugcgaggcagaaguucgagaggggggggcagggguggauauuugacuugugggggagggggacgcugauagcggugaguagc

SEQ ID NO: 57396 - RNA, 375 nt, Artificial Sequence
  derived and/or modified sequence opt11 from anti-HIV-1_HeavyChain
caggcgcaccuggagcagagcgcgagcgggguaaagaggccgggggcgagcgugagggugagcuguuggacgagcgaggacauauucgaggggagugaguugauacauugggugaggcaggcgccggggcagggguuggaguggauagggugggugaagacggugacgggggcggugaauuucgggagcgcguacuuuaggcauagagugagcuugacgagggacagggaccuguucacggcgcauauggauauaaggggguugacgcagggggauacggcgacguauuucugugcgaggcagaaguucuauaagggggggcaggggugguacuuugacuugugggggagggggacguugauaguggugaguagc

SEQ ID NO: 57397 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacuggguccggcaagcgcccgggcaagggcuagaguggauaggaugggucaagaccguaagcggggccgugaacuuuggcucgcccaauuucaggcacagagucucgcucacgcgcgaucgcgaucuauuuaccgcgcacauggacauacgcgggcucacgcaaggggacacggccacguacuuuugcgcgcgccagaaauuuuacgcgggcgggcaagggugguauuucgaucucuggggccggggaacgcucauagucgugagcucg

SEQ ID NO: 57398 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggaguagcgaggacauauucgagagggcggaguugauacauugggugaggcaggcgccggggcagggguuggaguggauagggugggugaagacggugacgggggcggugaauuucgggagcccgaacuuuaggcagagggugagcuugacgagggacagggacuuguucacggcgcauauggauauaagggggcugacgcagggggauacggcgacguauuucugugcgaggcagaaguucgagaggggggggcagggguggauauuugacuugugggggagggggacguugauagcggugaguagc

SEQ ID NO: 57399 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaacugauccauugggugcgccaggccccgggccagggcuuggaauggaucgggugggugaaaacggucacgggcgcggucaauuucgggagcuuggacuuucgccaucgcaucagcuugaccagggacagggacuuguucacggcccauauggauauaagaggcuugacccagggcgauaccgcgaccuauuucugugccaggcaaaaguucgagcgcgggggccagggcugguacuuugacuugugggggcgcgggacccugaucguggucucaagc

SEQ ID NO: 57400 - RNA, 375 nt, Artificial Sequence
  derived and/or modified sequence opt11 from anti-HIV-1_HeavyChain
caagugcaccuggaacagagcggaagcggagucaaaaaacugggcgcgagcguacgcgugagcugcuggacaagcgaggacauauucgagcgcacggaacugauccacuggguacgccaggccccaggccagggccuagaauggaucgggugggugaaagcagucucgggcgcggucaauuacggaagccuggacuuccgccaccgcgugagccugaccagggacagggaccugagcacggcccacauggacaucagaggccugacccaggacgacaccgcgaccuacuucugcgccagacaaaaauucgcacgcggggaccagggcugguucuucgaccuauggggacgcgggacccugaucguagucucgagc

SEQ ID NO: 57401 - RNA, 375 nt, Artificial Sequence
  derived and/or modified sequence opt11 from anti-HIV-1_HeavyChain
caggccuaucuagagcaaucgggcucgaucaugaaaaagcccggggccucggucagggucucgugcuggaccucggaagauaucuuugacaggaccgagcucauauacugggucaggcaagcgcccgggcaagggcucgaguggauaggcugggucaagaucgugagcggggcagugaacuuuggcucgcucgauuucaggaacagggucucgcucacgcgcgaucgcgaucucuuuaccgcgcacauggacauacgcgggcucacgcaaggggacacggccacguacuuuugcgcgcgccagaaauuugaaaggggcgggcaagggugguauuucgaucucuggggcaggggcacgcucauagucgugagcucg

SEQ ID NO: 57402 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauaaauugggugcgccaggccccgggccagggcuuggaauggaucgggugggugaaagcggucucgggcgcggucaauuacgggagcuuggacuuucgccaucgcgugagcuugaccagggacagggacuugagcacggcccauauggauaucaggggcuugacccaggacgauaccgcgaccuauuucugugccaggcaaaaguucgcgcgcggggaccagggcugguucuuugacuugugggggcgcgggaccuugaucguggucucgagc

SEQ ID NO: 57403 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggagcagcgaggacauauucgagaggacggaguugauacauugggugaggcaggcgccggggcagggguuggaguggauagggugggugaagacggugacgggggcggugaauuucgggagcuuggacuuuaggcauaggauaagccugacgagggauagggacuuguucacggcgcauauggauauaaggggguugacgcagggggauacggcgacguauuucugugcgaggcagaaguucgagaggggggggcaggggugguacuuugacuugugggggagggggacguugauaguggugaguagc

SEQ ID NO: 57404 - RNA, 375 nt, Artificial Sequence
  derived and/or modified sequence opt11 from anti-HIV-1_HeavyChain
caggcacaucucgagcaaucgggcucgggcgugaaaaagcccgggaccucggucagggucucgugcuggaccucggaagauaucuuugaaaggaccgagcuaauacacugggucaggcaagcgcccgggcaagggcucgaguggauaggcugggucaagaucgugagcggggccgugaacuuuggcucgccaaauuucaggcaaagggucucgcucacgcgcgaucgcgaucucuuuaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucg

SEQ ID NO: 57405 - RNA, 375 nt, Artificial Sequence
  derived and/or modified sequence opt11 from anti-HIV-1_HeavyChain
caagcgcacuuggaacagagcgggagcggggucaagaaacugggcgcgagcgugagagugagcuguuggacgagcggggacauauucgagcgcacggaauugauccauugggugcgccaggccccgggccagggcuuggaauggaucgggugggugaaagcggucucgggcgcggucaauuacggcagcuuggacuuucgccaucgcgugagcuugaccagggacagggacuuguucacggcccauauggauaucaggggauugacccaggacgauaccgcgaccuauuucugugccaggcaaaaguucgcgcgcggggaccagggcugguucuuugacuugugggggcgcgggaccuuaaucguggucucgagc

SEQ ID NO: 57406 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugagagugagcuguuggacgagcgaggacauauucgagcgcacggaauugauccauugggugcgacaggccccgggccagggcuuggaauggaucgggugggugaaaauagucucgggcgcggucaauuucgggagcccgaacuuucgccagcgcgugagcuugaccagggacagggacuuguucacggcccauaccgauaucaggggcuugacccagggcgauaccgcgaccuauuucugugccaggcaaaaguucgagcgagggggccagggcugguacuuugacuugugggggcgcgggaccuugaucgugguaucgagc

SEQ ID NO: 57407 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcugucucgcgagcgaggacauauucgagcgcacggaauugauccauugggugcgccaggccccgggccagggcuuggaauggaucgggugggugaaaacggucacgggcgcggucaauuucgggagcccgaacuuucgccaucgcgugagcuugaccagggacagggacuuguucacggcccauauggauaucaggggcuugacccagggcgauaccgcgaccuauuucugugccaggcaaaaguucgagcgcgggggccagggcugguacuuugacuugugggggcgcgggaccuugaucguggucucgagc

SEQ ID NO: 57408 - RNA, 375 nt, Artificial Sequence
  derived and/or modified sequence opt11 from anti-HIV-1_HeavyChain
caggcccaucucgagcaaucgggcgcgggcgugaaaaggcccggggccucggucagggucucgugcuggaccucggaagauaucuuugaaacgaccgagcucauacacugggucaggcaagcgcccgggcaagggcucgaguggauaggcugggucaagaccgugagcggggccgugaacuuuggcucgcucaauuucaggcacagggucucgcucacgcgcgaucgagaucucuuuaccgcgcacauggacauacgcgggcuaacgcaaggggacacggccacguacuuuugcgcgcgccagaaauuugccaggggcgaucaagggugguuuuucgaucucuggggcaggggcacgcuaauagucgugagcucg

SEQ ID NO: 57409 - RNA, 375 nt, Artificial Sequence
  derived and/or modified sequence opt11 from anti-HIV-1_HeavyChain
aggcacacguggaauaaaucgggcucgggagugaaaaagcccggggccucgguaagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgagaucgcgaucucuuuaccgcgcacauggacauaagagggcucacgcaaggggacacggccacguacuuuugcgcgcgccagaaauuuuacgcgggcgggcaagggugguauuucgaucucuggggcaggggcacgcucauagucgugagcucg

SEQ ID NO: 57410 - RNA, 375 nt, Artificial Sequence
  derived and/or modified sequence opt11 from anti-HIV-1_HeavyChain
gggacgccggggagcgagagugggagcggggugaagaagccgggggcgagcgugagggugagcuguuggacgagcgaggacauauucgagaggacggaguugauacauugggugaggcaggcgccggggcagggguuggaguggauagggugggugaagauagugaguggggcggugaauuucgggagcccgaacuuuaggcagagggugagcuugacgagggacagggacuuguucacggcgcauauggauauaagggggcugacacagggggauacggcgacguauuucugugcgaggcagaaguucgagaggggggggcagggguggauauuugacuugugggggagggggacguugauagcggugaguagc

SEQ ID NO: 57411 - RNA, 378 nt, Artificial Sequence
  derived and/or modified sequence opt11 from anti-HIV-1_HeavyChain
caagugcaauugguccagagcgggaccgagguccagaaaccgggcgcgagcgugaaagugagcuguaaagcauucggguacucauucacggacuauuacguguacugggucaggcaagcgcccgggcaagggcucgaguacguggccuggaucaaucccucgaacggguacacgaaauaugcccagaaauuucaagauugggugaccuugaccagggacucgagcauaaacacggccuaucuccagcucgcgcgcgugaccucggacgauaccgcgaucuauuacugugccaggcaaaaguucgcgagcagguacucgggcgaucaagggagcuauuucgaucucuggggcaggggcacgcucauagucgugagcucg

SEQ ID NO: 57412 - RNA, 378 nt, Artificial Sequence
  derived and/or modified sequence opt11 from anti-HIV-1_HeavyChain
cagguccagcucgugcaaucgggcgcggccgugaaaaagcccgggagcucggucaaggucucgugcaaggccucgggcuauaucuuuaccggguacuauauccauuggauacgccaggccccgggccagggcuuggaauggaugggguggauaaacccgagcacgggcgauaccaaguucgcgcgccaguuccagggcaggguaucguucuaucgcacgcgcgagcucgggaucgcguacauggacuugcgcgaucuaaaguucgaugacacggccguguacuuuugcgcgcgcaagaccaagggcgaugucucgggcgaugacaggggcuuuuucuuugacuugugggggcgcgggaccagggucauagucucgagc

SEQ ID NO: 57413 - RNA, 381 nt, Artificial Sequence
  derived and/or modified sequence opt11 from anti-HIV-1_HeavyChain
caggucuauauggagcaagcgggcgcgggcaugaaaaagcccggggccucgaugacggucucgugcaagacagcggacgaggacauauucgaugccgcguacaugcacugggucaggcaagcgccagggcaaacguucgaguggcugggauggaugaagcccgugaccggggcagugaacuaugccaggcaauuucaagggcgcgugagcuuuuacaggaccagggaauugggcauagccuauauggaucuaagggacuugaaauuugacgauaccgcggucuauuucugugccaggaaaacgaaaggggacgugagcggggacgaucgaggguucuuuuucgaucuauggggcaggggcacgcgagugaucgugagcucg

SEQ ID NO: 57414 - RNA, 381 nt, Artificial Sequence
  derived and/or modified sequence opt11 from anti-HIV-1_HeavyChain
cagguguuuauggagcaggcggggggggggaugaagaagccgggggcgaguaugacggugaguugcaagacggcggaugaggauguguuugaugcggcguauaugcauugggugaggcaggcgccggggcagacguuugagugguugggguggaugaagccggugacgggggcggugaauuaugcgaggaaguuucaggggagggugaguuuuuauaggacgagggaguuggggauagcauauauggauuugagggauuugaaguuugaugauacggcgguguauuuuugugcgaggaagacgaagggggaugugaguggggaugauaggggguuuuuuuuugauuugugggggagggggacgagggugauagugaguagu

SEQ ID NO: 57415 - RNA, 381 nt, Artificial Sequence
  derived and/or modified sequence opt11 from anti-HIV-1_HeavyChain
cagguguuuauggagcaggcggggggggggaugaagaagccgggggcgagcaugacggugagcuguaagacggcggaugaggauguguuugaugcggcguauaugcauugggugaggcaggcgccgggacagacguuugagugguugggguggaugaagccggugacgggggcggugaauuaugcgaggcaguuucaggggagggugaguuuuuauaggacgagggaguuggggauagcguauauggauuugagggauuugaaguuugaugauacggcgguguauuuuugugcgaggaagacgaagggggaugugaguggggaugauaggggguuuuuuuuugauuugugggggagggggacgagggugauagugaguagu

SEQ ID NO: 57416 - RNA, 381 nt, Artificial Sequence
  derived and/or modified sequence opt11 from anti-HIV-1_HeavyChain
cagguccauauggagcaagcgggagggggcgugaaaaagcccggggccucggucacgcucucgugcaagaccgcggacgaggacguguucgaugccgcguacaugcacugggucaggcaagcgcccgggcaaacguucgagugguugggcuggaugaagcccgugaccggggccgugagcuaugcaaggaaauuucaagggcgcgugagcuuuuacaugaccagggaacugggcauggccuauauggaucucaggaacuugcgcuuugacgauaccgcggucuauuucugugccaggaaaacggccggggacgugagcggggacaaucgcggguacuuuuucgaucucuggggcagaggcucgcgcgugaucgugagcucg

SEQ ID NO: 57417 - RNA, 381 nt, Artificial Sequence
  derived and/or modified sequence opt11 from anti-HIV-1_HeavyChain
cagguguauauggagcaggcgggggggggaaugaagaagccgggggcgaguaugacggugaguuguaagacggcggaugaggauauauuugaugcggcguauaugcauugggugaggcaggcgccggggcagacguuugaguggcugggguggaugaagccggugacgggggcggugaauuaugcgaggcaguuucaggggagggugaguuuuuauaggacgagggaguuggggauggcguauauggauuugaggaauuugagguucgaugauacggcgguguauuuuugugcgaggaagacggcgggggaugugagcggggauaauaggggguauuuuuuugauuugugggggagggggaguagagugauagugaguagu

SEQ ID NO: 57418 - RNA, 381 nt, Artificial Sequence
  derived and/or modified sequence opt11 from anti-HIV-1_HeavyChain
caggucuauauggagcaagcgggcgggggcgugaaaaagcccggggccucggucacgcucucgugcaagaccgcggacgaggacguguucgaugccgcguacaugcacuggguaaggcaagcgcccgggcaaacguucgagugguugggcuggaugaagcccgugaccggggccgugagcuaugccaggaaauuucaagggcgcgugagcuuuuacaugaccagggaauugggcauggccuauauggaucucaggaacuugcgcuuugacgauaccgcgguauauuucugugccaggaaaacggccggggacgugagcggggacaaucgcggguacuuuuucgaucuauggggcaggggaucgugggugaucgugagcucg

SEQ ID NO: 57419 - RNA, 381 nt, Artificial Sequence
  derived and/or modified sequence opt11 from anti-HIV-1_HeavyChain
caggugcaguuggugcagagcggggcggaggugaagaagccgggggcgagcgugacguugaguuguaagacggcggaugaggauguguuugaugcggcguauaugcauugggugaggcaggcgccggggcagacguuugagugguugggguggaugaagccggugacgggggcggugaauuaugcgagaaaguuucaggggagggugaguuuuuauaggacgagggaguuggggauagcguauauggauuugaggaaucugagguuugaugauacggcgguguauuuuugugcgagaaagacggcgggggaugugaguggggauaagaggggauuuuuuuuugauuugugggggagggggaguagggugauagugaguagc

SEQ ID NO: 57420 - RNA, 384 nt, Artificial Sequence
  derived and/or modified sequence opt11 from anti-HIV-1_HeavyChain
cagagccaucucgagcaaucgggcucggccaugaaaaagcccggggccucggucagggucucgugcuggaccucggaagauaucuuugacacgaccgagcucauauacugggucaggcaagcgcccgggcaagggcucgaguggauaggaugggucaagaucgugagcgggaccgugaacuuugccucgcucgauuucaggaacaggaucucgcucucacgcgaucgcgggcucucgaccgcguacauggacauacgcgggcucacgcaagaugacacggccacguacuuuugcgcgcgccagaaauuugccucgcgcuauagcggggaccagggcucguacuuugacuugugggggcgcgggacccugaucguggucucgagc

SEQ ID NO: 57421 - RNA, 384 nt, Artificial Sequence
  derived and/or modified sequence opt11 from anti-HIV-1_HeavyChain
caggcgcacuuggaacagagcgcgagcgggguaaggaggccgggggcgagugugagagugagcuguuggacgagcgaggacauauucgagaggucggaauugauauauugggugagacaggcgccggggagggggcuggaauggauaggguggauaaaauuggugucgggggcgguaaauuucgggagcguggacuuuagggauagggugagcuugacgagggacagggacuuguucacggcacauauggauauaaggggauugacacagggggauacggcgacauauuucugugcaaggcagaaguucgagagcagguacacgggagggcaggggugguauuucgaucugugggggagggggacgcacauaguagugagcucg

SEQ ID NO: 57422 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggccuagaauggaucgggugggugaaaacggucacgggcgcggucaauuacgggagcuugaacuuucgcucgcgcauaagccugaccagggacagggacuuguucacggcccauauggauaucaggggcuugacccagggcgauaccgcgaccuauuucugugccaggcaaaaguucgagagcagguacacgggcgggcaagggugguauuucgaucucuggggcaggggcacgcacauagucgugagcucg

SEQ ID NO: 57423 - RNA, 384 nt, Artificial Sequence
  derived and/or modified sequence opt11 from anti-HIV-1_HeavyChain
caagcgcaccuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucucgggcgcggucaauuucgggagcccgaacuuucgccaucgcgugagcuugaccagggacagggacuuguucacggcccauauggauaucaggggcuugacccagggcgauaccgcgaccuauuucugugccagacaaaaguucgagagcagguacacgggcgggcaagggugguauuucgaucucuggggcaggggcacgcacauagucgugagcucg

SEQ ID NO: 57424 - RNA, 384 nt, Artificial Sequence
  derived and/or modified sequence opt11 from anti-HIV-1_HeavyChain
cagguccaucucgagcaaucgggcucgggcgugaaaaagcccggggccucagucagagucucgugcuggagcucggaagauaucuuugaaaggaccgagcucauacacugggucaggcaagcgcccgggcaagggcucgaguggauaggcugggucaagacagugaccggggccgugaacuuuggcucgcucgauuucaggcacaggaucucgcucacgcgcgaucgcgauuuauuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 57425 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaagacaucuucgacaccaccgaacuaaucuacuggguccgccaagcccccggccaaggccucgaauggauaggcugggucaaaaucgucuccggcacagucaacuucgccucacucgacuuccgcaaccgcaucucccucggccgcgaccgagaccucuccaccgccuacauggacauccgcggccucacccaagacgacaccgccaccuacuucugcgcccgccaaaaauucgccucccgcuacucaggcgaccaaggcuccuacuucgaccucuggggccgcggcacccucaucgucgucuccucc

SEQ ID NO: 57426 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaacugauccauugggugcgccaggccccgggccagggccuggaauggauagggugggugaaaacggucacgggcacggucaauuucgggagcuugaacuuucgccagcgcgugagcuugaccagggacagggacuuguucacggcccauauggauaucaggggcuugacccagggcgauaccgcgaccuauuucugugccaggcaaaaguucgagagcagguacacgggcgggcaagggugguauuucgaucucuggggcaggggcacgcacauagucgugagcucg

SEQ ID NO: 57427 - RNA, 384 nt, Artificial Sequence
  derived and/or modified sequence opt11 from anti-HIV-1_HeavyChain
caaucccaccucgaacaauccggcuccgccaugaaaaaacccggcgccuccguccgcgucuccugcuggaccuccgaaggcaucuucgacaccaccgaacucaucuacugggucagacaagcccccggccaaggccucgaauggaucggcugggucaaaaucgucuccggcaccgucaacuucgccucccucgacuuccgcaaccgcaucucccucucccgcgaccgcgaccucuccaccgcauacauggacauccgcggacucacccaagacgacaccgccaccuacuucugcgcccgccaaaaauucgccucccgcuacuccggcgaccaaggcuccuacuucgaccucuggggccgcggcacccucaucgucgucuccucc

SEQ ID NO: 57428 - RNA, 384 nt, Artificial Sequence
  derived and/or modified sequence opt11 from anti-HIV-1_HeavyChain
caaucgcgcuuggaacagagcgggagcgcgaugaagaaaccgggcgcgagcgugcgcgugagcuguuggacgagcgaggacauauucgauaccacggaauugaucuauugggugcgccaggccccgggccagggcuuggaauggaucgggugggugaaaauagucucgggcacggucaauuucgcgagccuggacuuucgcaaucgcaucagcuugagcagggacagagacuuaagcacggcccauauggauauaaggggcuugacccaggacgauaccgcgaccuauuucugugccaggcaaaaguucgcgagcagguacucgggcgaucaagggagcuauuucgaucucuggggcaggggcacgcucauaaucgugagcucg

SEQ ID NO: 57429 - RNA, 384 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggacgagcgaggacauauucgagaaaucggaauugauccauugggugcgccaggccccgggccagggcuuggaauggaucgggugggugaaaacggucacgggcgcggucaauuucggaagcucggacuuucgccagcgcgugagcuugaccagggacagggacuuguucacggcccauauggauaucaggggcuugacacagggcgauaccgcgaccuauuucugugccaggcaaaaguucgagagcagguacacgggcgggcaagggugguauuucgaucucuggggcaggggcacgcacauagucgugagcucg

SEQ ID NO: 57430 - RNA, 384 nt, Artificial Sequence
  derived and/or modified sequence opt11 from anti-HIV-1_HeavyChain
caaucgcacuuggaacagagcgggagcgcgaugaagaaaccgggcgcgagcgugcgcgugagcuguuggacgagcgaggacauauucgauaccacggaauugaucuauugggugcgccaggccccgggccagggauuggaauggaucgggugggugaaaauagucucgggcacggucaauuucgcgagcucggacuuucgcaaucgcaucagcuugagcagggacagagacuugagcacggccuauauggauauaaggggcuugacacaggacgauaccgcgaccuauuucugugcaaggcaaaaguucgcgagcagguacucgggcgaucaagggagcuauuucgaucucuggggcaggggcacgcucauaaucgugagcucg

SEQ ID NO: 57431 - RNA, 384 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaggaccgagcucauacacugggucaggcaagcgcccgggcaagggcucgaguggauaggcugggucaagaucgugagcgggaccgugaacuuugccucgcucgauuucaggaacaggaucucacucucgcgagaucgcgaucucucgaccgcguacauggacauacgcgggcucacgcaagaugacacggccacguacuuuugcgcgcgccagaaauuugccucgcgcuauagcggggaccagggcucguacuuugacuugugggggcgcgggacccugaucguggucucgagc

SEQ ID NO: 57432 - RNA, 384 nt, Artificial Sequence
  derived and/or modified sequence opt11 from anti-HIV-1_HeavyChain
aggcacacgugggagcaaucgggaucgggcgugaaaaagcccggggcaucggucagggucucgugcuggagcucggaagauaucuuugaaaggaccgagcucauacacugggucaggcaagcgcccgggcaagggcucgaguggauaggcugggucaagaccgugaccggggccgugaacuuuggcucgcucgauuucaggcacaggaucucgcucacgcgcgaucgagaucucuuuaccgcgcacauggacauacgcgggcucacgcaaggggacacggccacguacuuuugcgcgcgccagaaauuugaaucgcgcuauaccgggggccagggcugguacuuugacuugugggggcgcgggacccauaucguggucucgagc

SEQ ID NO: 57433 - RNA, 384 nt, Artificial Sequence
  derived and/or modified sequence opt11 from anti-HIV-1_HeavyChain
aggcacacgugggagcaaucgggcucgggcgugaaaaagcccggggccucggucagggucucgugcuggaccucggaagauaucuuugaaaggaccgagcucauacacugggucaggcaagcgcccgggcaagggcuagaguggauaggcugggucaagaccgugaccggggccgugaacuuuggcucgcucgauuucaggcacaggaucucgcucacgcgcgaucgcgaucucuuuaccgcgcacauggacauaagagggcucacgcaaggggacacggccacguacuuuugcgcgcgccagaaauuugaaucgcgcuauaccgggggccagggcugguacuuugacuugugggggcgcgggacccauauaguggucucgagc

SEQ ID NO: 57434 - RNA, 414 nt, Artificial Sequence
  derived and/or modified sequence opt11 from anti-HIV-1_HeavyChain
caagcccaccucgaacaauccggcuccggcgucaaaaaacccggcgccuccguccgcgucuccugcuggaccuccgaagacaucuucgaacgcucagaacucauacacuggguccgccaagcccccggccaaggccuagaauggaucggaugggucaaaaccgucaccggcgccgucaacuucggcucccccaacuuccgccaccgagucucccucacccgagaccgcgaccucuucaccgcccacauggacauccgcggccucacccaaggcgacaccgccaccuacuucugcgcccgccaaaaauacuacgccggcggccaaggcugguacuucgaccucuggggccgaggcacccucaucgucgucuccuccgccuccaccaaaggccccuccgucuuccacgaccuccgc

SEQ ID NO: 57435 - RNA, 417 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggcaccgggccagggauuggaauggaucgggugggugaaaauagucucgggcgcggucaauuucgggagcccgaacuuucgccagcgcgugagccugaccagggacagggacuuguucacggcccauauggauaucaggggccugacccagggcgauacagcgaccuauuucugugccaggcaaaaguucgagcgcgggggccagggcuggaucuuugacuugugggggcgcgggaccuugaucgcggucucgagcgcgagcacgaaagggcccucggucuuucccacgaucuguguc

SEQ ID NO: 57436 - RNA, 417 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucagaauugauccacugggugcgccaggccccgggccagggcuuggaauggaucgggugggugaaagcggucucgggcgcggucaauuacgggagcuuggacuuucgacaucgcgugagccugaccagggacagagaccuauucacggcccauauggauauaaggggcuugacccaggacgauaccgcgaucuauuucugugccaggcaaaaguucgcgcgcggggaccagggcugguucuuugacuugugggggcgcgggaccuugaucguggucucgagcgcgagcacgaaagggccaucggucuuuccccaugacuugcgc

SEQ ID NO: 57437 - RNA, 417 nt, Artificial Sequence
  derived and/or modified sequence opt11 from anti-HIV-1_HeavyChain
caagcgcaccuggaacagagcgggagcggggucaagaaagugggagcaagcgugcgcgugagcuguuggacaagcgaggacauauucgagcgcacggaauugauccacugggugcgccaggccccgggccagggccuggaauggaucggauggguaaaagcggucucgggcgcggucaacuacggaagccuggacuuucgccaccgcgugagccugaccagggacagggacuuguucacggcccauauggauaucagaggccugacccaagacgauaccgcgaucuauuucugcgccaggcaaaaguucgcgcgcggagaccagggcugguucuuugacuuguggggacgcgggaccuuaaucguagucucaagcgcgagcacgaaagggcccucagucuucccccaugaccugcgc

SEQ ID NO: 57438 - RNA, 417 nt, Artificial Sequence
  derived and/or modified sequence opt11 from anti-HIV-1_HeavyChain
caggcccaucucgagcaaucgggcucgggagugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgagaucucuuuaccgcgcacauggacauacgcgggcucacgcaaggggacacggccacauacuuuugcgcgcgccagaaauuuuacgcgggcgggcaagggugguauuucgaucucuggggcaggggcacgcucauagucgugagcucggccucgaccaagggcccgagcguguucccgcacgaucuaagg

SEQ ID NO: 57439 - RNA, 423 nt, Artificial Sequence
  derived and/or modified sequence opt11 from anti-HIV-1_HeavyChain
caaguguacauggaacaggccggggccggggucaagaaaccgggcgcgagcgugacauugagcuguaaaacggccgaugaagaugucuuugacgcggccuauaugcauugggugcgccaggccccgggccagaccuuugaauggcucggguggaugaaaccggucacgggcgcggucucguacgcgcgcaaguuccagggcaggguaucguucuauaugacgcgcgagcucgggauggcguacauggacuugcgcaaucucagguucgaugacacggccguguacuuuugcgcgcgcaagaccgcgggcgaugucucgggcgauaacaggggcuauuucuuugacuugugggggcgcgggagcagggucauagucucgagcgcgagcacgaaagggcccucagucuuuccccaugacuugcgc

SEQ ID NO: 57440 - RNA, 426 nt, Artificial Sequence
  derived and/or modified sequence opt11 from anti-HIV-1_HeavyChain
caaucccaccucgaacaaucaggcuccgccaugaaaaaacccggcgccuccguccgcgucuccugcuggaccuccgaagacaucuucgacacaaccgaacucaucuacuggguccgccaagcccccggccaaggccucgaauggaucggcugggucaaaaucgucuccggcaccgucaacuucgccucacucgacuuccgcaaccgcaucucccuaucccgcgaccgagaccucucaaccgccuacauggacauccgcggccucacccaagacgacaccgccaccuacuucugcgcccgccaaaaauucgccucccgauacucuggcgaccaaggcuccuacuucgaccucuggggccgcggcacccucaucgucgucuccuccgccuccaccaaaggccccuccgucuuccccaccaucuacguc

SEQ ID NO: 57441 - RNA, 372 nt, Artificial Sequence
  derived and/or modified sequence opt11 from anti-HIV-1_HeavyChain
caagugcaauugguccagagcggggccgaggucaagaaaccgggcgcgagcgugaaagugagcuguaaagcgagcgggggcacgcucucgagcuaugccauaagcugggucaggcaagcgcccgggcaagggcucgaguggauaggcugggucaagaccgugaccggggccgugaacuuuggcucggccuguuucaggcacagggucucacucacgcgcgaucgcgaucuauuuaccgcgcacauggacauacgcgggcucacgcaaggggacacggccacguacuuuugcgcgcgccagaaauuuuacaagggcgggcaagggugguauuucgaucucuggggcaggggcacgcucauagucgugagcucg

SEQ ID NO: 57442 - RNA, 372 nt, Artificial Sequence
  derived and/or modified sequence opt11 from anti-HIV-1_HeavyChain
cacgugcgcuugguccagagcggggccgaggucgagaaaccgggcgcgagcgugaaagugagcugugaaacgagcaauuacccguucaauauguauggcaugaccugggucaggcaagcgcccgggcaagggcuagaguggauaggcugggucaagaucgugagcggggcagugaacuuuggcucgcccaauuucaggcaaagagucucgcucacgcgcgaucgcgaucuauuuaccgcgcacauggacauacgcgggcucacgcaaggggacacggccacguacuuuugcgcgcgccagaaauuugaaaggggcgggcaaggguggauauucgaucucuggggcaggggcacgcucauagccgugagcucg

SEQ ID NO: 57443 - RNA, 375 nt, Artificial Sequence
  derived and/or modified sequence opt11 from anti-HIV-1_HeavyChain
caggcccaucucgagcaaucgggcucaggcgugaaaaagcucggggccucggucagggucucgugcuggaccucggaagaugucuuugaaaggaccgagcucauacacugggucaggcaagcgcccgggcaagggcucgaguggauaggaugggucaaggccgugagcggggccgugaacuauggcucgcucgauuucaggcacagggucucgcucacgcgcgaucgcgaucucuuuaccgcgcacauggacauacgcgggcuaacgcaagaugacacggccacguacuuuugcgcgcgacagaaauuuuacgcgggagggcaagggugguauuucgaucucuggggcaggggcacgcucauaguagugagcucg

SEQ ID NO: 57444 - RNA, 375 nt, Artificial Sequence
  derived and/or modified sequence opt11 from anti-HIV-1_HeavyChain
aggcacacgugggagcaaucgggcucgggcgugaaaaagcccggggccucggucagggucucgugcuggagcucggaagauaucuuugaaaggaccgagcuaauacacugggucaggcaagcgcccgggcaagggcucgaguggauaggcugggucaagaccgugaccggggccgugaacuuuggcucgcucgauuucaggcacaggaucucgcucacgcgcgaucgcgaucucuuuaccgcgcacauggacauacgcgggcucacgcaaggggacacggccacguacuuuugcgcgcgccagaaauuugaaaggggcgggcaagggugguauuucgaucucuggggcaggggcacgcucauagucgugagcucg

SEQ ID NO: 57445 - RNA, 375 nt, Artificial Sequence
  derived and/or modified sequence opt11 from anti-HIV-1_HeavyChain
aggcacacgugggagcaaucgggcucgggcgugaaaaggcccggggccucggucagggucucgugcuggaccucggaagauaucuuugaaacgaccgagcucauacacugggucaggcaagcgcccgggcaagggcucgaguggauaggcugggucaagaccgugagcggggccgugaacuuuggcucacucaauuucaggcacagggucucgcucacgagagaucgcgaccucucgaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 57446 - RNA, 381 nt, Artificial Sequence
  derived and/or modified sequence opt11 from anti-HIV-1_HeavyChain
cagguguuuauggagcaggcgggggcggggaugaagaagccgggggcgaguaugacggugaguuguaagacggcggaugaggauguguuugaugcggcguauaugcauugggugaggcaggcgccggggcagacguuugagugguugggguggaugaagccggugacgggggcggugaauuaugcgaggcaguuucaggggagggugaguuuuuauaggacgagggaguuggggauagcguauauggaucugagggauuugaaguuugaugauacggcgguguauuuuugugcgaggaagacgaagggggaugugagcggggaugauaggggguuuuuuuuugaucugugggggagagggacgagggugauagugaguagu

SEQ ID NO: 57447 - RNA, 384 nt, Artificial Sequence
  derived and/or modified sequence opt11 from anti-HIV-1_HeavyChain
caagugcacuuggaacagagcgggagcgggguaaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcuuggacuuucgccaucgcaucagcuugaccagggacagggacuuguucacggcccauauggauauaaggggcuugacccagggcgauaccgcgaccuauuucugugcaaggcaaaaguucgagagcagguacacgggcgggcaagggugguauuucgaucuauggggcaggggcacgcacauagucgugagcucg

SEQ ID NO: 57448 - RNA, 417 nt, Artificial Sequence
  derived and/or modified sequence opt11 from anti-HIV-1_HeavyChain
caggcccaucucgagcaaucgggcucaggcgugaaaaagcucggggccucggucagggucucgugcuggaccucggaagauaucuucgaaaggaccgagcucauacacugggucagacaagcgcccgggcaagggcuagaguggauaggcugggucaaggccgugagcggggccgugaacuauggcucgcucgauuucagacacagggucucgcucacgcgcgaucgcgaucucucgaccgcacacauggacauacgcgggcucacgcaagaugacacagccacguacuuuugcgcgcgccagaaauuugccaggggcgaucaagggugguuuuucgaucuauggggaaggggcacgcucauagucgugagcucggccucgaccaagggcccgagcguguucccgaccauaugcgug

SEQ ID NO: 57449 - RNA, 417 nt, Artificial Sequence
  derived and/or modified sequence opt11 from anti-HIV-1_HeavyChain
caggcccaucucgagcaaucgggcucgggcgugaaaaagcccggggcaucggucagggucucgugcuggaccucggaagauaucuuugaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuucugcgcgcgccagaaauuuuacgcgggcgggcaagggugguauuucgaucucuggggcaggggcacgcucauagucgugagcucggccucgaccaagggcccgagcguguucccgaccauaugcgug

SEQ ID NO: 57450 - RNA, 417 nt, Artificial Sequence
  derived and/or modified sequence opt11 from anti-HIV-1_HeavyChain
caggcccaucucgagcaaucgggcucgggcgugaaaaagcucggggccucggucagggucucaugcuggaccucggaagaugucuuugaaaggaccgagcucauacacugggucaggcaagcgcccgggcaagggcucgaguggauaggcugggucaaggccgugagcggggccgugaacuauggcucgcucgauuucaggcacagggucucgcuaacgcgcgaucgcgaucuauuuaccgcgcacauggacauacgagggcucacgcaagaugacacggccacguacuucugcgcgcgccagaaauucuacgcgggcgggcaagggugguacuucgaucucuggggcaggggcacgcucauagucgugagcucggccucgaccaagggcccgagcguguucccgcacgaucucagg

SEQ ID NO: 57451 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccggggcagggguuggaguggauagggugggugaagauagugucgggggcggugaauuucgggagcccgaacuuuaggcagagggugagcuugacgagggacagggacuuguucacggcgcauauggauauaaggggguugacgcagggggauacggcgacguauuucugugcgaggcagaaguucgagaggggagggcaggggugguacuuugacuugugggggagagggacguugauaguggugaguagc

SEQ ID NO: 57452 - RNA, 384 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaauugauacauugggugcgacaggccccgggccagggcuuggaauggaucgggugggugaaaacggucacgggcgcggucaauuucgggagcuuggacuuucgccaucgaaucagcuugaccagggacagggacuuguucacggcccauauggauauaaggggcuugacccagggcgauaccgcgaccuauuucugugccaggcaaaaguucgagagcagguacacgggcgggcaagggugguauuucgaucucuggggcaggggcacgcacauagucgugagcucg

SEQ ID NO: 57453 - RNA, 426 nt, Artificial Sequence
  derived and/or modified sequence opt11 from anti-HIV-1_HeavyChain
caagcccaccucgaacaaucaggcuccggcgucaaaaaacccggcgccuccguccgcgucuccugcugguccuccgaagacaucuucgaacgcaccgaacuaauccacuggguccgccaagcccccggccaaggccucgaauggaucggcugggucaaaaccgucaccggcgccgucaacuucggcucccucgacuuccgccaccgcaucucccucacccgcgaccgcgaccucuucaccgcccacauggacauccgcggccucacccaaggcgacaccgcaaccuacuucugcgcccgccaaaaauucgaaucccgauacaccggcggccaaggcugguacuucgaccuauggggccgcggcacccacaucgucgucuccuccgccuccaccaaaggccccuccgucuuccccaccaucugcguc

SEQ ID NO: 57454 - RNA, 375 nt, Artificial Sequence
  derived and/or modified sequence opt11 from anti-HIV-1_HeavyChain
caagcgcacuuggaacagagcgggagcggggucaagaaaccgggcacgagcgugcgcgugagcuguuggacgagcgaggacauauucgagcgaacggaauugauccauugggugcgacaggccccgggccagggcuuggaauggaucgggugggugaaaacggucacgggcgcggucaauuucgggagcccgaacuuucgacaucgcgugagcuugaccagggacagggacuuguucacggcccauauggauaucaggggcuugacccagggcgauaccgcgaccuauuucugugccaggcaaaaguucgagcgagggggccagggcugguacuuugacuugugggggcgcgggaccuugaucguggucucgagc

SEQ ID NO: 57455 - RNA, 381 nt, Artificial Sequence
  derived and/or modified sequence opt11 from anti-HIV-1_HeavyChain
cagguccagcucgugcaaucaggcgcggaagucaaaaagcccggggccucaguaaaggucucgugcaaggccucgggcuauaccuauaccacguacggggucucguggcugcgccaggucccgggccagcgcccggaauggaugggguggauacgcccgaaaacgggcgcgcgcaaucaagcgcgccaguuccagcccaggaucucgcucacgcgcgaucgcgcgcucucgaccgcguacuuggacuugaacucgcucacgagcgcggacucgggcacguacuuuugcgcgcgccagaccuuuaaaccggacuuuuacuuugccgaucaaggguggucguucaaucucuggggcaggggcgcgcacuuuaucgugagcucg

SEQ ID NO: 57456 - RNA, 384 nt, Artificial Sequence
  derived and/or modified sequence opt11 from anti-HIV-1_HeavyChain
cgcgcgcacuuggaacagagcgggagcggggucaagaaauugggcgcgagcgugcgcgugagcuguuggacgagcgaggacauauucgagcgcacggaauugauccauugggugcgccaggccccgggccagggcuuggaauggaucgggugggugaaagcggucucgggagcggucaauuacgggagcuuggacuuucgccaucgagugagcuugaccagggacagggacuuguucacggcccauauggauaucaggggcuugacccaggacgauaccgcgaccuauuucugugccaggcaaaaguucgagagcagguacacgggcgggcaagggugguauuucgaucucuggggcaggggcacgcacauaaccgugagcucg

SEQ ID NO: 57457 - RNA, 375 nt, Artificial Sequence
  derived and/or modified sequence opt11 from anti-HIV-1_HeavyChain
caggcgcacuuggagcagagcgggagcggggugaagaagccgggggcgagcguaagggugagcuguuggacgagcgaggacauauucgagaggacggaguugauacauuggguaaggcaggcgccggggcagggguuggaguggauagggugggugaagauagugaguggggcggugaauuucgggagcccgaacuuuaggcagagggugagcuugacgagggacagggacuuguucacggcacauauggauauaagggggcugacgcagggggauacggcgacguauuacugugcgaggcagaaguucgagaggggggggcagggguggauauuugacuugugggggagggggacguugauagcggugaguagc

SEQ ID NO: 57458 - RNA, 375 nt, Artificial Sequence
  derived and/or modified sequence opt11 from anti-HIV-1_HeavyChain
caggcccaucucgagcaaucgggcucgggcgugaaaaagcucggggccucggucaggguaucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgcgaucgcgaucucuuuaccgcgcacauggacauacgcgggcucacacaagaugacacggccacguacuuuugcgcgcgccagaaauuugccaggggcgaucaagggugguuuuucgaucucuggggccauggcacgcucauagucgugagcucg

SEQ ID NO: 57459 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagagaacggaguugauacauugggugaggcaggcgccggggcagggguuggaguggauagggugggugaagacggugacgggggcggugaauuucgggagcccgaacuuuaggcauagagugagcuugacgagggacagggacuuguucacggcgcauauggauauaaggggguugacgcagggggauacggcgacguauuucugugcgagacagaaguucgagagaggagggcaggggugguacuuugacuugugggggcacgggacguugauaguggugaguagc

SEQ ID NO: 57460 - RNA, 375 nt, Artificial Sequence
  derived and/or modified sequence opt11 from anti-HIV-1_HeavyChain
caggcccaccucgagcaaucgggcucgggcgugaaaaagcccggggcaucggucagggucucgugcuggaccucggaagauaucuuugaaaagagcgagcucauacacugggucaggcaagcgccagggcaagggcucgaguggauaggcugggucaagaccgugaccggggccgugaacuuuggcucgagcgauuucagacaaagagucucgcucacgcgcgauggagaucuauuuaccgcgcacauggacauacgcgggcuaacgcaaggggacacggccacguacuuuugcgcgcgccagaaauuuuacgcgggcgggcaagggugguauuucgaucucuggggcaggggcacgcucauaaucgugagcucg

SEQ ID NO: 57461 - RNA, 372 nt, Artificial Sequence
  derived and/or modified sequence opt11 from anti-HIV-1_HeavyChain
caagcgcacuuggaacagagcgggagcggggucaagaaaccgggcgcaagcguacgagugagcuguuggacgagcgaggacauauucgagaaaucggaacugauccauugggugcgccaggccccgggccagggcuuggaauggaucgggugggugaaaacgguaacaggcgcggucaauuucgggcaccagaucucggacagggucucgcucacgcgcgaccgcgaucucuuuaccgcgcacauggacauacgcgggcucacgcaaggggacacggccacguacuuuugcgcgcgccagaaauuuuacgcgggcgggcaagggugguauuucgaucucuggggccauggcacgcuaauagucgugagcucg

SEQ ID NO: 57462 - RNA, 375 nt, Artificial Sequence
  derived and/or modified sequence opt11 from anti-HIV-1_HeavyChain
caggcgcacuuggagcagagcgggagcggggugaagaagccgggggcgagcguaagggugagcuguuggacgagcgaggacauauucgagagaacggagcugauacauugggugagacaggcgccggggcagggguuggaguggauagggugggugaagacggugaguggggcggugaauuucgggagcccgaacuuuaggcauagggugagcuugacgagggacagggacuuguucacggcacauauggauauaaggggguugacgcagggggauacggcgacguauuucugugcgaggcagaaguucgagaggggagggcaggggugguacuuugacuugugggggcacgggacguugauaguggugaguagc

SEQ ID NO: 57463 - RNA, 375 nt, Artificial Sequence
  derived and/or modified sequence opt11 from anti-HIV-1_HeavyChain
caagcgcacuuggaacagagcggggccggggucaagaaaccgggcgcgagcgugcgcgugagcuguuggacgagcgaggacauauucgagcgcacggaauugauccauugggugcgccaggccccgggccagggcuuggaauggaucgggugggugaaaacggucucgggcgcgguaaauuucgggagcccgaacuuucgccaucgcgugagcuugaccagggacagagaccuguucacggcccauauggauaucaggggcuugacccagggcgauaccgcgaccuauuacugugccaggcaaaaguucgagcgcgggggccagggcugguacuuugacuugugggggcgcgggaccuugaucguggucucgagc

SEQ ID NO: 57464 - RNA, 375 nt, Artificial Sequence
  derived and/or modified sequence opt11 from anti-HIV-1_HeavyChain
caggcccaucucgagcaaucgggaucgggcgugaaaaagcucggggccucggucagggucucgugcuggaccucggaagauaucuuugaaaggaccgagcucauacacugggucaggcaagcgcccgggcgcgggcucgaguggauaggcugggucaaggccgugagcggggccgugaacuauggcucgcucgauuucaggcacagggucucgcucacgcgcgaucgcgaucucuuuaccgcgcacauggacauacgcgggcucacgcaagaugacacggccacguacuauugcgcgcgccagaaauuugaaaggggcgggcaaggguggauauucgaucucuggggcaggggcacgcucauagccgugagcucg

SEQ ID NO: 57465 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaaaagagcgagcucauacacugggucaggcaagcgcccgggcaagggcuagaguggauaggcuggguaaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuauugcgcgcgccagaaauuuuacgcgggcgggcaagggugguauuucgaucucuggggcaggggcacgcucauagucgugagcucg

SEQ ID NO: 57466 - RNA, 375 nt, Artificial Sequence
  derived and/or modified sequence opt11 from anti-HIV-1_HeavyChain
caagcccaccucgaacaauccggcuccggcgucaaaaaacccggcgccuccgucagagucuccugcuggaccuccgaagacaucuucgaacgcaccgaacucauccacuggguccgccaagcccccggccaaggccucgaauggaucggcugggucaaaaccgucaccggcgccgucaacuucggcucccccaacuuccgccaccgcgucucccucacccgcgaccgcgaccucuucaccgcccacauggacauccgaggccucacccaaggcgacaccgccaccuacuucugcgcccgccaaaaauucuacaaaggcggccaaggcugguacuucgaccucuggggccgcggcacccucaucgucgucuccucc

SEQ ID NO: 57467 - RNA, 372 nt, Artificial Sequence
  derived and/or modified sequence opt11 from anti-HIV-1_HeavyChain
uacguggaacugggcacgaacacgggcccggaagugcgcaagcccggggccucggucaagaucucgugcaagaccucgggcuauaucuuuaccgauaacuauuuccauugguugcgccaggccccggccgugggccuggaauggaugggguggauaaacucgcacaauggcuauaccaagagcgcgaaaaaguuccagggcagaaucacgaugacgcgcgauaccgcggucgauaccgcguacauggaauugaucgaucucacgagcgaugacacggccacguacuauugcgcgcgccagaaauuuuacgcgggcggacaagggugguauuucgaucucuggggcuguggcacgcucauagucgugagcucg

SEQ ID NO: 57468 - RNA, 375 nt, Artificial Sequence
  derived and/or modified sequence opt11 from anti-HIV-1_HeavyChain
caggcccaucucgagcaaucaggcucgggcgugaaaaagcccggggccucggucagggucucgugcuggaccucggaagauaucuuugaaaagagcgagcucauacacugggucaggcaagcgcccgggcaagggcucgaguggauaggcugggucaagaccgugaccggggccguaaacuuuggcucgagcgauuucaggcaaagggucucgcucacgcgagauagagaucucuuuaccgcgcacauggacauacgcgggcucacgcaaggggacacggccacguacuuuugcgcgcgccagaaauuuuacgcgggcgggcaagggugguauuucgaucucuggggcaggggcacgcucauaugcgugagcucg

SEQ ID NO: 57469 - RNA, 375 nt, Artificial Sequence
  derived and/or modified sequence opt11 from anti-HIV-1_HeavyChain
caggcgcauuuggagcagagugggagcggggugaagaagccgggggcgagugugagggugaguuguuggacaagcgaggacauauuugagaggacggaguugauacauugggugaggcaggcgccggggcagggguuggaguggauagggugggugaagacggugacgggggcggugaauuucgggagcagugacuuuaggcagagggugagucugacgagggacagggacuuguuuacggcgcauauggauauaaggggguugacgcagggggauacggcgacguauuacugugcgaggcagaaguuuuaugcgggggggcaggggugguauuuugacuugugggggagggggacguuaauaguggugaguagc

SEQ ID NO: 57470 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgaacggaauugauccauugggugcgccaggccccgggccagggcuuggaauggaucgggugggugaaaccggucacgggcgcagucaauuucgggagcccgaacuuucgccaucgcgugagcuugaccagggacagggacuuguucacggcccauauggauaucaggggcuugacccagggcgauacagcgaccuauuucugugccaggcaaaaguucgagcgcgggggccagggcugguacuuugacuugugggggcgcgggaccuugaucguggucucgagc

SEQ ID NO: 57471 - RNA, 375 nt, Artificial Sequence
  derived and/or modified sequence opt11 from anti-HIV-1_HeavyChain
caggugcaguuggugcagaguggggcggaggugaagaagccgggggcgagugugagggugaguuguuggacgagugaggauauauuugagaagagugaguugauacauugggugaggcaggcgccggggcagggguuggaguggauagggugggugaagacggugacgggggcggugaauuuugggaguagugauuuuaggcagagggugagucugacgagggacagggacuuguuuacggcgcauauggauauaaggggguugacgcagggggauacggcgacguauuauugugcgaggcagaaguuugagaggggggggcaggggugguauuuugaccugugggggagggggacguugauaguggugaguagu

SEQ ID NO: 57472 - RNA, 375 nt, Artificial Sequence
  derived and/or modified sequence opt11 from anti-HIV-1_HeavyChain
caggcccaucucgagcaaucgggcucgggcgugaaaaagcucggggccucggucaggguaucgugcuggaccucagaagauaucuuugaaaggaccgagcucauacacugggucaggcaagcgcccgggcaagggcucgaguggauaggcugggucaaggccgugagcggggccgugaacuauggcucgcucgauuucaggcacagggucucgcucacgcgugaucgcgaucucucgacagcgcacauggacauacgcgggcucacgcaagaugacacggccacguacucgugcgcgcgccagaaauuugccaggggcgaucaagggugguuuuucgaucucuggggcaggggcacgcuaauagucgugagcucg

SEQ ID NO: 57473 - RNA, 375 nt, Artificial Sequence
  derived and/or modified sequence opt11 from anti-HIV-1_HeavyChain
caggcgcacuuggagcagagcgggagcggggugaagaagccggggacgagcgugagagugagcuguuggacgagcgaggacauauucgagaggacggaguugauacauugggugaggcaggcgccggggcagggguuggaguggauagggugggugaagacggugacgggggcggugaauuucgggagcccgaacuuuaggcauagggugagcuugacgagggacagggacuuguucacggcgcauauggauauaaggggguugacgcagggggauacggcgacguauuacugugcgaggcagaaguucgagaggggggggcaggggugguacuuugacuugugggggagggggacguugauaguggugaguagc

SEQ ID NO: 57474 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgacaggccccgggccagggcuuggaauggaucgggugggugaaaacggucacgggcacggucaauuucgggagcuugaacuuucgccagcgcgugagcuugaccagggacagggaccuguucacggcccauauggauaucaggggcuugacccagggcgauaccgcgacauauuucugugccaggcaaaaguucgcgcgcggggaccagggcugguucuuugaccugugggggcacgggaccuugaucguggucucgagc

SEQ ID NO: 57475 - RNA, 375 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagcgcacggaauugauccauugggugcgccaggccccgggccagggcuuggaauggaucgggugggugaaaacggucacgggcgcggucaauuucgggagcccgaacuuucgccaucgcgugagcuugaccagggacagggacccguucacggcccauauggauaucaggggccugacacagggcgauaccgcgaccuauuucugugccagacaaaaguucgagcgcgggggccagggcugguacuuugacuugugggggcacgggaccuugaucguggucucgagc

SEQ ID NO: 57476 - RNA, 375 nt, Artificial Sequence
  derived and/or modified sequence opt11 from anti-HIV-1_HeavyChain
caggcccaucucgagcaaucgggcucgggcgugaaaaagcccggggcaucggucaggguaucgugcuggaccucggaagauaucuuugaaaggaccgagcucauacacugggucaggcaagcgcccgggcaagggcucgaguggauaggcugggucaagacagugaccggggccgugaacuuuggcucgcccaauuucaggcacagggucucgcucacgcgcgaucgcgaucucuuuaccgcgcacauggacauaugcgggcucacgcaaggggacacggccacguacuuuugcgcgcgccagaaauuugaaaggggcgggcaagggugguauuucgaucucuggggccauggcacgcucauagucgugagcucg

SEQ ID NO: 57477 - RNA, 375 nt, Artificial Sequence
  derived and/or modified sequence opt11 from anti-HIV-1_HeavyChain
caggcccaucucgagcaaucgggcucgggcgugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuauggcucgcucgauuucaggcaaagggucucgcucacgcgcgaucgagaucucuuuaccgcgcacauggacauacgcgggcucacgcaaggggacacggccacguacuauugcgcgcgccagaaauuuuacgcgggcgggcaagggugguauuucgaucucuggggcaggggcacgcucauagucgugagcucg

SEQ ID NO: 57478 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgagugagcuguuggacgagcgaggacauauucaagagcgagcucauacacugggucaggcaagcgcccgggcaagggcucgaguggauaggcugggucaagaccgugaccggggcagugaacuuuggcucgagcgauuucaggcaaagggucucgcucacgcgcgaucgcgaucuauuuaccgcgcacauggacauacgcgggcucacgcaaggggacacggccacguacuuuugcgcgcgccagaaauuuuacgcgggcgggcaagggugguauuucgaucucuggggccauggcacgcucauagucgugagcucg

SEQ ID NO: 57479 - RNA, 375 nt, Artificial Sequence
  derived and/or modified sequence opt11 from anti-HIV-1_HeavyChain
caggcccaucucgagcaaucgggcucgggcgugaaaaagcccgggaccucggucagggucucgugcuggaccucggaagauaucuuugaaaggaccgagcucauacacugggucaggcaagcgcccgggcaagggcucgaguggauaggcugggucaagaccgugaccggggccgugaacuuuggcucgcccaauuucaggcacagggucucgcucacgcgcgaucgcgaucucuuuaccgcgcacauggacauacgcgggcucacgcaaggggacacggccacguacuuuugcgcgcgccagaaauuugccaggggcgaucaagggugguuuuucgaucucuggggccauggcacgcucauagucgugagcucg

SEQ ID NO: 57480 - RNA, 375 nt, Artificial Sequence
  derived and/or modified sequence opt11 from anti-HIV-1_HeavyChain
caagcgcacuuggaacagagcgggagcggggucaagaaauugggcgcgagcgugcgcgugagcuguuggacgagcgaggacauauucgagcgcacggaauugauccauugggugcgccaggccccgggccagggcuuggaauggaucgggugggugaaagcggucucgggcgcggucaauuacgggagcuuggacuuucgacaucgcgugagcuugaccagggacagggacuuguucacggcacauauggauaucaggggcuugacccaggacgauaccgcgaccuauuacugugccaggcaaaaguucgcgcgcggggaccagggcugguucuuugacuugugggggcgcgggaccuugaucguggucucgagc

SEQ ID NO: 57481 - RNA, 381 nt, Artificial Sequence
  derived and/or modified sequence opt11 from anti-HIV-1_HeavyChain
caaguccaacucguccaauccggcgccgaagucaaaaaacccggcgccuccgucaaagucuccugcaaagccucaggcuacaccuucaccgacuacuaccuccacuggguccgccaagcccccggccaaggccucgacugggucggcuggaucaaccccaacuccggcggcaccaacuacgcccaaaaauuccaaggccgcgucgccaugacccgcgacaccucccucuccuccgucuaccucgaccucaacucccucaccuccgccgacuccggcaccuacuucugcgcccgccaaaccuucaaacccgacuucuacuucgccgaccaaggcugguccuucaaccucuggggccaaggcucccacuucaucgucuccucc

SEQ ID NO: 57482 - RNA, 375 nt, Artificial Sequence
  derived and/or modified sequence opt11 from anti-HIV-1_HeavyChain
caggcccaucucgagcaaucgggcucaggcgugaaaaagcccggagccucggucagggucucgugcuggaccucggaagauaucuuugaaaagagcgagcucauacacuggguaaggcgcgcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgcgggcucacgcaaggggacacggccacguacuauugcgcgcgccagaaauuuuacgcgggcgggcaagggugguauuucgaucucuggggcaggggcacgcucauagucgugagcucg

SEQ ID NO: 57483 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugaccgugagcuguuggacgagcgaggacauauucgagaaaucggaauugauccauugggugcgccaggccccgggccagggcuuggaauggaucgggugggugaaaacggucacgggcgcggucaaucucguauaccagaucucggacagggucucgcucacgcgcgaucgcgggcucuuuaccgcgcacauggacauacgcgggcucacgcaaggggacacggccacguacuauugcgcgcgccagaaauuuuacgcgggcgggcaagggugguauuucgaucuauggggcaggggcacgcucauagucgugagcucg

SEQ ID NO: 57484 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagauaucuuugaagggagcgagcucauacacugggucaggcaagcgcccgggcaagggcucgaguggauaggcugggucaagaccgugaccggggccgugaacuuuggcucggccuauuucaggcacagggucucgcuaacgcgcgaucgcgaucucuuuaccgcgcacauggacauacgcgggcucacgcaaggggacacggccacguacuuuugcgcgcgacagaaauuuuacaagggcgggcaagggugguauuucgaucuauggggccauggcacgcuaauagucgugagcucg

SEQ ID NO: 57485 - RNA, 375 nt, Artificial Sequence
  derived and/or modified sequence opt11 from anti-HIV-1_HeavyChain
caggcccaucucgagcaaucgggcucgggcgugaaaaagcccggggccucggucagggucucgugcuggaccucggaagacaucuuugaaaggaccgagcucauacacugggucagacaagcgccagggcaagggcucgaguggauaggcugggucaagaccgugaccggggccgugaacuauggcucacucaauuucaggagcaggaucucgcucacgcgcgaucgcgaucucuuuaccgcacacauggacauacgcgggcucacggaaggggacacggccacguacuuuugcgcgcgccagaaauuuuacgcgggcgggcaagggugguauuucgaucuauggggccauggcacgcucauagucgugagcucg

SEQ ID NO: 57486 - RNA, 375 nt, Artificial Sequence
  derived and/or modified sequence opt11 from anti-HIV-1_HeavyChain
caggcccaucucgagcaaucgggcucgggagugaaaaagcccggggccucagucaggguaucgugcuggaccucggaagauaucuuugaaaggaccgagcucauacacugggucaggcaagcgcccgggcaagggcucgaguggauaggcugggucaagaccgugagcggggccgugaacuuuggcucgcccaauuucaggcacagggucucgcucacgcgcgaucgcgaucucuuuaccgcgcacauggacauacgcgggcucacgcaaggggacauggccacguacuuuugcgcgcgccagaaauuugaaaggggcgggcaagggugguauuucgaucucuggggccauggcacgcucauagucgugagcucg

SEQ ID NO: 57487 - RNA, 375 nt, Artificial Sequence
  derived and/or modified sequence opt11 from anti-HIV-1_HeavyChain
caggcgcacuuggagcagagcgggagcggggugaaggagccggggacgagcgugagggugagcuguuggacgagcgaggacauauucgagaggacggaguugauacauugggugaggcaggcgccggggcaaggguuggaguggauagggugggugaagacggugacgggggcggugaauuucgggagcccgaacuuuaggcauagggugagcuugacgagggacagggacuuguucacggcgcauauggauauaagggggcugacgcagggggauacggcgacguauuucugugcgaggcagaaguucgagaggggggggcagggguggauauuugacuugugggggagggggacguugauagcggugaguagc

SEQ ID NO: 57488 - RNA, 375 nt, Artificial Sequence
  derived and/or modified sequence opt11 from anti-HIV-1_HeavyChain
caggugcaguuggagcagagcgggaguggggugaagaaguugggggcgagcgugagggugagcuguuggacgagcgaggacauauucgggaggacggaguugauacauugggugaggcaggcgccggggcagggguuggaguggauagggugggugaaggcggugaguggggcggugaauuacgggagcuuggacuuuagacauagggugagcuugacgagggacagggacuuguucacggcgcauauggauauaaggggguugacgcaggacgauacagcgacguauuacugugcgaggcagaaguucgcgagaggggaccaggggugguucuuugacuugugggggagggggacguugauaguggugaguagc

SEQ ID NO: 57489 - RNA, 372 nt, Artificial Sequence
  derived and/or modified sequence opt11 from anti-HIV-1_HeavyChain
caagcgcaccuggaacagagcgggagcggggucaagaaaccgggcgcgagcgugcgagugagcuguuggacgagcgaugacauauucaagacagagcucauacacugggucaggcaagcgcccgggcaagggcucgaguggauaggcugggucaagaccguaaccggggccgugaacuuuggcucgcccaauuucaggcaaagggucucgcucacgcgcgaucgcgaucucuuuaccgcgcacauggacauacgcgggcucacgcaagaugacacggccacguacuuuugcgcgcgccagaaauuugccaggggcgaucaagggugguuuuucgaucucuggggcaggggcacgcucauagucgugagcucg

SEQ ID NO: 57490 - RNA, 375 nt, Artificial Sequence
  derived and/or modified sequence opt11 from anti-HIV-1_HeavyChain
caggcgcacuuggagcagagcgggagcggggugaagaagccgggggcgagcgugagggugagcuguuggacgagcgaggacauauucgagaggacggaguugauacauugggugaggcaggcgccggggcagggguuggaguggauagggugggugaagacggugacgggggcggugaauuucgggagcccgaacuuuaggcauagggugagcuugacgagggacagggacuuguucacggcgcauauggauauaaggggguugacgcagggggauacggcgacguauuacugugugaggcagaaguucgagaggggggggcaggggugguacuuugacuugugggggagagggacguugauaguggugaguagc

SEQ ID NO: 57491 - RNA, 375 nt, Artificial Sequence
  derived and/or modified sequence opt11 from anti-HIV-1_HeavyChain
cagguccagcuagugcaaucgggcgcggaagugaaaaagcccggggccucggucaaggucucgugcuggaccucggaagauaucuucgaaaagagcgagcucauacacugggucaggcaagcgcccgggcaagggcucgaguggauaggcugggucaagaccgugaccggggccgugaacuuuggcucgagcgauuucaggcaaagggucucgcucacgcgcgaucgcgaucucuuuaccgcgcacauggacauacgagggcucacgcaaggggacacggccacguacuauugcgcgcgccagaaauuuuacgcgggcgggcaagggugguauuucgaucuauggggcaggggcacgcucauagucgugagcucg

SEQ ID NO: 57492 - RNA, 375 nt, Artificial Sequence
  derived and/or modified sequence opt11 from anti-HIV-1_HeavyChain
caggcccaucucgagcaaucgggcucaggagugaaaaagcucggggccucggucagggucucgugcuggaccucggaagauaucuuugaaaggaccgagcucauacacugggucaggcaagcgcccgggcaagggcucgaguggauaggcugggucaaggccgugagcggggccgugaacuacggcucgcuagauuucaggcacagggucucgcucacgcgcgaucgagaucucuuuaccgcgcacauggacauacgcgggcucacgcaaggggacacggccacguacuuuugcgcgcgacagaaauuuuacaagggcgggcaagggugguauuucgaucucuggggcaggggcacgcucauaguagugagcucg

SEQ ID NO: 57493 - RNA, 372 nt, Artificial Sequence
  derived and/or modified sequence opt11 from anti-HIV-1_HeavyChain
caagcgcacuuggaacagagcgggagcggggucaagaaaccgggcgcgagcgugcgcgugagcuguuggacgagcgaggacauauucgagaaaucggaauugauccauugggugcgccaggccccgggccagggcuuggaauggaucgggugggugaaaacggucacgggcgcggucaauuucgcgcaccagaucucggacagggucucgcucacgcgcgaucgcgaucucuuuaccgcgcacauggacauacgcgggcucacgcaaggggacacggccacguacuauugcgcgcgccagaaauuuuacgcgggcgggcaagggugguauuucgaucucuggggaaggggcacgcucauagucgugagcucg

SEQ ID NO: 57494 - RNA, 375 nt, Artificial Sequence
  derived and/or modified sequence opt11 from anti-HIV-1_HeavyChain
caggcgcacuuggagcagagcgggaguggggugaagaagccgggggcgagcgugagggugagcuguuggacgagcgaggacauauucgggaggacggaguugauacauugggugagacaggcgccggggcagggguuggaguggauagggugggugaagacggugaguggggcggugaauuucgggagcccgaacuuuaggcauagagugagcuugacgagggacagggacuuguucacagcgcauauggauauaaggggguugacgcagggggauacggcgacguauuucugugcgaggcagaaguucgagaggggggggcaggggugguacuuugaccugugggggagggggacguugauaugugugaguagc

SEQ ID NO: 57495 - RNA, 636 nt, Artificial Sequence
  derived and/or modified sequence opt11 from anti-HIV_5CIN_LightChain
gaaaucguccucacacaaucccccggcacccaaucccucucccccggcgaaagagccacccucuccugccgcgccucccaauccgucggcaacaacaaacucgccugguaccaacaacgccccggacaagcaccccgccuacucaucuacggcgccuccucccgcccuuccggcgucgccgaccgauucucaggauccggcucaggcaccgacuucacccucacaaucucccgccucgaacccgaagacuucgccgucuacuacugccaacaauacggccaaucccucuccaccuucggccaaggcaccaaagucgaagucaaacgcacagucgccgcccccucuguauucaucuucccacccuccgacgaacaacuuaaauccggaaccgccucagucgucugccuccucaacaacuucuauccccgcgaagccaaaguccaauggaaagucgacaacgcccuccaauccggcaacucccaagaauccgucaccgaacaagacuccaaagacuccacauacucacuauccucaacccucacccucucaaaagccgacuacgaaaaacacaaagucuacgccugcgaagucacccaccaaggccucuccucccccguaaccaaaucauucaaccga

SEQ ID NO: 57496 - RNA, 672 nt, Artificial Sequence
  derived and/or modified sequence opt11 from anti-HIV_5CIN_HeavyChain
guccaacucguacaaucaggcgcagaaguaaaaagaccaggaagcucagucacagucucaugcaaagccuccggcggaagcuucagcacauacgcccucucaugggugcgacaagccccaggcagaggccuggaauggaugggcggcgucaucccacuacucaccaucaccaacuacgcccccagguuccagggccgcaucacaaucaccgccgaccgcucaaccucaaccgcauaccuagaacuaaacucacuccgacccgaagacaccgccguauacuacugcgcccgcgaaggcaccaccggcagcggcggcaaacccauaggcgcauucgcacacuggggccagggaacccucguaaccgugagcuccgccuccacaaaaggcccaagcgucuucccccucgcacccuccagcaaaagcaccagcggcggcaccgcagcacucggaugccugguuaaagacuacuuccccgaaccagucaccgucucauggaacagcggcgcccucaccucaggaguacacacauuccccgccguacuccaaagcuccggccuauacucacuaucaagcgucgucaccgucccaagcucaagccucggcacacaaaccuacaucugcaacguaaaccacaaacccuccaacacaaaaguagacaaaaaagucgaaccc

SEQ ID NO: 57497 - RNA, 678 nt, Artificial Sequence
  derived and/or modified sequence opt11 from anti-HIV_5CIL_HeavyChain
guccaacucguccaauccggagccgaagucaaacgccccggcuccucagucacagucuccugcaaagccuccggcggcuccuucucaaccuacgcccucucauggguccgccaagcccccggccgaggccuagaauggaugggcggcgucaucccccuccuaaccauaaccaacuacgccccccgcuuccaaggccgcaucaccaucaccgccgaccgcuccaccuccaccgccuaccucgaacucaacucccuccgccccgaagacaccgccguauacuacugcgcccgagaaggcaccaccggcgacggcgaccucggaaaacccaucggcgccuucgcccacuggggccaaggaacccucgucaccgucuccucagcaucaaccaaaggacccuccgucuucccacucgcccccuccuccaaaucaaccucuggcggcaccgccgcccucggcugccuagucaaagacuacuuccccgaacccgucaccguauccuggaacuccggcgcacucaccuccggcguccacaccuuccccgccguccuccaauccucaggccucuacucccuuuccucagucgucaccguccccucuuccucccucggcacccaaaccuacaucugcaacgucaaccacaaacccuccaacaccaaagucgacaaaaaagucgaaccc

SEQ ID NO: 57498 - RNA, 678 nt, Artificial Sequence
  derived and/or modified sequence opt11 from anti-HIV_5CIP_A-Chain
guccaacucguacaauccggcgccgaagucaaacgccccggcucauccgucaccgucuccugcaaagcauccggcggcuccuucuccaccuacgcccuuuccuggguacgacaagcccccggccgaggccucgaauggaugggcggaguaaucccacuccuaaccaucacaaacuacgcccccagauuccaaggccgcaucaccaucacagccgaccgcuccaccucaaccgccuaccucgaacucaacucacuccgccccgaagacaccgccgucuacuacugcgcccgcgaaggcaccacuggauggggcuggcuaggcaaacccaucggcgccuucgcccacuggggccaaggcacccucgucaccgucucuuccgccucaacaaaaggcccauccgucuucccacucgccccauccuccaaauccaccuccggcggaaccgccgcacucggcugccucgucaaagacuacuuccccgaacccgucaccgucucauggaacuccggcgcccucaccuccggcguacacaccuucccagccguccuccaauccuccggucucuacucacucuccuccgucgucacaguacccuccuccucacucggcacacaaaccuacaucugcaacgucaaccacaaaccaucuaacaccaaagucgacaaaaaagucgaaccc

SEQ ID NO: 57499 - RNA, 681 nt, Artificial Sequence
  derived and/or modified sequence opt11 from anti-HIV_5CIP_HeavyChain
guccaacucguacaauccggcgccgaagucaaacgccccggcucauccgucacggucucaugcaaagccuccggcggauccuucuccaccuacgcccucuccuggguccgccaagcccccggccgaggccuagaauggaugggcggcgucaucccccuccucacaauaacaaacuacgccccccgcuuccaaggccgcaucaccaucacagccgaccgcuccaccucgaccgccuaccucgaacuaaacagccuccgccccgaagacaccgccgucuacuacugcgcccgcgaaggcacaaccggcuggggauggcuaggcaaacccaucggcgccuucgcccacuggggccaaggcacccucgucacaguuucauccgcaucaaccaaaggcccauccgucuucccacuagcccccucauccaaauccaccucaggcggcaccgccgcacuuggaugccucgucaaagacuacuuccccgaacccgucaccgucuccuggaacuccggagcccuaacauccggcguccacacauucccagccguacuccaaagcucgggccucuacucacucuccucagucgucaccguucccucauccucccuaggcacacaaaccuacaucugcaacgucaaccacaaacccuccaacaccaaaguagacaaaaaaguagaaccaaaa

SEQ ID NO: 57500 - RNA, 630 nt, Artificial Sequence
  derived and/or modified sequence opt11 from anti-HIV_4JKP_LightChain
gaaaucguacucacccaaucccccgccacccuaucccuuuccccaggcgaaaccgcaaucaucuccugccgcaccucccaauacggaucccuagccugguaccaacaacgccccggccaagccccccgacucgucaucuacuccggcuccacccgcgccgccggcaucccagacagauucuccggcucucguuggggagccgacuacaaccucuccaucuccaaccucgaauccggcgacuucggcgucuacuacugccaacaauacgaauucuucggccaaggcaccaaaguccaagucgacaucaaacgcaccgucgcagcaccaucagucuucaucuucccccccucagacgaacaacucaaaucaggcaccgccuccgucgucugccuccucaacaacuucuacccccgagaagccaaaguccaauggaaagucgacaacgcccuccaauccggcaacucccaagaauccgucaccgaacaagacuccaaagacucaaccuacucccucuccuccacccucacccucuccaaagccgacuacgaaaaacacaaagucuacgcaugcgaagucacucaccaaggccucuccucgcccgucaccaaaucauucaaccgaggcgaaugc

SEQ ID NO: 57501 - RNA, 678 nt, Artificial Sequence
  derived and/or modified sequence opt11 from anti-HIV_3TNN_E-Chain
gaaguccagcuagucgaauccggcggcggacucguccaacccggcggcucccuccgccuuuccugcgccgccucaggcuucaccuucuccaccuacgccaugucauggguccgccaagcccccggaaaaggccucgaauggguauccucaaucaacaacuccggccgcaacacuuucuccgccgacuccguaaaaggccgcuucaccaucucccgcgacaacuccaaaaacacccucuuccucgucaugaacucacuccgcgccgaagacaccgccguauacuacugcgccaaagaccuccgacucggcggcggcuccgacuacuggggccaaggcacucucgucaccgucuccuccgccuccaccaaaggccccuccgucuucccacuagcccccuccuccaaauccaccucaggcggcaccgccgcccucggcugccucgucaaagacuacuuccccgaaccagucaccgucuccuggaacucaggagcccucaccuccggcguccacacauucccugccguccuccaauccuccggccuauacucacucuccuccgucgucaccgucccauccuccucacuaggcacccaaacauacauaugcaacgucaaccacaaacccucaaacaccaaagucgacaaacgcguagaacccaaauccugcgacaaaacacac

SEQ ID NO: 57502 - RNA, 705 nt, Artificial Sequence
  derived and/or modified sequence opt11 from anti-HIV_3BQU_B-Chain
cgaaucacccucaaagaauccggcccaccccucgucaaacccacccaaacccuaacccuaaccugcucauucuccggcuucucacucuccgacuucggcgucggcgucggcuggauccgccaaccacccggcaaagcccucgaauggcucgcuaucaucuacucagacgacgacaaacgcuacucccccucccucaacacccgucuaaccaucaccaaagacaccuccaaaaaccaagucguacucgucaugacccgagucucccccgucgacaccgccaccuacuucugcgcccaccgccgcggccccaccacccuauucggcguccccaucgcccgcggacccgucaacgccauggacgucuggggacaaggcaucaccgucaccaucuccuccacuucuaccaaaggccccuccgucuucccccucgcccccuccucaaaauccaccgccggcggcgccgccgcccuaggcugccucgucaaagacuacuucccugaacccguuaccgucuccuggaacuccggcgcccucaccucaggcguccacaccuuucccgccguccuccaauccuccggccucuacucccucuccuccgucgucaccguccccucauccucccucggcacccaaacauacacuugcaacgucaaccacaaacccuccaacaccaaagucgacaaacgcgucgaacccaaaucaugc

SEQ ID NO: 57503 - RNA, 642 nt, Artificial Sequence
  derived and/or modified sequence opt11 from anti-HIV_3BQU_A-Chain
gcccuacaacucacccaaucccccucaucccuauccgccuccgucggagaccgcauaaccaucaccugccgcgccucccaaggcgucaccucagcccucgccugguaccgacaaaaaccuggcucacccccucaacuucucauauacgacgcaucaucacucgaauccggaguccccucuagauucuccggcuccggcucaggcaccgaauucacccucaccaucuccacccuccgccccgaagacuucgccaccuacuacugccaacaacuccacuucuacccccacaccuucggcggcggcacccgcgucgacgucagacgcaccgucgccgcccccuccgucuucauauucccccccucagacgaacaacuaaaauccggcacagccucagucgucugccuccucaacaacuucuacccacgcgaagcaaaaguccaauggaaagucgacaacgcccuccaauccggaaacucccaagaaagcgucaccgaacaagacuccaaagacuccaccuacucccucuccuccacccuaacccucuccaaagccgacuacgaaaaacacaaagucuacgaaugcgaagucacccaccaaggccuauccucacccgucaccaaauccuucaaccgcggcgaaugc

SEQ ID NO: 57504 - RNA, 387 nt, Artificial Sequence
  derived and/or modified sequence opt11 from anti-HIV_IgG_VR-Chain
auggaaacccccgcccaacuccucuuccuccuccuccuauggcuccccgacaccaccggcgaaaucguccucacccaaucccccggaacccucucccucuccgccggcgaacgcgccacccucuccugccgcgccucccaauccgucuccucccgcuaccucgccugguaccaacaaaaacccggccaagcaccccgccuccucaucuacggcgccuccucccgcgccaccggcauccccgaccgcuucuccggcuccggcuccggcaccgacuucacccucaccaucucccgcgucgaacccgaagacuucgccggcuacuacugccaacaauacgacaacucagucugcaccuucggccaaggcaccaaacucgaaaucaaacgc

SEQ ID NO: 57505 - RNA, 348 nt, Artificial Sequence
  derived and/or modified sequence opt11 from anti-HIV_IgG_HeavyChain
augaaacaccucugguucuuccuccuccucgucgccgccccccgcuggguccucucccaaguccaacuccaagaauccggccccggccucgucaaacccuccgaaacccucucccucaccugcaccgucuccggcggcuccaucuccucccacuacugguccuggauccgccaaucccccggcaaaggccuccaauggaucggcuacaucuacuacuccggcuccaccaacuacucccccucccucaaaucccgcgucaccaucuccgucgaaaccuccaaaaaccaauucucccucaaacucaccuccaugaccgccgccgacaccgccgucuacuacugcgcccgc

SEQ ID NO: 57506 - RNA, 714 nt, Artificial Sequence
  derived and/or modified sequence opt11 from anti-HIV_4P9M_HeavyChain
caaauccaccucguccaauccggcacagaagucaaaaaacccggcuccuccgucacagucuccugcaaagccuacggcguaaacaccuucggucucuacgccgucaacuggguccgacaagcccccggccaaucccucgaauacaucggccaaauauggcgcuggaaaucaucagccucccaccacuuccgaggccgcguccucaucuccgccgucgaccucaccggauccuccccccccaucuccucacucgagauaaaaaaccuaaccuccgacgacaccgcagucuacuucugcaccaccaccuccaccuacgacaaaugguccggccuacaccaugacggcgucauggcauucucauccuggggccaaggcacacucaucuccgucuccgccgccucaaccaaaggccccucugucuucccccucgcacccuccuccaaauccaccuccggcggaaccgccgcacucggcugccucgucaaagacuacuuccccgaacccgucacagucuccuggaacuccggagcccucaccuccggcguccacaccuuccccgccgucuuacaauccuccggccucuacucccuauccuccgucgucaccguccccuccuccuccuuaggcacccaaaccuacauauguaacgucaaccacaaacccuccaacaccaaaguagacaaacgagucgaaccuaaaucaugcgacaaaacc

SEQ ID NO: 57507 - RNA, 645 nt, Artificial Sequence
  derived and/or modified sequence opt11 from anti-HIV_4P9M_LightChain
gacauacaaaugacccaaucccccucaacccucuccgccuccaucggcgacaccguccgcaucuccugccgagccucccaauccaucaccggcaacugggucgccugguaccaacaacgccccggcaaagcaccccgacuacucaucuaccgcggcgccgcccuccucggaggcguccccucccgauucucuggcuccgccgccggcacagacuucacccucaccaucggcaaccuacaagccgaagacuucggcaccuucuacugccaacaauacgacaccuaccccggcaccuucggccaaggaacaaaaguagaagucaaacgcaccgucgccgcccccucagucuucaucuucccacccuccgacgaacaacuaaaauccggcaccgccuccgucgucugccuccuaaacaacuucuacccccgcgaagccaaaguccaauggaaaguagacaacgcccuccaauccggcaacucccaagaauccgucaccgaacaagacuccaaagacuccaccuacucccucuccuccacccucacccucucaaaagccgacuacgaaaaacacaaagucuacgccugcgaagucacccaccaaggccucucaucccccgucaccaaauccuucaaccgcggcgaaugc

SEQ ID NO: 57508 - RNA, 558 nt, Artificial Sequence
  derived and/or modified sequence opt11 from anti-HIV_4P9H_C-Chain
aaaaaagucguccuaggcaaaaaaggcgacaccgucgaacucaccugcacggccucccaaaaaaaauccauccaauuccacuggaaaaacucaaaccaaaucaaaauccucgguaaccaaggcagcuuccucaccaaaggccccucaaaacucaacgaccgcgccgacucccgccgcucacucugggaccaaggcaacuucccccucauaauaaaaaaccucaccaucgaagacuccgacaccuacaucugcgaagucgaagaccaaaaagaagaaguccaacuucuagucuucggccucacugcaaacuccgacacccaccuccuacaaggccaaucccucacccucacccucgaauccccccccggcuccucccccuccguccaaugccgcuccccccgcggaaaaaacauccaaggcggcaaaacccucuccgucucacaacucgaacuccaagacuccggcaccuggaccugcaccguccuccaaaaccaaaaaaaagucgaauucaaaaucgacaucgucguccucgccuuccaaaaagccauagacggacgc

SEQ ID NO: 57509 - RNA, 462 nt, Artificial Sequence
  derived and/or modified sequence opt11 from anti-HIV_4YBL_A-Chain
guccccgucuggaaagacgccgacaccacccucuucugcgccuccgacgccaaagcccacgaaaccgaaugccacaacgucugggccacccacgcaugcguccccaccgaccccaacccacaagaaauccaccucgaaaacgucaccgaaaacuucaacauguggaaaaacaacaugguagaacaaaugcaagaagacgucaucucccucugggaccaaugccuccaacccggcggcgcccccaaaaucuccuucgaccccauccccauccacuacugcacccccgccggcuacgucauccucaaaugcaacgacaaaaacuucaacggcaccggacccugcaaaaacgucuccuccguccaaugcacacacggcaucaaacccgucgucuccuccggcggaggcaacaucaaagacaacuggcgcuccgaacucuacaaauacaaagucguccaaaucgaa

SEQ ID NO: 57510 - RNA, 1056 nt, Artificial Sequence
  derived and/or modified sequence opt11 from anti-HIV_4R4N_V-Chain
aucuggaaagacgccaacaccacccuuuucugcgccuccgacgccaaagcauacgacacagaaguacacaacgucugggcaacacacgccugcguacccaccgacccaucaccccaagaacucaaaauggaaaacguuacagaagaauucaacauguggaaaaacaacaugguggaacaaaugcacaccgacaucaucagccuaugggaccaaucacucaaacccugcguccaacuaaccggcggcuccgcacucacccaagccugcccgaaaguaaccuucgaaccaauccccauccacuacugcgcccccgccggcuacgccauccucaaaugcaaugacaaagaauucaacggcacaggacuaugcaaaaacguguccaccguccaaugcacccacggcauaagacccgucgucuccacccaacuccuccucaacggcucccuagccgaaggcaaagucaugauccgcagcgaaaacaucaccaacaacgucaaaaacauaaucgugcaacuaaacgaauccgucacaauaaacugcacccgacccaacaacggaggcucgggcucaggaggagacauccgccaagcccacugcaacgucuccggcucccaauggaacaaaacccugcaccaagucgucgaacaacuccgcaaauacuggaacaacaacaccaucaucuuuaacucauccucaggcggcgaccucgaaaucacaacccacuccuucaacugcggcggggaauucuucuacugcaacaccuccgggcucuucaacuccacauggguuaacggcaccgccuccauugaaaacggcacaaucacccuacccugccgcaucaaacaaaucauaaacauguggcaacgcguaggccaagccaucuacgccccccccauccaaggaguaaucagaugcgucuccaacaucacgggccuaauccucacccgcgacggcggcggaaacucaaacgaaaaugaaaccuucagaccaggcggcggcgacaugcgcgacaacuggcgcagcgaacucuacaaauacaaagucgucaaaaucgaa

SEQ ID NO: 57511 - RNA, 1065 nt, Artificial Sequence
  derived and/or modified sequence opt11 from anti-HIV_4JKP_G-Chain
gucuggaaagacgccgacacaacacucuucugcgccagcgacgccaaagcccacgaaacagaaugccacaacgucugggcgacacacgccugcguccccaccgaccccaacccccaagaaauacaccucgaaaacguaaccgaaaacuucaacauguggaaaaauaacauggucgaacaaaugcaagaagacgucaucucacuaugggaccaaugucuacaacccugcguaaaacucaccggcggcagcgucaucaaacaagccugccccaaaauaucauucgaccccauccccauccacuacugcacccccgccggcuacguaauccucaaaugcaacgacaaaaacuucaacggcaccggccccugcaaaaacgucuccuccguccaaugcacacacggcaucaaaccagucgucuccacccaacuacuacuaaacggcagccucgcagaagaagaaaucaucauccguuccgaaaaccuaaccaacaacgccaaaaccaucaucguacaccucaacaaaucaguggaaaucaacugcacacgcccgucaaacggcggauccggcuccggcggcgacauccgaaaagccuacugcgaaaucaacggaacaaaauggaacaaaguccuaaaacaagucacagaaaaacucaaagaacacuucaacaacaaaaccaucaucuuccaaccccccagcggaggcgaccucgaaaucaccaugcaccacuucaacugccgcggagaauucuucuacugcaacaccacccaacuauucaacaacacgugcauuggcaacgaaacaaugaaaggcugcaacggcaccaucacccuaccaugcaagaucaaacaaaucauaaacauguggcaaggcaccggccaagccauguacgcgccccccaucgacggcaaaaucaacugcguauccaacaucaccggaauccuccuaacccgagacggaggcgccaacaacaccuccaacgaaaccuuccgcccaggcggcggcaauaucaaggacaacuggcgaucugaacucuacaaauacaaagucguccaaaucgaaggcucc

SEQ ID NO: 57512 - RNA, 723 nt, Artificial Sequence
  derived and/or modified sequence opt11 from anti-HIV_3BQU_D-Chain
augggcuggucauggaucuuccucuuccuccucuccggaaccgcuggcguccacucaggcguccaacuccaacaauccggacccgaacuaguaaaacccggcgccuccgucaaaauguccugcaaagccuccggcuacuccuucaccgacuacuucaugcacugggucaaacaaucacacggcaaaucacucgacuggaucggauacaucaacugcuacaccggcgccaccaacuacucacaaaaauucaaaggaaaagccacauucaccgucgacaccuccuccaacaccgcauacaugcaauucaacucucucaccuccgaagacuccgcagucuacuacugcgcccgcaccuccaucggcuacggcuccucccccccuuuccccuacuggggccaaggaacccucgucaccgucuccgcagccaaaaccacaccccccuccgucuacccccucgcacccggcuccgcagcacaaaccaacuccaugguaacacucggcugccucgucaaaggcuacuuccccgaacccgucaccgucacauggaacucaggcagccucuccuccggcguccacaccuuccccgccguacuccaauccgaccucuacacccuauccuccuccgucaccguacccuccuccccucgccccuccgaaaccgucaccugcaacgucgcccacccagcauccuccaccaaagucgacaaaaaaaucgucccccgc

SEQ ID NO: 57513 - RNA, 699 nt, Artificial Sequence
  derived and/or modified sequence opt11 from anti-HIV_3BQU_C-Chain
augaccauguucucccucgcacuccuccucucccuccuucuccuaugcgucuccgacuccggcgcagaaaccacagucacccaaucccccgccucccucuccaugucaauaggcgaaaaagucaccauccgcugcauaaccuccaccgacaucgaugacgacaugaacugguaccaacaaaaacccggcgaacccccacgccuccuaaucuccgacggcaacacacuacgcccaggcguccccucccgcuucucuuccucaggauacggcaccgacuucgucuucaccauagaaaacaugcucuccgaagacgucgccgacuacuacugccuccaaucagacaaccuccccuacaccuucggaggaggaaccaaccuagagauaaaacgcgccgacgcagccccaacaguauccaucuucccacccucauccgaacaacucaccucaggcggcgccuccgucgucugcuuccucaacaacuucuaccccaaagacaucaacgucaaauggaaaaucgacggcuccgaacggcaaaacggcguccuaaacuccuggaccgaccaagacucaaaagacuccaccuacuccauguccuccacccucacccucaccaaagacgaauacgaacgacacaacuccuauaccugcgaagccacccacaaaaccuccacaucccccaucgucaaauccuucaaccga

SEQ ID NO: 57514 - RNA, 333 nt, Artificial Sequence
  derived and/or modified sequence opt11 from anti-HIV_Ig_LightChain
gacgucguccucacccaaucccccgccucccucgccgucucccucggccaacgcgccaccaucuccugcaaagccucccaauccgucgacuacgacggcgacuccuacaugaacugguaccaacaaaaacccggccaaccccccaaacuccucauccacgccgccuccaaccucguauccggcaugcccgcccgauucuccggcuccggcuccggcaccgacuucacccucaacauccaccccgucgaagaagaagacgccgccaccuacuacugccaacaauccaucgaagacccccccaccuucggcggcggcaccaaacucgaaaucaaa

SEQ ID NO: 57515 - RNA, 342 nt, Artificial Sequence
  derived and/or modified sequence opt11 from anti-HIV_Ig_HeavyChain
gacguccaacuccaacaauccggccccggccucgucaaacccucccaaucccucucccacaccugcaccgucaccggcuacuccaucaccuccgacuacgccuggaacuggauccgccaauuccccggcaacaaacucgaauggaugggcuacaucuccuucuccggcuccaccuccuacaaccccucccucaaaucccgcaucuccaucacccgcgacaccuccaaaaaccucuucuuccuccaacuaaacuccgucaccaccgaagacaccgccaccuacuacugcgcccgcggccuccccgacuacuggggccaaggcaccacccucaccgucuccucc

SEQ ID NO: 57516 - RNA, 1083 nt, Artificial Sequence
  derived and/or modified sequence opt11 from anti-HIV_4P9H_G-Chain
gucuggaaagacgccgacacaacccuauucugcgccucagacgccaaagcucacgaaaccgaaugccacaacgucugggccacccacgccugcguccccaccgaccccaacccacaggaaauccaccucgaacaaguaaccgaaaacuucaacauguggaaaaacaacauggucgaacaaaugcaagaagacguaaucucacucugggaccaaugccuacaacccugcguaaaacucaccggcggcucaguaaucaaacaagcaugccccaaaaucucauucgaccccaucccgauccauuacugcacccccgccggcuacgucauccuaaaaugcaacgacaaaaacuucaacggcaccggccccugcaaaaacguaucauccguccaaugcacccacggcauaaaaccagucgucuccacccaacuacuccucaacggcucccuagccgaagaagaaaucauaauccgcuccgaaaaccuaaccaacaacgccaagaccaucaucguccaccuacaaaaauccguagaaaucaacugcaccagacccucaaacggcgguuccggcagcgggggagacauccgaaaagccuacugcgaaauacaaggcacuaaauggaacaaaguccucaaacaagucaccgaaaaacucaaagaacacuucaacaacaaaacaaucauauuccaaccacccuccggcggagaccuggaaaucacaaugcaccacuucaacugccgcggcgaguucuucuacugcaacaccacccaacuauuccaaaauaccugcauaggaaacgaaaccaugaagggcugcaacggcaccaucacccuacccugcaaaauaaaacaaaucauaaacauguggcaaggcaccggccaagccauguacgcacccccgaucgacggcaaaaucaacugcgucucccaaaucacaggcauccuucuaacccgagacggcggcgccaacaacaccucaaacgaaaccuuccgaccaggaggcggcaacauaaaagacaacuggcgcucagaacucuacaaauacaaagucguccaaaucgaaggcagccaccaccaccaccaccac

SEQ ID NO: 57517 - RNA, 147 nt, Artificial Sequence
  derived and/or modified sequence opt11 from anti-HIV_Chain
caagugcaauugguccagagcgggggccagaugaagaaaccgggcgagagcaugcgcauaagcugucgcgcgagcggguacgaguucauagacuguaccuugaacuggaucaggcucgcgcccgggaaaaggcccgaguggaugggc

SEQ ID NO: 57518 - RNA, 180 nt, Artificial Sequence
  derived and/or modified sequence opt11 from anti-HIV_Chain
cccugcugcuucgccuacaucgcccgcccccucccccgcgcccacaucaaagaauacuucuacaccuccggcaaaugcuccaaccccgccgucgucuucgucacccgcaaaaaccgccaagucugcgccaaccccgaaaaaaaauggguccgcgaauacaucaacucccucgaaaugucc

SEQ ID NO: 57519 - RNA, 249 nt, Artificial Sequence
  derived and/or modified sequence opt11 from anti-HIV_Chain
cucgaauggaugggccgcaucauccccgccaucgacgacgucaccuacgcccaaaccuuccgcggccgcgucaccuucuccgccgacaaauucaccaccaccgccuacauggaccucaccggccuccgcuccgaagacaccgccaccuacuucugcgcccgcgacccccaagucaaccgccgcggcaacugcuucgaccacuggggccaaggcacccucgucaccgucuccuccgccuccaccaaaggc

SEQ ID NO: 57520 - RNA, 270 nt, Artificial Sequence
  derived and/or modified sequence opt11 from anti-HIV_Chain
gacgucgucaugacccaauccccccucucccuccccgucacccucggccaacccgccuccaucuccugccgcuccucccaaucccucgucuacucccacggcgacaccuaccucaaaugcuuccaacaacgccccggccaauccccccgccgccccaucuacaaagucuccaaccgcgacuccggcguccccgaccgcuucuccggcuccggcuccggcaccgacuucacccucaaaaucucccgcgucgaagccgaagacgucggcguc

SEQ ID NO: 57521 - RNA, 294 nt, Artificial Sequence
  derived and/or modified sequence opt11 from anti-HIV_Chain
agcucguucgcgaucucaugggugcgccaggccccgggccagggcuuggaauggaugggcgggauaaucccgaucuuugaagcgaccucguacgcgcaaaaguuccaggacaggcucacgaucacgaccgaugaaucgaccacgaccgcguacauggacuugagcucgcucaggagcgaggacacggccguguacuauugcgcgcgcgcgcaaggggacauacucacggaaggguacuuugacuauugggggcaagggaccuuggucacggucucgagcgcgagcacgaaaggg

SEQ ID NO: 57522 - RNA, 297 nt, Artificial Sequence
  derived and/or modified sequence opt11 from anti-HIV_Chain
aacaccuucaccucccacuacguccacuggguccgccaagcccccggccaaggccucgaauggaugggcaugaucaaccccggcggcaccacccgcuacgcccccaaauuccaagaccgagucacccucacccgcgacaccuccacccgcaccgucuacauggaacuccgcucccuccgcuccgaagacaccgccgucuacuacugcgcccgcccccaauacaaccucggccgcgaaccccucaacguauggggccaaggcaccauggucaccgucuccuccgccuccaccaaaggc

SEQ ID NO: 57523 - RNA, 297 nt, Artificial Sequence
  derived and/or modified sequence opt11 from anti-HIV_Chain
auccgcuccuucuacuggcacuggauccgccaaucacccggcaaaggccucgaauggcucggcuccgucuucgacaacggccucaccacccacaaccccucccucaaaucccgccucaccaucuccgaagaccccucacgcaaccaaaucucccucaaacuccgcuccaugaccgccgccgacaccgccgucuacuacugcgcccgcggcgacuacgacauccucaccucauccuaccaauucgacuacuggggccaaggcacccucgucgccgucuccuccgccuccaccaaaggc

SEQ ID NO: 57524 - RNA, 300 nt, Artificial Sequence
  derived and/or modified sequence opt11 from anti-HIV_Chain
caauccgcccucacccaacccgccuucgucuccggcucccccggccaauccaucacccucuccugcacccucggcaccgaagacgucuccugguaccaacaacgccccaacuccgccccccgccucaucaucuucgacgucaaaaaacgccccuccgacgucuccgaccgcuucuccggccacaacuccgacaccgccgccuuccucaccaucuccgaacuccgccccgaagacgaagccgacuacuucugcaccuccuggcccuaccgcuucgaccgcggcaccaaagucgacgucgcc

SEQ ID NO: 57525 - RNA, 300 nt, Artificial Sequence
  derived and/or modified sequence opt11 from anti-HIV_Chain
caauccgcccucacccaacccgccuucgucuccggcucccccggccaauccaucacccucuccugcacccucggcaccgaagacgucuccugguaccaacaacgccccaacuccgccccccgccucaucaucuucgacgucaaaaaacgccccuccgacgucuccgaccgcuucuccggccacaacuccgacaccgccgccuuccucaccaucuccgaacuccgccccgaagacgaagccgaauacuucugcaccuccuggcccuaccgcuucggccgcggcaccaaagucgacgucgcc

SEQ ID NO: 57526 - RNA, 300 nt, Artificial Sequence
  derived and/or modified sequence opt11 from anti-HIV_Chain
caauccgcccucacccaccccgccuucgucuccggcucccccggccaauccaucacccucuccugcacccucggcaccgaagacgucuccugguaccaacaacgccccaacuccgccccccgccucaucaucuucgacguccgcaaacgccccuccgaagucuccgaccgcuucuccggccacaaauccgacaccgccgccuuccucaccaucuccgaccuccgccccgaagacgaagccgaauacuucugcaccuccuggcccuaccgcuucgaccgcggcacccgccucgacgucgcc

SEQ ID NO: 57527 - RNA, 300 nt, Artificial Sequence
  derived and/or modified sequence opt11 from anti-HIV_Chain
caauccguccucacccaacccgccuucgucuccggcucccccggccaauccaucaccaucuccugcaccgucggcaccaccgacgucuccugguaccaacaacgccccaacuccgccccccgccucaucaucuucgacgucaaaaaacgacccuccggcgucuccgaccgcuucuccggcuccucauccgacaacgccgccuuccucaccaucgccggccuccgccccgaagacgaagccgaauacuacugcaccucauggcccuaccgcuucggccgcggcaccaaagucgacgucggc

SEQ ID NO: 57528 - RNA, 300 nt, Artificial Sequence
  derived and/or modified sequence opt11 from anti-HIV_Chain
caauccguccucacccaacccgccuucgucuccgccucccccggccaauccaucacccucuccugcaaccucggcaccgacuacgucuccugguaccaacaacgacccuccuccgccccccgccucaucaucuucgacgucaaaaaccgccccuccggcgucuccgaccgcuucuccggcuacaacuccgacaccgccgccuuccucaccaucuccggccuccaacccgaagacgaagccgaauacuacugcaccuccuggcccuacaacuucggccccggcaccaaagucgacgucacc

SEQ ID NO: 57529 - RNA, 300 nt, Artificial Sequence
  derived and/or modified sequence opt11 from anti-HIV_Chain
caauccguccucacccaacccgccuccgucuccggcucccccggccaauccaucaacaucuccugcgccggccgcuccgaccgcgucuccugguaccaacaacgccccaacggcguccccaaacuccuccucuucgacgucuaccgccgccccuccggagucuccgaccgcuucuccggcucccacuccgacgacaccgccuuccucaccaucuccggccuccaaaccgacgacgaagccgacuacuacugcaccucccaccccuacgccuucggccccggcaccaaagucaacguccuc

SEQ ID NO: 57530 - RNA, 300 nt, Artificial Sequence
  derived and/or modified sequence opt11 from anti-HIV_Chain
caauccguccucacccaacccgccuucgucuccggcucccccggccaauccaucacccucuccugcacccucggcaccgaagacgucuccugguaccaacaacgccccaacuccgccccccgccucaucaucuucgacgucaaaaaacgccccuccgacgucuccgaccgcuucuccggccacaacuccgacaccgccgccuuccucaccaucuccgaacuccgccccgaagacgaagccgaauacuucugcaccuccuggcccuaccgcuucggccgcggcaccaaagucgacgucgcc

SEQ ID NO: 57531 - RNA, 306 nt, Artificial Sequence
  derived and/or modified sequence opt11 from anti-HIV_Chain
caauccgcccucacccaacccgccuccgucuccggcucccccggccaauccaucaccaucuccugcaccgccgacuccgacuacgucuccugguaccaacaacgccccaacuccgcccccaaacucauccucuucgacgucaacucccgccccuccggcgucuccgaccgcuacuccggcucccgcuccggcaacaccgccucccucaccaucuccggccuccaacgcgaagacgaagccgacuacuucugcacccccuggcccuacgacuuccgccccggcacccgcgucuucguccucggccaa

SEQ ID NO: 57532 - RNA, 306 nt, Artificial Sequence
  derived and/or modified sequence opt11 from anti-HIV_Chain
caauccgcccucacccaacccgccuucgucuccggcucccccggccaauccaucacccucuccugcucccucggcaccgccgacgucuccugguaccaacaacgccccaacuccgccccccgccucaucaucuucgacgucaaaaaacgccccuccgacgucuccgaccgcuucuccggccacaacuccgacaccgccgccuucgucaccaucuccgaacuccgccccgaagacgaagccgaauacuucugcaccuccuggcccuaccgcuucggccccggcaccaaagucgacgucgcccgccaa

SEQ ID NO: 57533 - RNA, 306 nt, Artificial Sequence
  derived and/or modified sequence opt11 from anti-HIV_Chain
caauccguccucacccaacccgccuccgucuccggcucccccggccaaaccaucuccaucuccugcuccggcaccuucggcuccgacuccgucuccugguaccaacaauuccccaacuccgcccccacccucaucaucuucgacguccaccgccgccccuccggcaucuccacccgcuucuccggcuccaccuccggcgacaccgccucccucaccaucuccacccuccaccgcgaagacgaagccuucuacuacugcaccucccaccccuacgacuucggcggcggcaccuacgucaucguccuc

SEQ ID NO: 57534 - RNA, 306 nt, Artificial Sequence
  derived and/or modified sequence opt11 from anti-HIV_Chain
caauccguccucacccaacccgccuccgucuccggcucccccggccaaaccaucuccaucuccugcuccggcaccuucggcucagacuccgucuccugguaccaacaauaccccaacuccgcccccacccucaucaucuucgacguccaccgccgccccuccggcaucuccacccgcuucuccggcuccaccuccggcgacaccgccucccucaccaucuccacccuccaccgcgaagacgaagccuacuacuacugcaccucccaccccuacgacuucggcggcggcaccuacgucaucguccuc

SEQ ID NO: 57535 - RNA, 306 nt, Artificial Sequence
  derived and/or modified sequence opt11 from anti-HIV_Chain
caauccgcccucacccaacccgccuccgucuccggcucccccggccaauccaucaacaucuccugcgccggccgcuccgaccgcgucuccugguaccaacaacgccccaacggcguccccaaacuccucauguucgacgucuaccgccgccccuccggcgucuccgaccgauucuccggcucccacuccggcgacaccgccuuccucaccaucuccggccuccaaaccgaagacgaagccgacuacuacugcaccucccaccccuacgccuucggcgccggcaccaaagucaacguccuccgccaa

SEQ ID NO: 57536 - RNA, 306 nt, Artificial Sequence
  derived and/or modified sequence opt11 from anti-HIV_Chain
gacauccaaaugacccaaucccccuccucccucuccgccuccgucggcgaccgcgucuccauccacugccaagccggccaaggcaucggcuccucccucaacugguaccaacaaaaacccggccgcgccccccgccuccucguccacggcgccuccaaccuccaacgcggcguccccucccgcuucuccggcuccggcuuccacaccaccuucacccucaccaucuccucccuccaacccgacgacgucgccaccuacuggugcgccgcccucgaauucuucggccccggcaccaaagucgaaauc

SEQ ID NO: 57537 - RNA, 309 nt, Artificial Sequence
  derived and/or modified sequence opt11 from anti-HIV_Chain
gacauccaaaugacccaaucccccuccucccucuccgccuccgucggcgacaccgucaccaucaccugccaagccaacggcuaccucaacugguaccaacaacgccgcggcaaagcccccaaacuccucaucuacgacggcuccaaacucgaacgcggcguccccucacgcuucuccggccgccgcuggggacaagaauacaaccucaccaucaacaaccuccaaccagaagacaucgccaccuacuucugccaagucuacgaauucgucguccccggcacccgacucgaccucaaacgcaccgucgcc

SEQ ID NO: 57538 - RNA, 309 nt, Artificial Sequence
  derived and/or modified sequence opt11 from anti-HIV_Chain
gacauccaaaugacccaaucccccuccucccucuccgcccgcgucggcgacaccgucaccaucaccugccaagccaacggcuaccucaacugguaccaacaacgccgcggcaaagcccccaaacuacucaucuacgacggcuccaaacucgaacgcggcguccccgcccgcuucuccggccgccgcuggggccaagaauacaaccucaccaucaacaaccuccaacccgaagacgucgccaccuacuucugccaagucuacgaauucaucguccccggcacccgccucgaccucaaacgcaccgucgcc

SEQ ID NO: 57539 - RNA, 309 nt, Artificial Sequence
  derived and/or modified sequence opt11 from anti-HIV_Chain
gacauccaaaugacccaaucccccuccucacucuccgcccgcgucggcgacaccgucaccaucaccugccaagccaacggcuaccucaacugguaccaacaacgccgcggcaaagcccccaaacuccucaucuacgacggcuccaaacucgaacgcggcguccccucccgcuucuccggccgccgcuggggccaagaauacaaccucaccaucaacaaccuccaacccgaagacaucgccaccuacuucugccaagucuacgaauucgccguccccggcacccgccucgaccucaaacgcaccgucgcc

SEQ ID NO: 57540 - RNA, 309 nt, Artificial Sequence
  derived and/or modified sequence opt11 from anti-HIV_Chain
gacauccaaaugacccaaucccccuccucccucuccgccuccgucggcgacaccgucaccaucaccugccaagccaacggcuaccucaacugguaccaacaacgccgcggcaaagcccccaaacuccucaucuacgacggcuccaaacucgaacgcggcguccccucccgauucuccggccgccgcuggggccaagaauacaaccucaccaucaacaaccuccaagccgaagacaucgccaccuacuucugccaagucuacgaauucgccguccccggcacccgccucgaccucaaacgcaccgucgcc

SEQ ID NO: 57541 - RNA, 309 nt, Artificial Sequence
  derived and/or modified sequence opt11 from anti-HIV_Chain
gacauccaaaugacccaaucccccuccucacucuccgccuccgucggcgacaccgucaccaucaccugccaagccaacggcuaccucaacugguaccaacaacgccgcggcaaagcccccaaacuccucaucuacgacggcuccaaacucgaacgcggcguccccucccgcuucuccggccgccgcuggggccaagaauacaaccucaccaucaacaaccuccaacccgaagacaucgccaccuacuucugccaagucuacgaauucaucguccccggcacccgccucgaccucaaacgcaccgucgcc

SEQ ID NO: 57542 - RNA, 309 nt, Artificial Sequence
  derived and/or modified sequence opt11 from anti-HIV_Chain
gacauccaaaugacccaaucccccuccucccucuccgcccgcgucggcgacaccgucaccaucaccugccaagccaacggcuaccucaacugguaccaacaacgccgcggcaaagcccccaaacuccucaucuacgacggcuccaaacucgaaaccggcguccccucccgcuucaccggccgccgcuggggccaagaauacaaccucaccaucaacaaccuccaacccgaagacaucgccaccuacuucugccaagucuacgaauucaucguccccggcacacgccucgaccucaaacgcaccgucgcc

SEQ ID NO: 57543 - RNA, 312 nt, Artificial Sequence
  derived and/or modified sequence opt11 from anti-HIV_Chain
gacauccaaaugacccaaucccccuccucccucuccgccuccgucggcgacaaagucaccaucaccugccaaaccuccgccggcuaccucaacugguaccaacaacgccgcggccgcgcccccaaacuccucauguacgacggcucccgccucgucaccggcguccccucccgcuucuccggccgccgcuggggcacccaauacaaccuaaccaucggcucccuccaacccgaagacgucgccaccuacuacugccaagucuacgaauucuucggccccggcacccgccucgaccucaaacgcaccgucgcc

SEQ ID NO: 57544 - RNA, 312 nt, Artificial Sequence
  derived and/or modified sequence opt11 from anti-HIV_Chain
gacauccaaaugacccaaucccccuccucccucuccgccuccgucggcgacaaagucaccaucaccugccaaaccuccgccggcuaccucaacugguaccaacaacgccgcggccgcgcccccaaacuccucauguacgacggcucccgccucgucaccggcguccccucacgcuucuccggccgccgcuggggcacccaauacaaccucacaaucggcucccuccaacccgaagacaucgccaccuacuacugccaagucuacgaauucuucggccccggcacccgccucgaccucaaauccaccgucgcc

SEQ ID NO: 57545 - RNA, 312 nt, Artificial Sequence
  derived and/or modified sequence opt11 from anti-HIV_Chain
gacauccaaaugacccaaucccccuccucccucuccgcccgcgucggcgacaccgucaccaucaccugccaagccaacggcuaccucaacugguaccaacaacgccgcggcaaagcccccaaacuccucaucuacgacggcuccaaacucgaacgcggcguccccgcccgcuucuccggccgccgcuggggccaagaauacaaccucaccaucaacaaccuccaacccgaagacgucgccaccuacuucugccaagucuacgaauucaucguccccggcacccgccucgaccucaaacgcaccgucgccgcc

SEQ ID NO: 57546 - RNA, 312 nt, Artificial Sequence
  derived and/or modified sequence opt11 from anti-HIV_Chain
ugcacggucucgggcgggagcauaaucucguacuauuggaauuggauacgccagagcccgggcaagggcuuggaauggcucggguacauauucgauggcgggcgcgcgaacuauaacccgagcuugcgcucgcgcuugaccaugagcguggacacgagcaagaaccagaucucgcucaaggucaagagcgugaccgcggccgauagcgcgaucuauuacugugccaggcucgauggcgaggccuuucgcuauuacuuugacucgugggggcaagggaccuuggucacggucucgagcgcgagcacgaaaggg

SEQ ID NO: 57547 - RNA, 312 nt, Artificial Sequence
  derived and/or modified sequence opt11 from anti-HIV_Chain
gucucgggcgggcgcuuuagcaauuacgggcucucgugggugcgccaggccccgggccagggccuggaauggauggggcgcauagucccggccauaaacagggccaaguacgcgcaaaaguuccagggcagggucauacucacggccgauaaaauaaccgauaccgcguacauggaauugcgaucgcucaggagcgaggacacggccauauucuauugcgcgcgcgauccccagaucgagaucaggggcaaugccuuugacauaugggggcaagggaccguggucacggucucgagcgcgagcacgaaaggg

SEQ ID NO: 57548 - RNA, 315 nt, Artificial Sequence
  derived and/or modified sequence opt11 from anti-HIV_Chain
uccgacaucuccgucgcccccggcgaaaccgcccgcaucuccugcggcgaaaaaucccucggcucccgcgccguccaaugguaccaacaccgagccggccaagcccccucccucaucaucuacaacaaccaagaccgccccuccggcauccccgaacgcuucuccggcucccccgacucccccuucggcaccaccgccacccucaccaucaccuccgucgaagccggcgacgaagccgacuacuacugccacaucugggacucccgcguccccaccaaaugggucuucggcggcggcaccacccucaccguccuc

SEQ ID NO: 57549 - RNA, 315 nt, Artificial Sequence
  derived and/or modified sequence opt11 from anti-HIV_Chain
uccuccauguccgucucccccggcgaaaccgccaaaaucuccugcggcaaagaauccaucggcucccgcgccguccaaugguaccaacaaaaauccggccaaccccccucccucaucaucuacaacaaccaagaccgccccuccggcguccccgaacgcuucuccgccacccccgacuucggcgccggcaccaccgccacccucaccaucaccaacgucgaagccgacgacgaagccgacuacuacugccacaucuacgacgcccgcggcggcaccaacugggucuucgaccgcggcgccacccucaccguacuc

SEQ ID NO: 57550 - RNA, 315 nt, Artificial Sequence
  derived and/or modified sequence opt11 from anti-HIV_Chain
ucguucgugagcguggccccgggccagaccgcgcgcauaaccuguggcgaggaaucgcucgggagcaggagcgugaucugguaccagcaaaggcccgggcaagcgcccucgcucauaaucuauaacaauaacgaucgcccgagcgggaucccggaaagguucucgggcucgcccgggagcacguucgggaccacggccacgcucacgaucacgagcguggaagcgggcgaugaagcggacuauuacugucacauaugggauagcaggcgcccaaccaauuggguguucggggaagggaccacgcucacggucuug

SEQ ID NO: 57551 - RNA, 315 nt, Artificial Sequence
  derived and/or modified sequence opt11 from anti-HIV_Chain
uccuucgucuccgucgcccccggccaaaccgcccgcaucaccugcggcgaagaaucccucggcucccgcuccgucaucugguaccaacaacgccccggccaagcccccucccucaucauguacaacaaccacgaccgccccuccggcauccccgaacgcuucuccggcucccccggcuccaccuucggcaccaccgccacccucaccaucaccuccgucgaagccggcgacgaagccgacuacuacugccacaucugggacucccgccgccccaccaacugggucuucggcgaaggcaccacccuaaccguccuc

SEQ ID NO: 57552 - RNA, 315 nt, Artificial Sequence
  derived and/or modified sequence opt11 from anti-HIV_Chain
gacauccaaaugacccaaucccccuccucccucuccgccuccgucggcgacaaagucaccaucaccugccaaaccuccgccggcuaccucaacugguaccaacaacgccgcggccgcgcccccaaacuccucauguacgacggcucccgccucgucaccggcguccccucccgcuucuccggccgccgcuggggcacccaauacaaccucaccaucggcucccuccaacccgaagacaucgccaccuacuacugccaagucuacgaauucuucggccccggcacccgccucgaccucaaauccaccgucgccgcc

SEQ ID NO: 57553 - RNA, 315 nt, Artificial Sequence
  derived and/or modified sequence opt11 from anti-HIV_Chain
gacauccaaaugacccaaucccccucaucccucuccgccuccgucggcgaccgcgucuccaucaacugccaagccggccaaggccucggcuccucccucaacugguaccaacaaaaacccggccgcgcccccaaacuccucguccacggcgccuccaaccuccaacgcggcguccccucccgcuucuccggauccggcuuccacaccaccuucacccucaccaucuccucccuccaacccgacgacgucgccaccuacuucugcgccgccuuccaaugguucggccccggcaccaaagucgaaaucaaacgcacc

SEQ ID NO: 57554 - RNA, 318 nt, Artificial Sequence
  derived and/or modified sequence opt11 from anti-HIV_Chain
ugcaccgucuccggcggcuccaucuccuccgccggcuacuacuggaccuggauccgccaacaccccggcaaaggccucgaauucaucggcuacaucuacuacaucggcaccaccuacuacaaccccucccucaaaucccgccucaccaucuccaucgacaccuccaaaaaccaauucucccucaaacucuccuccgucaccgccgccgacaccgccaucuacuacugcgcccgcgacuacaccgcccgcggccgccacuucuucgacuacuggggccaaggcgcccucgucaccgucuccuccgccuccaccaaaggc

SEQ ID NO: 57555 - RNA, 321 nt, Artificial Sequence
  derived and/or modified sequence opt11 from anti-HIV_Chain
ucgagccugcccuugagccuggccccgggcgcgaccgcgaaaauacccuguggcgagaaaucgcgcgggagcagggccgugcaaugguaccagcaaaagcccgggcaagcgcccacgcucauaaucuauaacaaccaagaucgcccggccggggucucggaaagguacucgggcaaucccgaugucgcgaucggagucacggccacgcucacgaucucgcgcguggaagcgggcgaugaagcggaauauuacugucacuauugggauagcaggagcccgaucucguggguauucgggggcuggacccagcucacggucuug

SEQ ID NO: 57556 - RNA, 321 nt, Artificial Sequence
  derived and/or modified sequence opt11 from anti-HIV_Chain
uccucccucccccucuccgucgcccccggcgccaccgccaaaauagccugcggcgaaaaauccuucgccucccgcgccguccaaugguaccaacaaaaacccggccaagcccccguccucaucaucuacaacaaccaagaccgccccgccggcgucuccgaacgcuucuccggcacccccgacgucggcuucggcuccaccgccacccucaccaucucccgcgucgaagccggcgacgaagccgacuacuacugccacaaaugggacucccgcuccccccucuccugggucuucggcggcggcacccaacucaccguccuc

SEQ ID NO: 57557 - RNA, 321 nt, Artificial Sequence
  derived and/or modified sequence opt11 from anti-HIV_Chain
gacauccaaaugacccaaucacccucaucccucuccgccuccaucggcgaccgcgucaccaucaccugccgcgccucccaagacaucgccaacuaccucaacugguaccaaaaaaaauccggcaccccccccaaacuccucaucuucgccgccaccaaccuccaccgcggcgucuccccccgcuucaccggcuccggccacggcacccacuucucccucaccaucaccaacguccaacacgaagacuucggcaacuacuucugccaacaauccuucgccaccgucggcuccuucggccaaggcaccugggucgacauccgc

SEQ ID NO: 57558 - RNA, 321 nt, Artificial Sequence
  derived and/or modified sequence opt11 from anti-HIV_Chain
gacauccaaaugacccaaucccccuccucccucuccgccuccaucggcgaccgcgucaccaucaccugccgcgccucccaagacaucgccaacuaccucaacugguaccaaaaaaaauccggcaccccccccaaacuccucaucuucgccgccaccaaccuccaccgcggcgucuccccccgcuucaccggcuccggccacggcacccacuucucccucaccaucaccaacguccaacacgaagacuucggccacuacuucugccaacaauccuucgccaccgucggcuccuucggccaaggcaccugggucgacauccgc

SEQ ID NO: 57559 - RNA, 321 nt, Artificial Sequence
  derived and/or modified sequence opt11 from anti-HIV_Chain
gacauccaaaugacccaaucccccuccucccucuccgccuccgucggcgaccgcgucaccaucaccugccgcgccucccaagacaucgccaacuaccucaacugguaccaaaaaaaauccggcaccccccccaaacuccucaucuucgccgccaccaaccuccaccgcggcgucuccccccgcuucuccggcuccggcuccggcacccacuucucccucaccaucaccaacguccaauacgaagacuucgccaacuacuucugccaacacuccuucggcaccaucggcaccuucggccaaggcaccugggucgacauccgc

SEQ ID NO: 57560 - RNA, 321 nt, Artificial Sequence
  derived and/or modified sequence opt11 from anti-HIV_Chain
gacauccaaaugacccaaucccccuccucccucuccgccuccaucggcgaccgcgucaccaucaccugccgcgccucccaagacaucgccaacuaccucaacugguaccaaaaaaaauccggcaccccccccaaacuccucaucuucggcgcaaccaaccuccaccacggcgucuccccccgcuucuccggcuccggccacggcacccacuucucccucaccaucaccaacguccaacacgaagacuucgccaacuacuucugccaacaauccuuccaaaccgucggcuccuucggccaaggcaccugggucgacauccgc

SEQ ID NO: 57561 - RNA, 321 nt, Artificial Sequence
  derived and/or modified sequence opt11 from anti-HIV_Chain
gagaucgugcuaacgcaaucgcccgcgaccuugagcuugagcccgggcgagaccgcgaucauaagcugucgcacgagccagagcgggagcuuggccugguaccagcaaaggcccgggcaagcgcccaggcucgugaucuauagcgggagcacgcgcgcggccgggaucccggacagguucucgggcucgcgcuggggcgcggacuauaacuugagcauaagcaaucucgagagcggggacuuuggcguguacuauugccagcaauaugaauuuuucgggcaagggaccaagguccaggucgauaucaagcgcacggucgcg

SEQ ID NO: 57562 - RNA, 321 nt, Artificial Sequence
  derived and/or modified sequence opt11 from anti-HIV_Chain
gacauccaaaugacccaaucccccuccucacucuccgccuccaucggcgaccgcgucaacaucaccugccaagccucccgcgacaccggcuccgcccucaacugguaccaacaaaaagucggccgccccccccgccuccucaucuccgccgucuccaaccucggcgccggcguccccucccgcuucuccggccgccgcuccggcacccaauccacccucaccaucaacacccuccaacccgaagacaucgccaccuacuucugccaacacuacgaauucuucggccccggcaccaaagucgacaucaaacgcaccgucgcc

SEQ ID NO: 57563 - RNA, 321 nt, Artificial Sequence
  derived and/or modified sequence opt11 from anti-HIV_Chain
gacauccaaaugacccaaucccccuccucccucuccgccuccgucggcgaccgcgucaccaucaccugccaagccggccaaggcaucggcuccucccuccaaugguaccaacaaaaacccggcaaagcccccaaacuccucguccacggcgccuccaaccuccaccgcggcguccccucccgauucuccggcuccggcuuccacaccaccuucucccucaccaucuccggccuccaacgcgacgacuucgcaaccuacuucugcgccguccucgaauucuucggccccggcaccaaagucgaaaucaaacgcaccgucgcc

SEQ ID NO: 57564 - RNA, 324 nt, Artificial Sequence
  derived and/or modified sequence opt11 from anti-HIV_Chain
uccuacguccgcccccucuccgucgcccucggcgaaaccgccuccaucuccugcggccgccaagcccucggcucacgcgccguccaaugguaccaacaccgccccggccaagcccccauccuccucaucuacaacaaccaagaccgccccuccggcauccccgaacgcuucuccggcacccccgacaucaacuucggcacccgcgccacccucaccaucuccggcgucgaagccggcgacgaagccgacuacuacugccacaugugggacucccgcuccggcuucuccugguccuucggcggcgccacccgccucaccguccuc

SEQ ID NO: 57565 - RNA, 324 nt, Artificial Sequence
  derived and/or modified sequence opt11 from anti-HIV_LightChain
gacauccucaugacccaaucccccucccuccucuccgccuccgucggcgaccgcgucaccaucaccugcaaagccucccaagacgucuccaccgccgucgccugguaccaacaaaaacccggcaaagcccccaaacuccucaucuacugggccuccacccgccacaccggcguccccucccgcuucaccggcuccggcuccggcaccgacuucacccucaccaucucccgccuccaagccgaagacuucgcccucuacuacugccaacaacacuacaccacccccuggaccuucggcggcggcaccaaagucgaaaucaaacgc

SEQ ID NO: 57566 - RNA, 324 nt, Artificial Sequence
  derived and/or modified sequence opt11 from anti-HIV_LightChain
gacaucgucaugacccaaucccccucccuccucuccgccuccgucggcgaccgcgucaccaucaccugcaaagccucccaagacgucuccaccgccgucgccugguaccaacaaaaacccggcaaagcccccaaacuccucaucuacugggccuccacccgccacaccggcguccccucccgauucucaggcuccggcuccggcaccgacuucacccucaccaucuccucccuccaacccgaagacuucgcccucuacuacugccaacaacacuacaccacccccuggaccuucggcggcggcaccaaagucgaaaucaaacgc

SEQ ID NO: 57567 - RNA, 324 nt, Artificial Sequence
  derived and/or modified sequence opt11 from anti-HIV_Chain
gacauccaaaugacccaaucacccuccucccucuccgccuccgucggcgacaccgucaccaucaacugccaaaccaacaaaggcuaccucaacugguaccaacaacgccgcggccgcgcccccaaacuccucauguacgacggcuccaaacucgucaccggcguccccucccgcuucuccggccgccgcuggggcacccaauacaaccucaccaucggcucccuccaacccgaagacaucgccaccuacuacugccaagucuacgaauucuucggccccggcacccgccucgaccuaaaacgaaccgucgcagcccccuccgac

SEQ ID NO: 57568 - RNA, 333 nt, Artificial Sequence
  derived and/or modified sequence opt11 from anti-HIV_Chain
cucuccgccuacgucggcgaccgcgucaccauaaccugccgcgccucccaaaacaucaacaccuaccucaacugguaccaacaacgccccggcaaagcccccaaacuccucaucuacgccgccuccacccuccaauccggcguccccucccgcuucuccggcuccggcuccggcaccgacuucacccucaccaucuccaaccucgaaaccgaagacuucgccgucuacuacugccaacaaaccuacuccuccgucaccuucggccaaggcaccaaacuagaaacccgccgcaccguagccgcccccuccgucuucaucuucccccccuccgac

SEQ ID NO: 57569 - RNA, 333 nt, Artificial Sequence
  derived and/or modified sequence opt11 from anti-HIV_Chain
gaaaucguccucacccaaucccccgccacccucucccucucacccggcgaacgcgccacccucuccugccgcgccucccaaggcgucaacuucgucgucugguaccaacaaaaacgcggccaagccccccgccuccucaucuacggcaacucagaccgcguccccggcguccccgaccgcuucuccgcccgcggcuccggcaccgaauucucccucgucaucuccuccgucgaacccgacgacuucgcccucuacuacugccaagaauacuccuccacccccuacaacuucggccccggcacccgcgucgaccgcaaacgcaccgucgccgcc

SEQ ID NO: 57570 - RNA, 336 nt, Artificial Sequence
  derived and/or modified sequence opt11 from anti-HIV_HeavyChain
gaagucaaacuagaagaauccggcggcggccucguccaacccggcggcucccgcaaacucuccugcgccgccuccggcuucaccuucuccuccuucggcaugcacuggguccgccaagcccccgaaaaaggccucgaaugggucgccuacaucuccuccggcuccuccacccuccacuacgccgacaccgucaaaggccgcuucaccaucucccgcgacaaccccaaaaacacccucuuccuccaaaugaaacuccccucccucugcuacggccuccucggcucccgcaaccucucccaccgccuccucucccaaaacgacacccccaucugccuc

SEQ ID NO: 57571 - RNA, 336 nt, Artificial Sequence
  derived and/or modified sequence opt11 from anti-HIV_Chain
gagaucgugcucacacaaucgcccgcgaccuugagcuugagcccgggcgagcgcgcgaccuugagcugucgcgcgagccagggcgugaacuuugucgugugguaucaacagaaaaggggccaggccccgcgcuugcucauauacgggcccucggacagggccccgggcgugcccgaucgcuuuagcgcacgcgggagcgggaccgaguucucgcucgugaucucaagcguggaaccggacgauuucgcgcucuauuacugucaagaguacucgagcacgcccuauaacuuuggcacgggcacgcgcguggacaggaaaaggaccguggccgcgccc

SEQ ID NO: 57572 - RNA, 336 nt, Artificial Sequence
  derived and/or modified sequence opt11 from anti-HIV_Chain
caaacccucucccucaccugcuccgucuccggcggcuccaucuccuccgccggcuacuacuggggcuggauccgccaacaccccggcaaaggccucgaauggaucggccacaucuacuacuccggcaacaccaacuacaaccccucccucaaaucccgccucuccauguccgucgaaaccuccaaaaaccaauucucccucaaccucgccuccgucaccgccgccgacaccgccgucuacuucugcgcccgagacuacuccgccgccggccgccaccucuucgacuccuggggccaaggcauccucgucaccgucuccuccgccuccaccaaaggc

SEQ ID NO: 57573 - RNA, 336 nt, Artificial Sequence
  derived and/or modified sequence opt11 from anti-HIV_LightChain
gacaucgucaugacccaacaaaccccccucacccucuccaucaccaucggccaacccgccuccaucuccugcaaauccucccaaucccuccucgacuccgacggcaaaaccuaccucaacuggcuccuccaacgccccggccaaucccccaaacgccuuaucuacuggauguccaaacucgacuccggcguccccgaccgcuucaccggcuccggcuccggcaccgacuucacccucaaaaucucccgcgucgaagccgaagaccuaggcgucuacuacugcuggcaaggcacccacuuccccuggaccuucggcggcggcaccaaacucgaacuc

SEQ ID NO: 57574 - RNA, 339 nt, Artificial Sequence
  derived and/or modified sequence opt11 from anti-HIV_LightChain
gacaucgucaucacccaauccaccaaauucauguccaccucagucggcgaccgcgucuccaucaccugcaaagccucccaagacgucuccaccgccgucgccugguaccaacaaaaacccggccaaucccccaaacuccucaucuacugggccuccacccgccacaccggcguccccgaccgcuucaccggcuccggcuccggcaccgacuacacccucaccaucucccgcguccaagccgaagaccucgcccucuacuacugccaacaacacuacaccacccccuggaccuucggcggcggcaccaaacucgaaaucaaacgcaccgucgccgccccc

SEQ ID NO: 57575 - RNA, 339 nt, Artificial Sequence
  derived and/or modified sequence opt11 from anti-HIV_Chain
gacauccaaaugacccaaucccccuccucacucuccgcccgcgucggcgacaccgucaccuucaccugccaagccaacggcuaccucaacugguaccaacaacgccgcggcaaagcccccaaacuccucaucuacgacggcuccaaacucgaacgcggcguccccucccgcuucuccggccgucgcuggggccaagaauacaaccucaccaucaacaaccuccaacccgaagacaucgccaccuacuucugccaagucuacgaauucgccguccccggcacccgccuagaccucaaacgaaccgucgccgcccccuccgucuucaucuuccccuccgac

SEQ ID NO: 57576 - RNA, 339 nt, Artificial Sequence
  derived and/or modified sequence opt11 from anti-HIV_Chain
caauccguccucacccaacccgccuccgucuccggcucccccggccaauccaucaccaucuccugcaccggcaccaacuccgacgucggcuacuccuacgucuccugguuccaacaacaccccggcaaaguccccaaacuccucaucuacgacgucucacgccgcuccucaggcgucuccaaccgcuucuccggcucccgcuccggcaacaccgccucccucaccaucuccggccuccgcgccgaagacgaagccgacuacuacugcggcuccuucaccaccucccucacccucgucuucggcggcggcaccaaacucgccguccucgucucccccucc

SEQ ID NO: 57577 - RNA, 339 nt, Artificial Sequence
  derived and/or modified sequence opt11 from anti-HIV_Chain
ucccucuccgccuccgucggcgaccgcgucaccaucaccugccgcgccuccgaauccaucuccuucuaccucaacugguaccaacaaaaacccggcaaagcccccgaacuccucaucuucgccaccucaacccuccacuccggcguccccucccgcuucuccggcuccggcuccggcaccgacuucacccucaccaucuccucccuacaacucgaagacuucgccaccuacuacugccaacaauccuccuccacccccuucaccuucggcggcggcaccaaagucgaaaucaaacgcaccgucgccgcccccuccgucuucaucuucccccccucagac

SEQ ID NO: 57578 - RNA, 342 nt, Artificial Sequence
  derived and/or modified sequence opt11 from anti-HIV_Chain
gacauccaaaugacccaaucccccuccucccucuccgccuccgucggcgacaccgucaccaucaccugccaagccaacggcuaccucaacugguaccaacaacgccgcggaaaagcccccaaacuccucaucuacgacggcuccaaacucgaacgcggcguccccucccgcuucuccggccgccgcuggggccaagaauacaaccucaccaucaacaaccuccaacccgaagacaucgccaccuacuucugccaagucuacgaauucaucguccccggcacccgccucgaccucaaacgcaccgucgccgcccccuccgucuucaucuucccccccuccgac

SEQ ID NO: 57579 - RNA, 342 nt, Artificial Sequence
  derived and/or modified sequence opt11 from anti-HIV_Chain
gacauccaaaugacccaaucccccuccucacucuccgcccgcgucggcgacaccgucaccaucaccugccaagccaacggcuaccucaacugguaccaacaacgccgcggcaaagcacccaaacuccucaucuacgacggcucaaaacucgaacgcggcguccccucccgcuucuccggccgccgcuggggccaagaauacaaccucaccaucaacaaccuccaacccgaagacaucgccaccuacuucugccaagucuacgaauucgccguccccggcacccgccucgaccucaaacgcaccgucgccgcccccuccgucuucaucuucccccccuccgac

SEQ ID NO: 57580 - RNA, 342 nt, Artificial Sequence
  derived and/or modified sequence opt11 from anti-HIV_Chain
gacauccaaaugacccaaucccccuccucccucuccgcccgagucggcgacaccgucaccaucaccugccaagccaacggcuaccucaacugguaccaacaacgccgcggcaaagcccccaaacuccucaucuacgacggcuccaaacucgaacgcggcguccccucccgcuucuccggccgccgcuggggccaagaauacaaccucaccaucaacaaccuccaacccgaagacaucgccaccuacuucugccaagucuacgaauucgucguccccggcacccgccucgaccucaaacgcaccgucgccgcccccuccgucuucaucuucccccccuccgac

SEQ ID NO: 57581 - RNA, 342 nt, Artificial Sequence
  derived and/or modified sequence opt11 from anti-HIV_Chain
gacauccaaaugacccaaucccccuccucccucuccgcccgcgucggcgacaccgucaccuucaccugccaagccaacggcuaccucaacugguaccaacaacgccgcggcaaagcccccaaacuccucaucuacgacggcuccaaacucgaacgcggcguccccucccgcuucuccggccgccgcuggggccaagaauacaaccuaaccaucaacaaccuccaacccgaagacaucgccaccuacuucugccaagucuacgaauucgccguccccggcacccgacucgaccucaaacgcaccgucgccgcccccuccgucuucaucuucccccccuccgac

SEQ ID NO: 57582 - RNA, 342 nt, Artificial Sequence
  derived and/or modified sequence opt11 from anti-HIV_Chain
gacauccaaaugacccaaucccccuccucccucuccgccuccgucggcgacaccgucaccaucaccugccaagccaacggcuaccucaacugguaccaacaacgccgcggcaaagcccccaaacuccucauguacgacggcuccacccucgaacgcggcguacccgcccgcuucuccggccgccgcuggggccaagaauacaaccucaccauaaacaaccuccaacccgaagacgucgccaccuacuucugccaagucuacgaauucaucguccccggcacccgccucgaccucaaacgcaccgucgccgcccccuccgucuucaucuucccccccuccgac

SEQ ID NO: 57583 - RNA, 342 nt, Artificial Sequence
  derived and/or modified sequence opt11 from anti-HIV_Chain
gacauccaaaugacccaaucccccuccucccucuccgccuccgucggcgacaccgucaccaucaccugccaagccaacggcuaccucaacugguaccaacaacgccgcggcaaagcccccaaacuacucaucuacgacggcuccaaacucgaacgaggcguccccucccgauucuccggccgccgcuggggccaagaauacaaccuaaccaucaacaaccuccaagccgaagacaucgccaccuacuucugccaagucuacgaauucgccguccccggcacccgccucgaccucaaacgcaccgucgccgcccccuccgucuucaucuucccccccuccgac

SEQ ID NO: 57584 - RNA, 342 nt, Artificial Sequence
  derived and/or modified sequence opt11 from anti-HIV_Chain
gacauccaaaugacccaaucccccucaucccucuccgccuccgucggcgacaccgucaccuucaccugccaagccaacggcuaccucaacugguaccaacaacgccgcggcaaagcccccaaacuccucaucuacgacggcucccgccucgaacgcggcguccccucccgcuucuccggccgccgcuggggccaagaauacaaccucaccaucaacaaccuccaacccgaagacaucgccaccuacuucugccaagucuacgaauucgccguccccggcacccgccucgaccucaaacgcaccgucgccgcccccucugucuucaucuucccccccuccgac

SEQ ID NO: 57585 - RNA, 342 nt, Artificial Sequence
  derived and/or modified sequence opt11 from anti-HIV_Chain
gacauccaaaugacccacucccccuccucccucuccgccuccgucggcgacaccgucaccaucaccugccaagccaacggcuaccucaacugguaccaacaacgccgcggcaaagcccccaaacuccucaucuacgacggcuccaaacucgaaaccggcguccccucccgcuucaccggccgccgcuggggccaagaauacaaccuaaccaucaacaaccuccaacccgaagacaucgccacauacuucugccaagucuacgaauucaucguccccggcacccgccucgaccucaaacgcaccgucgccgcccccuccgucuucaucuucccccccuccgac

SEQ ID NO: 57586 - RNA, 342 nt, Artificial Sequence
  derived and/or modified sequence opt11 from anti-HIV_Chain
gacauccaaaugacccaaucccccuccucccucuccgcccgcgucggcgacaccgucaccaucaccugccaagccaacggcuaccucaacugguaccaacaacgccgcggcaaagcccccaaacuccucaucuacgacggcuccaaacucgaaaccggcguccccucccgcuucaccggccgccgcuggggccaagaauacaaccucaccaucaacaaccuccaacccgaagacaucgccaccuacuucugccaagucuacgaauucaucguccccggcacccgccucgaccucaaacgcaccgucgccgcccccuccgucuucaucuucccccccuccgac

SEQ ID NO: 57587 - RNA, 342 nt, Artificial Sequence
  derived and/or modified sequence opt11 from anti-HIV_Chain
gacauccaaaugacccaaucccccuccucacucuccgcccgcgucggcgacaccgucaccuucaccugccaagccaacggcuaccucaacugguaccaacaacgccgcggcaaagcccccaaacuccuaaucuacgacggcuccaaacucgaacgcggcgucccaucccgcuucuccggccgcggcuggggccaagaauacaaccucaccaucaacaaccuccaacccgaagacaucgccaccuacuucugccaagucuacgaauucgccguccccggcacccgccucgaccucaaacgcaccgucgccgcccccuccgucuucaucuucccccccuccgac

SEQ ID NO: 57588 - RNA, 342 nt, Artificial Sequence
  derived and/or modified sequence opt11 from anti-HIV_Chain
gacauccaaaugacccaaucccccuccucccucucagccuccgucggcgacaccgucaccaucaccugccaagccaacggcuaccucaacugguaccaacaacgccgcggcaaagcccccaaacuccucaucuacgacggcuccaaacucgaacgcggcguccccucccgcuucucaggccgccgcuggggccaagaauacaaccucaccaucaacaaccuccaacccgaagacaucgccaccuacuucugccaagucuacgaauucgucguccccggcacccgccucgaccucaaacgcaccguagccgcccccuccgucuucaucuucccccccuccgac

SEQ ID NO: 57589 - RNA, 342 nt, Artificial Sequence
  derived and/or modified sequence opt11 from anti-HIV_Chain
ucccaauccgucgucacccaagaacccucccucaccgucucccccggcggaaccgucacccucaccugcggccccuccaccggcgccgucaccuccggcuucuacccccacugguuccaacaaaaacccggccaagccccccgcgcccucaucuacuccaccuccaacaaauacuccuggaccccagcccgcuucuccggcucccuccucggcggcaaagccguccucacccucuccgacguccaacccgacgacgaagccgaauacuacugccuccuccuccucuacuacggcggccccuggaucuucggcggcggcaccaaacucaccguccucgucucc

SEQ ID NO: 57590 - RNA, 345 nt, Artificial Sequence
  derived and/or modified sequence opt11 from anti-HIV_Chain
gacauccaaaugacccaaucccccuccucccucuccgccuccgucggagacaaagucaccaucaccugccaaaccuccgccggcuaccuaaacugguaccaacaacgccgcggccgcgcccccaaacuccucauguacgacggcucccgccucgucaccggcguccccucccgcuucuccggccgccgcuggggcacccaauacaaccucaccaucggcucccuccaacccgaagacgucgccaccuacuacugccaagucuacgaauucuucggccccggcacccgccucgaccucaaacgcaccgucgccgcccccuccgucuucaucuucccccccucagac

SEQ ID NO: 57591 - RNA, 345 nt, Artificial Sequence
  derived and/or modified sequence opt11 from anti-HIV_Chain
gacauccaaaugacccaaucccccuccucccucuccgccuccgucggcgacaccgucaccaucaccugccaaaccaccaaaggcuaccucaacugguaccaacaacgccgcggccgcgcccccaaacuccucauguucgacggcuccaaacucgucaccggcguccccucccgcuucuccggccgccgcuggggcacccaauacaaccucaccaucggcucccuccaacccgaagaccucgccaccuacuacugccaagucuacgaauucuucggccccggcacccgccucgaccucaaacgcaccgucgccgcccccuccgucuucaucuucccccccuccgac

SEQ ID NO: 57592 - RNA, 345 nt, Artificial Sequence
  derived and/or modified sequence opt11 from anti-HIV_Chain
gacauccaaaugacccaaucccccuccucccucuccgccuccgucggcgacaccgucaccaucaccugccaaaccaacaaaggcuaccucaacugguaccaacaacgccgcggccgcgcccccaaacuccucaugugcgacggcuccaaacucgucaccggcguccccucccgcuucuccggccgccgcuggggaacccaauacaaccucaccaucggcucccuccaacccgaagacaucgccaccuacuacugccaagucuacgaauucuucggccccggcacccgccucgaccucaaacgcaccgucgccgcccccuccgucuucaucuucccccccuccgac

SEQ ID NO: 57593 - RNA, 345 nt, Artificial Sequence
  derived and/or modified sequence opt11 from anti-HIV_Chain
gacauccaaaugacccaaucccccuccucccucuccgcccgcgucggcgacaaagucaccaucaccugccaaaccuccgccggcuaccucaacugguaccaacaacgccgcggccgcgccccaaaacuccucauguacgacggcucccgccucgucaccggcguccccucccgcuucuccggccgccgcuggggcacccaauacaaccucaccaucggcucccuccaacccgaagacaucgccaccuacuacugccaagucuacgaauucuucggccccggcacccgccuagaccucaaacgcacagucgccgcccccuccgucuucaucuucccccccuccgac

SEQ ID NO: 57594 - RNA, 345 nt, Artificial Sequence
  derived and/or modified sequence opt11 from anti-HIV_Chain
gacauccaaaugacccaaucccccuccucccucuccgccuccgucggcgacaccgucaccaucaccugccaaaccaacaaaggcuaccucaacugguaccaacaaaaacgcggccgcgcccccaaacuccucauguacgacggcuccaaacucgucacaggcguccccucccgccucuccggccgccgcuggggcacccaauacaaccucaccaucggcucccuccaacccgaagacaucgccaccuacuacugccaagucuacgaauucuucggccccggcacccgccucgaccuaaaacgcaccgucgccgcccccuccgucuucaucuucccccccuccgac

SEQ ID NO: 57595 - RNA, 345 nt, Artificial Sequence
  derived and/or modified sequence opt11 from anti-HIV_Chain
gacauccaaaugacccaaucccccuccucccucuccgccuccgucggcgacaccgucaccaucaccugccaaaccaacaaaggcuaccucaacugguaccaacaacgccgcggccgagcccccaaacuccucauguacgacggcuccaaacucgucaccggcguccccucccgccucuccggccgccgcuggggcacccaauacaaccucaccaucggcucccuccaacccgaagacaucgccaccuacuacugccaagucuacgaauucuucggccccggcacccgccucgaccucaaacgcaccgucgccgcccccuccgucuucaucuucccccccuccgac

SEQ ID NO: 57596 - RNA, 345 nt, Artificial Sequence
  derived and/or modified sequence opt11 from anti-HIV_Chain
gacauccaaaugacccaaucccccuccucccucuccgccuccgucggcgacaccgucaccaucacaugccacaccaacaaaggcuaccucaacugguaccaacaacgccgcggccgcgcccccaaacuccucauguucgacggcuccaaacucgucaccggcguccccucccgcuucuccggccgccgcuggggcacccaauacaaccuaaccaucggcucccuccaacccgaagacaucgccaccuacuacugccaagucuacgaagucuucggccccggcacccgccucgaccucaaacgcaccgucgccgcccccuccgucuucaucuucccacccuccgac

SEQ ID NO: 57597 - RNA, 345 nt, Artificial Sequence
  derived and/or modified sequence opt11 from anti-HIV_Chain
gacauccaaaugacccaaucccccuccucccuauccgcauccgucggcgacaccgucaccaucaacugccaaaccaacaaaggcuaccucaacugguaccaacaacgccgcggccgcgcccccaaacuccucauguacgacggcuccaaacucgucaccggcguccccucccgcuucuccggccgccgcuggggcacccaauacaaccucaccaucggcucccuccaacccgaagacaucgccaccuacuacugccaagucuacgaauucuucggccccggcacccgccucgaccucaaacgcaccgucgccgcccccucagucuucaucuucccccccuccgac

SEQ ID NO: 57598 - RNA, 345 nt, Artificial Sequence
  derived and/or modified sequence opt11 from anti-HIV_Chain
gacauccaaaugacccaaucccccuccucccucuccgcccgcgucggcgacaaagucaccaucaccuaccaaaccuccgccggcuaccucaacugguaccaacaacgccgcggccgcgcccccaaacuccucauguacgacggcucccgccucgucaccggcgcccccucccgcuucuccggccgccgcuggggcacccaauacaaccucacaaucggcucccuccaacccgaagacaucgccaccuacuacugccaagucuacgaauucuucggccccggcacacgccucgaccucaaacgcaccgucgccgcccccuccgucuucaucuucccccccuccgac

SEQ ID NO: 57599 - RNA, 345 nt, Artificial Sequence
  derived and/or modified sequence opt11 from anti-HIV_Chain
gacauccaaaugacccaaucccccuccucccucuccgccuccgucggcgacaccgucaccaucaccugccaaaccaacaaaggcuaccucaacugguaccaacaacgccgcggccgcgcccccaaacuccucauguacgacggcuccaaacucgucaccggcguccccucacgcuucuccggccgccgcuggggcacccaauacaaccucaccaucggcucccuccaacccgaagacaucgccaccuacuacugccaagucuacgaauucuucggccccggcacccgccucgaccucaaacgcaccgucgccgcccccuccgucuucaucuucccccccuccgac

SEQ ID NO: 57600 - RNA, 345 nt, Artificial Sequence
  derived and/or modified sequence opt11 from anti-HIV_Chain
gucacccucucccucucccccggcgaacgcgccacccucuccugccgcgccucccaaaccaucuccaacaacuaccucgccugguaccaacaaaaacccggccaagccccccgccuccucaucuacggcgccuccuccggcgccaccggccuccccgaccgcuucuccggcuccggcuccggcaccgacuucacccucaccaucucccgccucgaacccgaagacuucgccgucuacuacugccaccaauacgcccucucccccuggaccuucggccgaggcaccaaagucgaaaucaaacgcaccgucgccgcacccuccgucuucaucuucccccccuccgac

SEQ ID NO: 57601 - RNA, 345 nt, Artificial Sequence
  derived and/or modified sequence opt11 from anti-HIV_Chain
acccucuccgccuccgucggcgaccgcgucaccaucaccugccgcgccucccaauccaucaacaacuaccucaacugguaccaacaaaaacccggcaaagcccccaaacuccucaucuacgccgccuccucccuccaaucaggcguccccucccgcuucuccggcuccggcuccggcaccgacuucacccucaccaucuccucccuccaacccgaagacuucgucaccuacuacugccaacaaaccuacuccaacccccgcauguucggccaaggcaccaaagucgaaaucaaacgcaccgucgccgcccccuccgucuucaucuucccccccuccgacgaacaa

SEQ ID NO: 57602 - RNA, 345 nt, Artificial Sequence
  derived and/or modified sequence opt11 from anti-HIV_Chain
caauccgcacucacccaagcccccuccgccuccggcacccccggccaacgcgucaccaucuccugcuccggcggcggcuccaacaucggcggcaaccucgucuccugguaccaacacuuccccggcgccgcccccaaacuccucaucuaccgcaacgaccaacgccccuccggcguccccgaccgcuucuccgccuccaaauccggcaccuccgccucccucgccaucuccggccuccgcuccgacgacgaagccaccuacuucugcgccgccuacgacuccacccucucccuccgccucuucggcggcggcaccacccucgccguccucucccaacccaaagcc

SEQ ID NO: 57603 - RNA, 345 nt, Artificial Sequence
  derived and/or modified sequence opt11 from anti-HIV_Chain
aaacccucccaaacccucucccucaccugcaccguauccggcggcuccaucuccuccgccggcuacuacuggaccuggauccgccaccaccccggcaaaggccucgaauucaucggcuacaucuaccacaucggcacccccuacuacaaccccucacucaaaucccgccucaccaucuccaucgacaccuccaaaaaccaauucucccucaaacucuccuccgucaccgccgccgacaccgccaucuacuacugcgcccgcgacuacaccgcccgaggccgacacuucuucgacuacuggggccaaggcgcccucgucaccgucuccuccgccuccaccaaaggc

SEQ ID NO: 57604 - RNA, 345 nt, Artificial Sequence
  derived and/or modified sequence opt11 from anti-HIV_Chain
cccuccgaaacccucucccucaccugccgcgucuccggcgccucuaucuccaacuucuacuggaccuggauccgccaacccgccggcaaaggccuagaauggaucggccgccuauacuccuccgacaaaaccaacuacaaccccucccucaacggccgcgucaccaugucccucgacaccuccaaaaaccaauucucccuccgccucaccuccaugaccgacgccgacaccgccaucuacuacugcgcccgcgaaaaaggccaaugggucacccucccccccuacuacuucgacuccuggggccaaggcauccucgucaccgucuccuccgccuccaccaaaggc

SEQ ID NO: 57605 - RNA, 348 nt, Artificial Sequence
  derived and/or modified sequence opt11 from anti-HIV_Chain
ggccccgccacccucuccgucucccccggcgaacgcgccacccucuccugccgcgccucccaaucccuccgcaacaaccucgccugguaccaacaaaaaaccggccaauccccccgccuccucaucuacgccgucuccacccgcgccaccggcauccccccccgcuucuccggcggcggcuccggcaccgaauucacccucaccaucgacucacuccaauccgaagacuucgccgucuacuucugccaacaauacgacucaccccaauggaccuucggccaaggcaccaaagucgaaaucaaacgcaccgucgcagcccccuccgucuucaucuucccccccuccgac

SEQ ID NO: 57606 - RNA, 348 nt, Artificial Sequence
  derived and/or modified sequence opt11 from anti-HIV_Chain
gcccccgucacccucuccgccuccgucggcgacaccguaaccaucaccugccgcgccucccaacccaucgccaccuuccucaacugguaccaacacaaacccggccaagcccccaaacuccucaucuacgccgccuccaccuuccaacgcggcgcccccucccgcuacucaggcuccggcuccggcaccgacuucacccucaccaucaacucccuacaacccgaagaccuagccaccuacuacugccaacaaaccuucaccgaccccgucaccuucggccaaggcacccgccucgaaaucaaacgcaccgucgccgcccccuccgucuucaucuucccccccuccgac

SEQ ID NO: 57607 - RNA, 351 nt, Artificial Sequence
  derived and/or modified sequence opt11 from anti-HIV_LightChain
gacauccaaaugacccaaucccccuccacccucuccgccuccaucggcgacaccguccgcaucuccugccgcgccucccaauccaucaccggcggcuggcucgccugguaccaccaacgccccggcaaagccccccgccuacucaucuaccgcggcucccgccuccucggcggcguccccucccgcuucuccggcuccgccgccggcaccgacuucacccucaccaucgccaaccuccaagccgaagacuucggcaccuucuacugccaacaauacgacaccuaccccggcaccuucggccaaggcaccaaagucgaagucaaacgcaccgucgccgcccccuccgucuuc

SEQ ID NO: 57608 - RNA, 351 nt, Artificial Sequence
  derived and/or modified sequence opt11 from anti-HIV_LightChain
gacauccaaaugacccaaucccccuccacccuauccgccuccaucggcgacaccguccgcaucuccugccgcgccucccaauccaucaccggcaacugggucgccugguaccaacaacgccccggcaaagccccccgccuccucaucuaccgcggcgccgcccuccucggcggcguccccucccgcuucuccggcuccgccgccggcaccgacuucacccucaccaucggcaaccuccaaaccgaagacuucggcaccuucuacugccaacaauacgacaccuaccccggcaccuucggccaaggcaccaaagucgaagucaaacgcaccgucgccgcccccuccgucuuc

SEQ ID NO: 57609 - RNA, 351 nt, Artificial Sequence
  derived and/or modified sequence opt11 from anti-HIV_LightChain
gacauccaaaugacccaaucccccuccacccucuccgccuccaucggcgacaccguccgcaucuccugccgcgccucccaauccaucaccggcaacugggucgccugguaccaacaacgccccggcaaagcaccccgccuccucaucuaccgcggcgccgcccuacucggcggcguccccucccgcuuccgcggauccgccgccggcaccgacuucacccucaccaucggcaaccuccaagccgaagacuucggcaccuucuacugccaacaauacgacaccuaccccggcaccuucggccaaggcaccaaagucgaagucaaacgcaccgucgccgcccccuccgucuuc

SEQ ID NO: 57610 - RNA, 351 nt, Artificial Sequence
  derived and/or modified sequence opt11 from anti-HIV_LightChain
gacauccaaaugacccaaucacccuccacccuauccgccucagucggcgacaccguccgcauauccugccgcgccucccaauccaucaccggcggcuggcucgccugguaccaccaacgccccggcaaagccccccgccuccucaucuaccgcggcucccgccuccucggcggcguccccucacgcuucuccggcuccgccgccggcaccgacuucacccucaccaucgccaaccuccaagccgaagacuucggcaccuucuacugccaacaauacgacaccuaccccggcaccuucggccaaggcaccaaagucgaagucaaacgcaccgucgccgcccccucagucuuc

SEQ ID NO: 57611 - RNA, 351 nt, Artificial Sequence
  derived and/or modified sequence opt11 from anti-HIV_LightChain
gacauccaaaugacccaaucccccuccacccucuccgccuccaucggcgacaccguccgcaucuccugccgcgccucccaauccaucaccggaaacugggucgccugguaccaacaacgccccggcaaagccccccgccuccucaucuaccgcggcgccgcccuccucggcggcguccccucccgcuucuccggcuccgccgccggcaccgacuucacccucaccaucggcaaccuccaagccgaagacuucggcaccuucuacugccaacaauacgacaccuaccccggcaccuucggccaaggcaccaaagucgaagucaaacgcaccgucgccgcccccuccgucuuc

SEQ ID NO: 57612 - RNA, 351 nt, Artificial Sequence
  derived and/or modified sequence opt11 from anti-HIV_LightChain
gacauccaaaugacccaaucccccuccacccucuccgccuccaucggcgacaccguccgcaucuccugccgcgccucccaauccaucaccggcggcugggucgccugguaccaccaacgccccggcaaagccccccgccuccucaucuaccgcggcucacgccuccucggcggcguccccucccgcuucuccggcuccgccgccggcaccgacuucacccucaccaucggcaaccuccaagccgaagacuucggcaccuucuacugccaacaauacgacaccuaccccggcaccuucggccaaggcaccaaagucgaagucaaacgcaccgucgccgcccccuccgucuuc

SEQ ID NO: 57613 - RNA, 351 nt, Artificial Sequence
  derived and/or modified sequence opt11 from anti-HIV_LightChain
gacauccaaaugacccaaucccccuccacccucuccgccuccgucggcgacaccguccgcaucuccugccgcgccucccaauccaucaccggcggcuggcucgccugguaccaccaacgccccggcaaagccccccgccuccucaucuaccgcggcucccgccuccucggcggcguccccucccgcuucuccggcuccgccgccggcaccggcuucacccucaccaucgccaaccuccaagccgaagacuucggcacauucuacugccaacaauacgacaccuaccccggcaccuucggccaaggcaccaaagucgaagucaaacgcaccgucgccgcccccuccgucuuc

SEQ ID NO: 57614 - RNA, 351 nt, Artificial Sequence
  derived and/or modified sequence opt11 from anti-HIV_LightChain
gacauccaaaugacccaaucccccuccacccucuccgccuccgucggcggcaccguccgcaucuccugccgcgccucccaauccaucaccggaggcuggcucgccugguaccaccaacgccccggcaaagcccccagacuccuaaucuaccgcggcucccgccuccucggcggcguccccucccgcuucuccggcuccgccgccggcaccgacuucacccucaccaucgccaaccuccaagccgaagacuucggcaccuucuacugccaacaauacgacaccuaccccggcaccuucggccaaggcaccaaagucgaagucaaacgcaccgucgccgcccccuccgucuuc

SEQ ID NO: 57615 - RNA, 351 nt, Artificial Sequence
  derived and/or modified sequence opt11 from anti-HIV_LightChain
gacauccaaaugacccaaucacccucaacccuaagcgccagcauaggcgacaccguccgcauaagcugccgcgcaagccaaagcauaaccggcaacugggucgcaugguaccaccaacgcccaggcaaagccccacgccuacucauauacagaggcgcagcccuacucggcggcguacccucacgcuucagcggaagcgcagccggaaccgacuucacacucacaaucggaaaccuacaagccgaagacuucggaaccuucuacugccaacaauacgacaccuaccccggaacauucggccaaggcacaaaaguagaaguaaaaagaaccgucgccgcacccucagucuuc

SEQ ID NO: 57616 - RNA, 351 nt, Artificial Sequence
  derived and/or modified sequence opt11 from anti-HIV_LightChain
gacauccaaaugacccaaucacccuccacccucuccgccuccaucggcgacaccgucaugaucuccugccgcgccucccaauccaucaccggcggcuggcucgccugguaccaccaacgccccggcaaagccccccgccuccucaucuaccgcggcuccaaacuccucggcggcguccccucacgcuucuccggcuccgccgccggcaccggcuucacccucaccaucggcaaccuccaagccgaagacuucggcaccuucuacugccaacaauacgacaccuaccccggcaccuucggccaaggcaccaaagucgaaguaaaacgcaccgucgccgcccccuccgucuuc

SEQ ID NO: 57617 - RNA, 351 nt, Artificial Sequence
  derived and/or modified sequence opt11 from anti-HIV_LightChain
gacauccaaaugacacaaucacccucaacccuaagcgcaagcguaggcgacaccguacgcauaagcugccgcgcaagccaaagcauaaccggaggcuggcucgcaugguaccaccaacgcccaggcaaagccccacgccuacucauauacagaggcucccgccuacucggaggcguacccucacgcuucagcggaagcgcagccggcgccgacuucacacucacaaucgcaaaccuacaagcagaagacuucggaaccuucuacugccaacaauacgacaccuaccccggaaccuucggccaaggcacaaaaguagaaguaaaaagaaccguagccgcacccucagucuuc

SEQ ID NO: 57618 - RNA, 351 nt, Artificial Sequence
  derived and/or modified sequence opt11 from anti-HIV_LightChain
gacauccaaaugacccaaucccccuccacccucuccgccuccaucggcgacaccguccgcaucuccugccgcgccucccaauccaucaccggcggcuggcucgccugguaccaccaacgccccggcaaagccccccgccuccucaucuaccgcggcucccgccucgucggcggcguacccucccgcuucuccggcuccgccgccggcaccgacuucacccucaccaucggcaaccuccaagccgaagacuucggcaccuucuacugccaacaauacgacaccuaccccggcaccuucggccaaggcaccaaagucgaagucaaacgcaccgucgccgcccccuccgucuuc

SEQ ID NO: 57619 - RNA, 351 nt, Artificial Sequence
  derived and/or modified sequence opt11 from anti-HIV_LightChain
gacauccaaaugacccaaucccccuccacccucuccgcauccaucggcgacaccguccgcaucuccugccgcgccucccaauccaucaccggcggcuggcucgccugguaccaccaacgccccggcaaagcaccccgccuccucaucuaccgcggcucccgccuccuaggcggcguccccuccaaauucuccggcuccgccgccggcaccgacuucacccucaccaucgccaaccuccaagccgaagacuucggcaccuucuacugccaacaauacgacaccuaccccggcaccuucggccaaggcaccaaagucgaagucaaacgaaccgucgccgcccccuccgucuuc

SEQ ID NO: 57620 - RNA, 351 nt, Artificial Sequence
  derived and/or modified sequence opt11 from anti-HIV_LightChain
gacauccaaaugacccaaucccccuccacccucuccgccuccaccggcgacaccguccgcaucuccugccgcgccucccaauccaucaccggcaacugggucgccugguaccaacaacgccccggcaaagccccacgccuccucaucuaccgcggcgcagcccuccucggcggcguccccucccgcuuccgcggcuccgccgccggcaccgacuucacccucaccaucggcaaccuccaagccgaagacuucggcaccuucuacugccaacaauacgacaccuaccccggcaccuucggccaaggcaccaaagucgaagucaaacgcaccgucgccgcccccuccgucuuc

SEQ ID NO: 57621 - RNA, 351 nt, Artificial Sequence
  derived and/or modified sequence opt11 from anti-HIV_LightChain
gacauccaaaugacccaaucccccuccacccucuccgccuccaucggcgacaccguccgcaucuccugccgcgccucccaauccaucaccggcaacuggcucgccugguaccaccaacgccccggcaaagccccccgccuccucaucuaccgcggcucccgccuccucggcggcguacccucccgcuucuccggcuccgccgccggcaccgacuucacccucaccaucgccaaccuccaagccgaagacuucggcacauucuacugccaacaauacgacaccuaccccggcaccuucggccaaggcaccaaagucgaagucaaacgcaccgucgccgcccccuccgucuuc

SEQ ID NO: 57622 - RNA, 351 nt, Artificial Sequence
  derived and/or modified sequence opt11 from anti-HIV_Chain
aucauccucuuccucgucgccaccgccaccggcucaugggcccaauccgcccucacccaaccccgcuccgucuccggcucccuaggccaauccgucaccaucuccugcaccggcuccuccuccgacgucggccgcuacaacuacgucuccugguaccaacaccaccccggcaaagcccccaaacucaugaucuccgacgucaacaaacgccccuccggcguccccgaccgcuucuccggcuccaaauccggcaacaccgccucccucaccaucucaggccuccaagccgaagacgaaaccgacuacuacugcugcuccuacgccggcucauacaucugggucuucggcggc

SEQ ID NO: 57623 - RNA, 351 nt, Artificial Sequence
  derived and/or modified sequence opt11 from anti-HIV_Chain
cccgucacccucuccgccuccgucggcgaccgcgucaccaucaccugccgcgccuccgaagacaucuccaaauaccucaacugguaccaacacaaacccggcaaagcccccaaacuccucaucuacaccgccuccucccucgaaaccggcguccccucccgcuucuccggcuccggcuccggcaccgacuucucccucaccaucuccucccuccaacccgacgacuucgccaccuacuacugccaacaauccuacaccuccuccgucaccuucggccaaggcacccgagucgaagucaaacgcaccgucgccgcccccuccgucuucaucuucccccccuccgacgaacaa

SEQ ID NO: 57624 - RNA, 351 nt, Artificial Sequence
  derived and/or modified sequence opt11 from anti-HIV_Chain
guggaggaacccgggagcucgguaaaggucucgugcaaggccucgggcgggagcucgaccgcguacggguacucgugggugcgccaggccccgggccagggcuuugaauggauggggcgcauaaucccguucuauggcauaaucacguacgcgcccaaguuccagggcagggucacgaucacagccgaucgcucgaccucgaccguguacauggaauugaccaggcucacguucgcggacacggccuuguucuuuugcgcgcgcgauuacggggacccgcgcaauggcuauuacuuugacucaugggaucaagggcucuggcucacggucucgagcgcgagcacgaaaggg

SEQ ID NO: 57625 - RNA, 351 nt, Artificial Sequence
  derived and/or modified sequence opt11 from anti-HIV_Chain
caaguccgccuagaacaauccggcgccgccguccgcacccccggcgccuccgucacccucuccugccaagccuccggcuacaaauucgucaacuacaucauccacuggguccgccaacgccccggccucgccuucgaaugggucggcaugaucgaccccuaccgcggccgccccugguccgcccacuccuucgaaggccgccucucccucucacgcgacgucuccauggaaauccucuacaugacccucaccucccuccgcuccgacgacaccgccaccuacuucugcgcccgcgccgaagccgaaucccaaucccacucccgccccaucaucuccaccuccggcgcccgc

SEQ ID NO: 57626 - RNA, 351 nt, Artificial Sequence
  derived and/or modified sequence opt11 from anti-HIV_Chain
guccaccucgaaguccaacuccaacaaucaggccccgaacucaaaaaacccggcgaaaccgucaaaaucuccugcaaagccuccgucuacaccuucaccgaauaccccauccacugggucaaacaagcacccggcaaaggcuucaaauggaugggcuggaucaacaccuacuccggcgaacccaccuacgccgacgacuucaaaggccgcuucgccuucucccucgaaaccuccgccuccaccgccuaccuacaaaucaacucccucaaaaacgaagacaccgccaccuacuucugcgccucccucggccgcgacuacuggggccaaggccaaggcacaacccucaccguc

SEQ ID NO: 57627 - RNA, 354 nt, Artificial Sequence
  derived and/or modified sequence opt11 from anti-HIV_Chain
cucucagucucccucggcgaacgcgccaccaucaacugcaaauccucccaauccauccucuacuccuccgacaaaaaaaacuaccucgccugguaccaacaaaaaaucggccaaccccccaaacuccuccucuacugggccuccacccgcgaauccggaauccccgaccgcuucuccggcuccggcuccggcuccgacuucacccucaccaucuccucccuacaacccgaagacgucgccgucuacuacugccaacaauacuacaucucccccuucaccuucggccccggcacaaaagucgaccucaaacgcaccgucgccgcccccuccgucuucaucuucccccccuccgac

SEQ ID NO: 57628 - RNA, 354 nt, Artificial Sequence
  derived and/or modified sequence opt11 from anti-HIV_Chain
caauccguccucacccaaccacccuccgccuccggcgcccccggccaacgcgucaccaucuccugcuccggcggccccuccaacgucggcggcaacuacgucuacugguaccgccaauuccccggcaccgcccccaaacuccucauccuccgcgacgaccaacgacccuccggcguccccgaccgcuucuccgccuccaaauccggcaacuccgccucccucgccaucuccggccuccgccccgacgacgaagccuucuacuucugcgccaccuacgacuccgacggcuccauccgccucuucggcggcggaaccgcccucaccguccucucccaacccaaagccgcccccucc

SEQ ID NO: 57629 - RNA, 354 nt, Artificial Sequence
  derived and/or modified sequence opt11 from anti-HIV_Chain
aaagcccccgccacccucucccucucccccggcgaacgcgccacccucuccugccgcgccucccaauccgucggcuccgaccucgccugguaccaacaaaaacccggccaagccccccgacuccucaucuacgacgccuccaaccgcgccaccgccauaccagcccgauucuccggcuccggcuccggcaccgacuucacccucuccaucuccucccucgaacccgaagacuucgccguauacuucugccaacaacgauacgacaaaaucaccuucggccaaggcacccgccucgaaauccaacgcaccgucgccgcccccuccgucuucaucuucccccccuccgacgaacaa

SEQ ID NO: 57630 - RNA, 354 nt, Artificial Sequence
  derived and/or modified sequence opt11 from anti-HIV_Chain
caaguccaacucguccaauccggcgccgaagccaaacgccccggcgacucagucaaagucuccugcaaagccuccggcuacaccuucaccgaauacuacauccacuggguccgccaaacccccggccaaggcuucgaauggaugggcaucaucacccccggcgccggcaacaccaccuacgcccaaaaauuccaaggccgcaucaccgucacccgcgacaccuccgccgccaccgucuacauggaacucuccaaccucaccuccgaagacaccgccgucuacuucugcucacgcggagucuccuucuggggccaaggcacccuagucaccgucucauccgccuccaccaaaggc

SEQ ID NO: 57631 - RNA, 354 nt, Artificial Sequence
  derived and/or modified sequence opt11 from anti-HIV_HeavyChain
gaagugaaacugcaacagagcggggccgagcucgugcgcccgggcgcgagcgugaaaaugagcuguaaagcgagcggguacagguucacgagcuauaacaugcacugggucaagcaaacgcccaggcaagggcucgaguggauaggcgcgaucuaucccgggaacggggacacgagcuauaaccagaaauuuaaagggaaagcgaccuugaccguggacaagagcucgagcacggccuauaugcagcucucgagcuugaccucggaagauagcgcggucuauuucugugccaggggcaggcucucgcucggguucgauuacuggggccagggcucgaccuugaccgugagcucg

SEQ ID NO: 57632 - RNA, 357 nt, Artificial Sequence
  derived and/or modified sequence opt11 from anti-HIV_Chain
caaguccaacucguccaauccggcaccgccgucaaacgccccggcgccuccguccgcgucuccugccaagccuccggcuacaccuucaucgaccacuucaucuacugguggcgccaagcccccggccaaggccucgaauggcucggcuggaucaacccccucaccucccaacccuccuaccccucacgcuuccaaggccgccucacccucacccgcgacaccuucgacgaaaugcucuacauggaccuccgcggccuccgcuccgacgacaccggcaucuacuucugcgcccgccgccacuccgacuacugcgacuucgacaucuggggcuccggcacccaaaucaucgucuccucc

SEQ ID NO: 57633 - RNA, 357 nt, Artificial Sequence
  derived and/or modified sequence opt11 from anti-HIV_Chain
caaguccaacucguccaauccggcaccgccgucaaacgccccggcgccuccguccgcgucuccugccaagccuccggcuacaccuucaccgacuacuucaucuacugguggcgccaagcccccggccaaggccucgaauggcucggcuggaucaacccccucaccucacaacccuccuaccccucccgcuuccaaggccgccuaacccucacccgcgacaccuucgacgaaaugcucuacauggaccuccgcggccuccgcuccgacgacaccggcaucuacuucugcgcccgccgccacuccgacuacugcgacuucgacaucuggggcuccggcacccaaaucaucgucuccucc

SEQ ID NO: 57634 - RNA, 357 nt, Artificial Sequence
  derived and/or modified sequence opt11 from anti-HIV_Chain
caauccguccucacccaaccccgcuccgucuccggcucccccggccaauccgucaccaucuccugcaccggcaccuccuccgacgucggcggcuacaacuacgucuccugguaccaacaacaccccggcaaagcccccaaaaccaugaucuucgacgucaccaaacgccccuccggcguccccgaccgcuucuccggcuccaaauccggcaacaccgccucccucaccaucuccggccuccaagccgaagacgaagccgacuacuacugcuccuccuacgccggccgcaacaccuucuacgucuucggcaccggcaccaccgucaccguccaagucucccccucccaaccccccccc

SEQ ID NO: 57635 - RNA, 357 nt, Artificial Sequence
  derived and/or modified sequence opt11 from anti-HIV_Chain
gaaaucguccucacccaaucccccggcacccucucccucucccccggcgaacgcgccacccucuccugccgcgccucccaaucagucuccuccaacuaccucgccugguaccaacaaaaacccggccaagccccccgccuccucaucuacggcgccuccucccgcgccaccggcauccccgaccgcuucuccggcuccggcuccggcaccgacuucacccucuccaucucacgccucgaacccgaagacuucgccgucuacuacugccaacaauacggcaccuccuccugcaccuucggccaaggaaccaaacucgaaaucaaacgcaccgucgccgcccccuccgucuucaucuuc

SEQ ID NO: 57636 - RNA, 357 nt, Artificial Sequence
  derived and/or modified sequence opt11 from anti-HIV_Chain
cuauccgccuccgucggcgaccgcgucaccaucaccugccgcgccucccaaucaaucgaccgcuaccucaacugguaccaacaaaaacccggcaaagcccccaaacuccucaucuacgccgccuccucccuccacaccgacguccccucccgauucuccggcuccggcgccggcaccuacuucacccuaaccaucaccucccuacaacccgaagacuucgccaccuacuacugccaacaaucccacucccccuccuucggccaagaauccuacuccaucaccuucggccaaggcacccgccucgaaaucaaacgaaccgucgccgcccccuccgucuucaucuucccccccuccgac

SEQ ID NO: 57637 - RNA, 357 nt, Artificial Sequence
  derived and/or modified sequence opt11 from anti-HIV_Chain
aacuucaugcucacacaagcccccuccgccuccggcgcccccggccaacgcgucaccaucuccugcuccggcggccccuccaacgucggcggcaacuacgucuacugguaccgccaauaccccggcaccgcccccaaacuccucauccuccgcgacgaccaacgacccuccggcguccccgaccgcuucuccgccuccaaauccggcaacuccgcaucccucgccaucuccgaacuccgccccgacgacgaagccuucuacuucugcgccaccuacgacuccgacggcuccauccgccucuucggcggcggcaccgcccucaccguccucucccaacccaaagccgcccccuccguc

SEQ ID NO: 57638 - RNA, 360 nt, Artificial Sequence
  derived and/or modified sequence opt11 from anti-HIV_Chain
gacauccaaaugacccaaucccccuccucccucuccgccuccaucggcgaccgcgucaacaucaccugccaagccucccgcgacaccggcuccgcccucaacugguaccaacaaaaagucggccgccccccccgacuccucaucuccgccgucuccaaccucggcgccggcguccccucccgcuucuccggccgccgcuccggcacccaauccacccucaccaucaacacccuccaacccgaagacaucgccaccuacuucugccaacacuacgaauucuucggacccggcaccaaagucgacaucaaacgcaccgucgccgcccccuccgucuucaucuucccccccuccgacgaacaa

SEQ ID NO: 57639 - RNA, 360 nt, Artificial Sequence
  derived and/or modified sequence opt11 from anti-HIV_Chain
caauccguccucacccaacccgccuccgucuccggcucccccggacaauccaucaccaucuccugcaccggcaccuccaacgacgucggcggccaaaacuucgucuccugguaccaacaacaccccggcaccgccccccaacuccucaucuacgacgucaccaaccgccccgccggcgucuccucccgcuucuccggcuccaaauccggcaacaccgccucccucaccaucuccggccuccgcaccgaagacgaagccgacuacuacugcgccuccuucaccauccuaaacggcgucgacuacgucuucggcaccggcaccaaagucaccguccuccucucccccucccaacccuaccuc

SEQ ID NO: 57640 - RNA, 360 nt, Artificial Sequence
  derived and/or modified sequence opt11 from anti-HIV_Chain
aacuucaugcucacccaacccgccuccgucuccggcucccccggccaauccaucacccucuccugcaccggcaccaccuccgacguccgcgacuccaacuucgucuccugguaccaacaaguccccggcaaagcccccaaacucaucaucuacgacgucuccgcccgacccuccggcgucuccuuccgcuucuccggcuccaaauccggcaacaccgccucccucaccaucuccggccuccaagccgaagacgaagcccucuacuacugcuccuccuucacccccaccaacacccucgucuucggcggcggcaccaaacuaaccguccucggccaacccaaagccgcccccuccgucacc

SEQ ID NO: 57641 - RNA, 360 nt, Artificial Sequence
  derived and/or modified sequence opt11 from anti-HIV_Chain
caauccgcccucacccaaccccccgccgccuccggcgcccccggccaacgagucaccaucuccugcuccggcggcggcuccaacgucggcggcaaccucgucuccugguaccaacaauuccccggcgccgcccccaaacuuauccuccaccgcgacggccaacgccccuccggcguccccgaccgcuucuccgccuccaaauccggcaccuccgccucccucaccaucuccggccuccgcuccgacgacgaagccaccuacuucugcgccgccuacgacuccgccgucucccuccccgucuucggcggcggcaccaaacucaccguacucucccaacccaaagccgccccccucgucacc

SEQ ID NO: 57642 - RNA, 360 nt, Artificial Sequence
  derived and/or modified sequence opt11 from anti-HIV_Chain
caacuaguccucacccaaccccccuccgucuccggaacccccggccaaaacgucaccaucuccugcuccggcggcggcucccacgucggcggcaaccucgucuccugguaccaacacuuccccggcgccgcccccaaacuccucauccaccgcgacaaccaacgccccuccggcguccccgaccgcuucuccgcccucaaauccggcaacuccgccucccucgccaucuccggccuccgcuccgacgacgaagccuucuacuucugcgccgucuacgacuccucccucucccucggccucuucggcggcggcaccaaacucaccguccucucccaacccaaagccgcccccuccgucacc

SEQ ID NO: 57643 - RNA, 360 nt, Artificial Sequence
  derived and/or modified sequence opt11 from anti-HIV_Chain
gacauccaaaugacccaaucacccuccucccucuccgccuccgucggcgaccgcgucuccauccacugccaagccggccaaggcaucggcuccucccucaaaugguaccaacaaaaauccggccgcgccccccgccuccucguccacggcgccucaaaccuccaacgcggcguccccucccgcuucuccggcuccggcuuccacaccaccuucacccucaccaucuccucccuccaaccagacgacgucgccaccuacuggugcgccguccucgaauucuucggccccggcaccaaagucgaaaucaaacgcaccgucgccgcccccuccgucuucaucuucccccccuccgacgaacaa

SEQ ID NO: 57644 - RNA, 360 nt, Artificial Sequence
  derived and/or modified sequence opt11 from anti-HIV_Chain
gacauccaaaugacccaaucccccuccucccucuccgccuccgucggcgaccgugucaccaucaccugccaagccucccaaggcaucggcuccucccuccaaugguaccaacaaaaacccggccgagcccccaaacuccucguccacggcgccuccaaccuccaccgcggcguccccucccgcuucuccggcuccggcuuccacaccuccuucacccucaccaucuccucccuccaacccgacgacgucgccaccuacuucugcgccguccucgaauucuucggccccggcaccaaagucgaaaucaaacgcaccgucgccgcccccuccgucuucaucuucccccccuccgacgaacaa

SEQ ID NO: 57645 - RNA, 360 nt, Artificial Sequence
  derived and/or modified sequence opt11 from anti-HIV_Chain
gacauccaaaugacccaaucccccuccucccucuccgccucagucggcgaccgcgucuccaucaacugccaagccggccaaggcaucggcuccucccucaacugguaccaacaaaaacgcggcaaagcccccaaacuccucguccacggcgccuccacccuccaacgcggcguccccucccgcuucuccggcuccggcuuccacaccaccuucacccucaccaucuccucccuccaacccgacgacgucgccaccuacuucugcgaauccuuccaaugguucggccccggcaccaaagucgaaaucaaacgcaccgucgcagcccccuccgucuucaucuucccccccuccgacgaacaa

SEQ ID NO: 57646 - RNA, 360 nt, Artificial Sequence
  derived and/or modified sequence opt11 from anti-HIV_Chain
uacauccaaaugacccaaucccccuccucccucuccgccuccaucggcgaccgcgucaccaucacaugccaagcaggccaaggcaucggcuccucccucaacugguaccaacaaaaacccggcaaagcccccaaacuccucguccacggcgccuccaaccuccaacgcggcgucuccucccgcuucuccggcuccggcuuccacaccaccuucacccucaccaucuccucccuccgacccgaagacgucggcaccuacuucugcgaagucuacgaauucaucggccccggcaccaaagucgacaucaaacgcaccgucgccgcccccuccgucuucaucuucccccccuccgacgaacaa

SEQ ID NO: 57647 - RNA, 360 nt, Artificial Sequence
  derived and/or modified sequence opt11 from anti-HIV_Chain
gacauccaaaugacccaaucccccuccucccuccccgccucagucggcgacaccgucaccaucaccugccaagccggccaaggcaucggcuccucccuccaaugguaccaacaacgccccggccgcgcccccaaccuccucgucuacgacgccuccaaccuccaacgcggcguccccucccgcuucaccggcaccggcuuccacaccaccuucacccucaccauccgcggccuccgccccgaagacuucggcaccuacuucugcgccucccucgaauucuucggccccggcaccaaagucgacaucaaacgcaccgucgccgcccccuccgucuucaucuucccccccuccgacgaacaa

SEQ ID NO: 57648 - RNA, 360 nt, Artificial Sequence
  derived and/or modified sequence opt11 from anti-HIV_Chain
gacauccaaaugacccaaucccccuccucccucuccgccuccgucggcgaccgcgucaccaucaccugccaagccucccaaggcaucggcuccucccuccaaugguaccaacaaaaacccggccgcgcccccaaccuccucguccacggcgccuccaaccuccaccgcggcguccccucccgcuucuccggcuccggcuuccacaccaccuucucccucaccaucuccggccuucaacgcgacgacuucgccaccuacuucugcgccguccucgaauucuucggccccggcaccaaagucgacaucaaacgcaccgucgccgcccccuccgucuucaucuucccccccuccgacgaacaa

SEQ ID NO: 57649 - RNA, 360 nt, Artificial Sequence
  derived and/or modified sequence opt11 from anti-HIV_Chain
gacauccaaaugacccaaucccccuccucccucuccgucuccgucggcgaccgcgucuccaucaccugccgcgccacccaaggcaucggcaacucccucaacugguaccaacaaaaacccggcaaagcccccaaaguccucaucuacggcaccaccaaacuccacggcggcguccccucccgcuucuccggcggcggcuccggcuccacaggcacccucaccaucgacucccuccaacccgaagacaucgccaccuacuucugccaacucuucgaauucuucggccccggcaccaaagucgaaaucaaacgcaccgucgccgcccccuccgucuucaucuucccccccuccgacgaacaa

SEQ ID NO: 57650 - RNA, 360 nt, Artificial Sequence
  derived and/or modified sequence opt11 from anti-HIV_Chain
gacauccaaaugacccaaucccccuccucccucuccgccuccgucggcgaccgcgucaccaucaccugccaagccggccaaggcaucggcuccucccucaacugguaccaacaaaaacccggccgcgcccccaaacuccucgucuacggcgccuccaaccuccaacgcggcguccccucccgcuucuccggcuccggcuuccacaccaccuucacccucaccaucuccucccuccaacccgaagacuucgccaccuacuucugcucagucuacgaauuccucggccccggcaccaaagucgaaaucaaacgcaccgucgccgcccccuccgucuucaucuucccccccuccgacgaacaa

SEQ ID NO: 57651 - RNA, 360 nt, Artificial Sequence
  derived and/or modified sequence opt11 from anti-HIV_Chain
ccgauguuucaaccgggacagagcgggggaguaguggugcaaaguggagagagcuugcacuugagcugugaagcgagcggguucaaguucgcgagccagaugaugcacuggguaaggcacgugccagggagagggcuagaguggguggcauugauaaguugggauggaucgggaaagcuauuugcagauagcgugagggggagguuuacgauacacagguggaaugacaggaacagucuauaucuagauguaaagaacgugaggccggaagaugcagcgauauauuacuguacaaggaacggguucgauguaugggggcagggaauacuggugacagugagcucggcaucgacaaaggga

SEQ ID NO: 57652 - RNA, 363 nt, Artificial Sequence
  derived and/or modified sequence opt11 from anti-HIV_HeavyChain
gaagucaaacucgucgaauccggcggcggccucguccaacccggcggcucccuccgccuauccugcgccgccuccggcuucaccuucuccuccuucggcaugcacuggguccgccaagcccccgaaaaaggccucgaaugggucgccuacaucuccuccggcuccuccacccuccacuacgccgacaccgucaaaggccgcuucaccaucucccgcgacaacuccaaaaacucccucuaccuccaaaugaaccuccuccgcgccgaagacaccgccgucuacuacugcgcccgcggcucccgcaaccucucccaccgccuccucuccuacuggggccaaggcacccucgucaccgucuccucc

SEQ ID NO: 57653 - RNA, 363 nt, Artificial Sequence
  derived and/or modified sequence opt11 from anti-HIV_HeavyChain
gagguccagcucguggaaucgggcgggggccugguccagcccgggggcucgcucaggcucucgugcgcggccucgggcuuuaccuuuagcucguucgggaugcauugggugcgccaggccccgggcaagggcuuggaaugggucucguacauaagcucgggcucgagcacgcuccauuacgcggacacggucaagggcagguucacgaucucgcgcgauaacucgaaaaauagcuuguacuugcaaaugaacucgcucagggccgaggacacggccguguacuauugcgcgcgcgggagcaggaacuugagccaucgcuugcucucguacuggggccagggcacacucgugaccgugagcucg

SEQ ID NO: 57654 - RNA, 363 nt, Artificial Sequence
  derived and/or modified sequence opt11 from anti-HIV_Chain
gacauccaaaugacacaaucccccuccucccucuccgccuccgucggcgaccgcgucaccaucaccugccaagccucccaaggcaucuccaacucccucaacugguaccaacaaaaacccggcaaagccccccgccuccucaucuacggcaccuccacccuccaacgcggcguccccucacgcuucuccggcuccggcuccggcacccgcuucaccgucaccaucaacucccuccaacccgaagacaucgccaccuacuucugccaacacaacgaauucuucggccgcggcaccaaagucgacaucaaacgcaccgucgccgcccccuccgucuucaucuucccccccuccgacgaacaacuc

SEQ ID NO: 57655 - RNA, 363 nt, Artificial Sequence
  derived and/or modified sequence opt11 from anti-HIV_Chain
gacauccaaaugacccaaucccccuccuccgucuccgccuccgucggcgaccgcgucaccaucaccugccaagccucccgcgacaccgacaacucccucaccugguaccaacaaaaacccggccgcccccccaaacuccucaucuaccacgucgucaaccucggccccggcguccccucccgcuucuccggcuccgccuccuccgccacccaauccacccucaucaucuccgacuuccaacccgacgacgucgccaccuacuucugccaaaacuacgaauucuucggccccggcaccaaagucgaaaucaaacgcaccgucgccgcccccuccgucuucaucuucccccccuccgacgaacaa

SEQ ID NO: 57656 - RNA, 363 nt, Artificial Sequence
  derived and/or modified sequence opt11 from anti-HIV_Chain
gaaaucguccucacccaaucccccggcacccucucccucucccccggcgaacgcgccacccuauccugccgcgccucccaauccgucuccuccaacaaccuagccugguaccaacaaaaacccggccaagccccccgccuccucauguccggcgccuccucccgcgccaccggcauccccgaccgauucuccggcuccggcuccggcaccgacuucacccucaccaucucccgccucgaacccgaagacuucgccgucuaccacugccaacaauacggcuccuccccccccaccuucggccaaggcaccaaagucgaaaucaaacgcaccgucgccgcccccuccgucuucaucuuccccccc

SEQ ID NO: 57657 - RNA, 363 nt, Artificial Sequence
  derived and/or modified sequence opt11 from anti-HIV_Chain
gacauccaaaugacccaaucccccuccucccucuccgccuacgucggcgaccgcgucaccaucaccugccgcgccucccaaaacaucaacaccuaccucaacugguaccaacaacgccccggcaaagcccccaaacuccucaucuacgccgccuccacccuccaauccggcguccccucccgcuucuccggcuccggcuccggcaccgacuucacccucaccaucuccaaccucgaaaccgaagacuucgccgucuacuacugccaacaaaccuaccgcuccgucaccuucggccaaggcaccaaacucgaaaucaaacgcaccgucgccgcccccuccgucuucaucuucccccccuccgac

SEQ ID NO: 57658 - RNA, 363 nt, Artificial Sequence
  derived and/or modified sequence opt11 from anti-HIV_Chain
gacauccaaaugacccaaucacccuccucccucuccgccuccgucggcgaccgcgucaccaucaccugccaagccggccaaggcaucggcuccucccuccaaugguaccaacaaaaacccggcaaagcccccaaacuccucguccacggcgccuccaaccuccaccgcggcguccccucccgcuucuccggcuccggcuuccacaccaccuucucacucaccaucuccggccuccaacgcgacgacuucgccaccuacuucugcgccgucgucgaauucuucggccccggcaccaaagucgacauaaaacgcaccgucgccgcccccuccgucuucaucuucccccccuccgacgaacaacuu

SEQ ID NO: 57659 - RNA, 363 nt, Artificial Sequence
  derived and/or modified sequence opt11 from anti-HIV_Chain
caagugcaauuggucgagagcggggccgagcucaggaaaccgggcgagagccuggaaauaagcuguaaagcgagcggguacucguucucgagccauuggauaggcugggccaggcaaaugcccgggaaagggcucgaguggaugggcauaaucuaucccggggacucgaacacgaucuauagcccgagcuuucaagggcaagugaccauaagcgcggacaagagcauaaacacggccuaucuccaguggucgagcuugaaagcgagcgauaccgcgauguauuucugugccucgaacuaucacgauuacuuuuacuggggccagggcacgcucgugaccgugagcucggccucgaccaagggc

SEQ ID NO: 57660 - RNA, 363 nt, Artificial Sequence
  derived and/or modified sequence opt11 from anti-HIV_Chain
uuuguccagcucguggaaucgggcgggggcgugguccagcccgggaccucgcucaggcucucaugcacgacaucgggcuuuaucuuuagcgauuacgggaugcauugggugcgccaggccgcgggcaagggcuuggaaugggucgcggucauauggcaugacgggagcaaucgauuuuacgcggacucggucaagggcagauucacgaucucgcgcgauaacucgaaaaaugccguguacuuggaaaugaacaaucucagggucgaggacacggccuuguacuauugcgcgcgcacgagcauggacauagacuauugggggcaagggaccccggucacggucucgagcgcgagcacgaaaggg

SEQ ID NO: 57661 - RNA, 363 nt, Artificial Sequence
  derived and/or modified sequence opt11 from anti-HIV_Chain
gagcccauguuccagcccgggcaaucgggcggggucgugguccagagcggggaaucgcuccaucucucgugcgaggccucgggcuuuaaauuugccucgcaaaugaugcauugggugcgccaugucccgggcaggggccuggaaugggucgcgcucauaagcugggacgggagcgggaaauuguucgcggacucggucaggggcagguucacgauccaucgcuggaacgaucgcaauagcuuguacuuggacgugaaaaaugucaggcccgaggacgcggccauauacuauugcacgcgcaauggcuuugacgugugggggcaagggaucuuggucacggucucgagcgcgagcacgaaaggg

SEQ ID NO: 57662 - RNA, 366 nt, Artificial Sequence
  derived and/or modified sequence opt11 from anti-HIV_Chain
agccagcaccugguccagagcgggacacaggucaagaaaccgggcgcgagcgugcgcauaagcugccaagcgagcggguacucauucacggacuacguccugcacugguggaggcaagcgcccgggcaagggcucgaguggaugggcuggaucaagcccguguacggggccaggaacuacgccaggcgcuuucaagggcgcauaaacuuugacagggacauauacagggaaauagccuucauggaccucucgggcuugagaucggacgauaccgcgcucuauuucugugccagggacgggagcggggacgauaccucguggcaccuagaucccuggggccagggcacgcucguaaucgugagcgcg

SEQ ID NO: 57663 - RNA, 366 nt, Artificial Sequence
  derived and/or modified sequence opt11 from anti-HIV_Chain
gacauccaaaugacccaaucccccuccucccucuccgccuccgucggcgaccgcgucaccaucaccugccgcgccucccaauccaucucccgauaccuaaacugguaccaacaaaaacccggcaaagcccccaaacuccucaucuacgccgccuccucccuccaaggcggcguccccucacgcuucuccggcuccggcuccggcaccgacuucacccuaaccaucuccucacuccaacccgaagacuucgccaccuacuacugccaacaauccuccuccaaacccuucaccuucggcggcggcaccaaagucgaaaucaaacgcaccgucgccgcccccuccgucuucaucuucccccccuccgac

SEQ ID NO: 57664 - RNA, 366 nt, Artificial Sequence
  derived and/or modified sequence opt11 from anti-HIV_Chain
gaaaucguccucacccaaucccccggcacccucucccuuucccccggcgaacgcgccacccucuccugccgcgccucccaauccaucuccuccaacuaccucgccugguaccaacaaaaacccggccaagccccccgccuccucaucuacggcgccuccacccgcgccaccggcauccccgaccgauucuccggcuccggcuccggcaccgacuucacccucuccaucucccgccucgaacccgaagacaucgccgucuacuacugccaccaauacggcuccucccaacgcuucggccaaggcaccaaagucgaaaucaaacgcaccgucgccgcccccucagucuucaucuucccccccuccgac

SEQ ID NO: 57665 - RNA, 366 nt, Artificial Sequence
  derived and/or modified sequence opt11 from anti-HIV_Chain
gaaaucgucaugacccaaucccccgccacccucuccgucucccccggcgaccgcgccacccucuccugccgcgccucccaauccgucuccaccaaccucgccugguaccaacaaaaacccggccaagccccccgccuccucaucuacggcgccuccacccgcgccaccggaauccccgccaccuucuccggcuccggcuucgccaccgaauucacccucaccauauccucccuccaauccgaagacuucgccgucuacuacugccaacaauacaacaacuggccccccgccuucggccaaggcaccaaagucgaaaucaaacgcaccgucgccgcccccuccgucuucaucuucccccccuccgac

SEQ ID NO: 57666 - RNA, 366 nt, Artificial Sequence
  derived and/or modified sequence opt11 from anti-HIV_Chain
gacauccaaaugacccaaucccccgccucccucuccgccuccgucggcgaccgcgucaccaucaccugccgcgccucccaaggcaucucccacuaccuagccugguaccaacaaaaacccggcaaagucccccgccuccucaucuacgccgccucccgccuccaauccggcgucaccucccgcuucuccggcuccggcuccggcaccgaauucacccucacaaucuccucccuccuccccgaagacgccgccgucuacuucugccaaaaauacgacaccgaccccaugaccuucggccaaggcacccgccucgaaaucaaacgcaccgucgccgcccccuccgucuucaucuucccccccuccgac

SEQ ID NO: 57667 - RNA, 366 nt, Artificial Sequence
  derived and/or modified sequence opt11 from anti-HIV_Chain
caauccgcccucacccaaccccccuccgccuccggcgcccccggccaacgcgucaccaucuccugcuccggcggccccuccaacgucggcggcaacuacgucuacugguaccgccaauuccccggcaccgcccccaaccuccucauccuccgcgacgaccaacgccccuccggaguccccgaccgcuucuccgccuccaaauccggcaacuccgccucccucgccaucuccggccuccgccccgacgacgaagccuucuacuucugcgccaccuacgacuccgacggcuccauccgccucuucggcggcggcaccacacuaaccguccucucccaacccaaagccgcccccuccgucacacucuuc

SEQ ID NO: 57668 - RNA, 366 nt, Artificial Sequence
  derived and/or modified sequence opt11 from anti-HIV_Chain
gacauccaaaugacccaaucccccuccucccucuccgccuccgucggcgaccgcgucaccaucaacugccaagccggccaaggcaucggcuccucccucaacugguaccaaaaaaaacccggccgcgcccccaaacuccucguccacggcgccuccaaccuccaacgcggcguccccucccgcuucuccggcuccggcuuccacaccaccuucacccucaccaucuccucccuccaacccgacgacgucgccaccuacuucugcgccgucuuccaaugguucggccccggcaccaaagucgacaucaaacgcaccgucgccgcccccuccgucuucaucuucccccccuccgacgaacaacucaaa

SEQ ID NO: 57669 - RNA, 366 nt, Artificial Sequence
  derived and/or modified sequence opt11 from anti-HIV_Chain
gacauccaaaugacccaaucccccuccucccucuccgcauccgucggcgaccgcgucaccaucaccugccaagccucccaaggcaucggcuccucccuccaaugguaccaacaaaaacccggccgcgcccccaaccuccucguccacggcgccuccaaacuccaccgcggcguccccucccgcuucuccggcuccggcuuccacaccaccuucucccucaccaucuccggccuccaacgcgacgacuucgccaccuacuucugcgccguccucgaauucuucggccccggcaccaaagucgaaaucaaacgcaccgucgccgcccccuccgucuucaucuucccccccuccgacgaacaacucaaa

SEQ ID NO: 57670 - RNA, 366 nt, Artificial Sequence
  derived and/or modified sequence opt11 from anti-HIV_Chain
caaguccaccucguacaaucaggcgcagaaguaaaaaaacccggcgccucagucaaagucuccugcaaagucuccggcuacacccuaagcgaacucucaauccacuggguacgccaaggcccaggccgcggccuagaauggauggccaacuucgacccagaagacggcgaaaccauauacgcaccccaauuccaaggcagggucacacucacagaagacaccucaaccgacaccgcauacaugcaacuaaccucacuaagaagcgaagacacagccgucuacuacugcgcaaccgaccgcuacaccgacaccgggcgcuggggcccaggcacacucguaaccgucagcucagccucaaccaaaggc

SEQ ID NO: 57671 - RNA, 366 nt, Artificial Sequence
  derived and/or modified sequence opt11 from anti-HIV_Chain
caggugcaguugguggagaguggggggggguugauacagccgggggggagcuugagguugagcugugaggcgaguggguuugcggugggggauauaaauuauaugaguugggugaggcaggcgccagggaagggguuggagugggugaguguguuguacaguggggggaguagucaguaugcggauagcgugaaggggagguuuacgauaagcagggauaauaguaggaauacgcuguaucugcagauggauaauuugagggcggaggauacggcgguauauuauugugcgaggggguugaggguguauuuugaucugugggggcaggggauauuggugacggugaguagugcgagcacgaagggg

SEQ ID NO: 57672 - RNA, 366 nt, Artificial Sequence
  derived and/or modified sequence opt11 from anti-HIV_Chain
cagguccagaugguggccucgggcgggggcuuggucaagcccgggggcucgcucaggcucucgugcgaggccucgggcuuuaccuuuagcgauuacuauaugucgugggugcgacaggcaccgggcaagggcuuggaauggaucucguacauaaccucgggcgggaacgcgcucuauuacgcggacucggucaagggcagguucacgaucucgcgcgauaacgcgaaaaauagcuuguacuugcaaaugaacucgcucagggccgaggacacggccguguacuauugcgcgcgcgaucucuugcacgcgcacgauuucgggcgccagggcacgcucgugaccgugagcucggccucaaccaagggc

SEQ ID NO: 57673 - RNA, 366 nt, Artificial Sequence
  derived and/or modified sequence opt11 from anti-HIV_Chain
caacuccaacucgucgaauccggcggcggcgucguccaacccggccgcucccuccgccucuccugcgccgccuccggcuucaccuucuccaccuacaccaugcacuggguccgccaagcccccggcaaaggccucgaaugggucgccgucaucuccuacgacggcaccaacaaauacuacgccgacucagucaaaggccgcuucaccaucucccgcgacaacuccaaaaacacccucuaccuccaaaugaacucccuccgcggcgaagacaccgccgucuacuacugcgcccgcucccccuccuacuacuucgacuacuggggccaaggcacccucgucaccgucuccgccgccuccaccaaaggc

SEQ ID NO: 57674 - RNA, 369 nt, Artificial Sequence
  derived and/or modified sequence opt11 from anti-HIV_Chain
caagugcaccugagccagagcggggccgcggucacgaaaccgggcgcgagcgugcgcgugagcugugaagcgagcggguacaagaucucggaccauuucauacacugguggaggcaagcgcccgggcaagggcuccagugggugggcuggaucaaucccaagaccgggcaaccgaacaaucccaggcaauuucaagggcgcgugagcuugaccaggcaagcgagcugggacuuugacacguacucguucuauauggaucucaaggccgugcgcucggacgauaccgcgaucuauuucugugccaggcaaaggagcgauuucugggacuuugacgugugggggagcgggacccaggucacggucucgagc

SEQ ID NO: 57675 - RNA, 369 nt, Artificial Sequence
  derived and/or modified sequence opt11 from anti-HIV_Chain
caaguccaacuccuccaauccggcgccgucgucacaaaacccggcgccucaguccgcgucuccugcgaagccucaggcuacaaaauccgcgacuacuucauccacugguggcgccaagcccccggccaaggccuccaaugggucggcuggaucaacccccaaaccggccaacccaacaucccccgccccuuccaaggccgcgucacccucacccgccacgccuccugggacuucgacacauucuccuucuacauggaccucaaagcccuccgcuccgacgacaccgccaucuacuucugcgcccgccgacgcuccgacuacugcgacuucgacgucuggggcuccggcacccacgucaccgucuccucc

SEQ ID NO: 57676 - RNA, 369 nt, Artificial Sequence
  derived and/or modified sequence opt11 from anti-HIV_Chain
caaguccaacuccuccaauccggcgccgccgucaccaaacccggcgccuccguccgcgucuccugcgaagccuccggcuacaacauccgcgacuacuucauccacugguggcgccaagcccccggccaaggccuccaaugggucggcuggaucaaccccaaaaccggccaacccaacaacccccgccaauuccaaggccgcgucucacucacccgccacgccuccugggacuucgacaccuucuccuucuacauggaccucaaaggccuccgcuccgacgacaccgccaucuacuucugcgcccgccaacgcuccgacuacugggacuucgacgucuggggcuccggcacccaagucaccgucucaucc

SEQ ID NO: 57677 - RNA, 369 nt, Artificial Sequence
  derived and/or modified sequence opt11 from anti-HIV_Chain
caagugcaauugcuccagagcggggccgcggucacgaaaccgggcgcgagcgugcgcgugagcugugaagcgagcggguacaauaucagggacuauuucauacacugguggaggcaagcgcccgggcaagggcuccagugggugggcuggaucaaucccaagaccgggcaaccgaacaaucccagacucuuucaagggcgagugagccugaccaggcacgcgagcugggacuuugacacguucucguucuauauggaucucaaggccgugcgcucggacgauaccgcggucuauuucugugccaggcaaaggagcgauuacugggacuuugacgugugggggagugggacccaggucacggucucgagc

SEQ ID NO: 57678 - RNA, 369 nt, Artificial Sequence
  derived and/or modified sequence opt11 from anti-HIV_Chain
caaguccgccuccuccaauccggcgccgccgucaccaaacccggcgccuccguccgcgucuccugcgaagccuccggcuacgaaauccgcgacuacuucauccacugguggcgccaagcccccggccaaggccuccaaugggucggcuggaucaaccccaaaaccggccaacccaacaacccccgccaauuccaaggccgcgucucccucacccgccaagccucaugggacuucgacucauacuccuucuacauggaccuaaaagcccuacgcuccgacgacaccggcgucuacuucugcgcccgccaacgcuccgacuacugggacuucgacgucuggggcuccggcacccaagucaccgucuccucc

SEQ ID NO: 57679 - RNA, 369 nt, Artificial Sequence
  derived and/or modified sequence opt11 from anti-HIV_Chain
caaguccaacuccuccaauccggcgccgccgucaccaaacccggcgccuccguccgcgucuccugcgaagccuccggcuacaacauccgcgacuacuucauccacugguggcgccaagcccccggccaaggccuacaaugggucggcuggaucaaccccaaaaccggccaacccaacaacccccgccaauuccaaggccgcgucucacucacccgccacgccuccugggacuucgacaccuucuccuucuacauggaccucaaagcccuccgcuccgacgacaccgccgucuacuucugcgcacgccaacgcuccgacuacugggacuucgacgucuggggcuccggcacccaagucaccgucucaucc

SEQ ID NO: 57680 - RNA, 369 nt, Artificial Sequence
  derived and/or modified sequence opt11 from anti-HIV_Chain
gaagugcaauuggucgagagcgggggcgggcucauacaaaggggcgggagcuugcgcuugagcugugucgcgagcggguucccggucucggacaaucacaugagcugggucaggcaagcacccgggaaagggcucgagugggugagcauaaucuauagcgauggcgggaccuauuacgcggacucggucaagggcagguucacgaucucgcgcgauaacucgaaaaauaccguguacuugcaaaugaacucgcucagggccacggacacggccguguacuauugcgcgcgcgaucccggguuccauuacgggcucgaugucuggggccagggcacgaccgugaccgugagcucggccucgaccaagggc

SEQ ID NO: 57681 - RNA, 369 nt, Artificial Sequence
  derived and/or modified sequence opt11 from anti-HIV_Chain
caagugcaauugcaagagagcgggcccgggcucuugcgcccgcucgagaccuugagcuugaccuguagcgugagcgggggcucgaucaggggcuauuucuggagcugggucaggcaaccggccgggcgcgggcucgaguggauaggcaggaucuauagcucgggcacgaccagguucaaucccucgcucaagagcagggucaggcuaucgaucgauaccgcgaaaucggaagugagccugaacauaaccucggucacggccgcggacucggccucguacuuuugcgcgggcacgagcccgguccauggcgggcucgaucucuggggcuugggcuugcgcgugaccguaaguucggccucgaccaagggc

SEQ ID NO: 57682 - RNA, 369 nt, Artificial Sequence
  derived and/or modified sequence opt11 from anti-HIV_Chain
gaaaucguccucacccaaucacccggcacccucucccucucccccggcgaacgcgccacccucuccugccgcgccucccaauccgucuccuccaaccucgccugguacgcccaaaaacccggccaagcaccccgccucaucaucuacggcgccuccucccgagccuccgccauccccgaccgcuuccgcggcucaggcuccggcaccgacuucacccucaccaucucccgccucgaacccgaagacuucgccgucuacuacugccaacaauacgacgacgcccccaucaccuucggccacggcacccgccucgaaaucaaacgcaccgucgccgcccccuccgucuucaucuucccacccuccgacgaa

SEQ ID NO: 57683 - RNA, 369 nt, Artificial Sequence
  derived and/or modified sequence opt11 from anti-HIV_Chain
gaaaucguccucacccaaucccccggcacccucucccucucccccggcgaccgcgccgcccucuccugccgcgccuccgaaacccucuccggcaacucccucgccugguaccaacaaaaacgaggccaacccccccgccuccucaucuucgccgccuccucccgcgccaccggcauccccgaacgcuucuccggcggcggcucaggcaccgacuucacccucaccaucacccgccucgaacccgaagacuucgccgucuacuucugccaacaauacgucgacgcacccaucaccuucggccaaggcacccgccucgaaaucaaacgcaccgucgccgcccccuccgucuucaucuuccccccauccgac

SEQ ID NO: 57684 - RNA, 369 nt, Artificial Sequence
  derived and/or modified sequence opt11 from anti-HIV_Chain
gacauccaaaugacccaaucccccuccucccucuccgccuccgucggcgaccgcgucaccaucaccugccgcgccucccaagacaucaccaccuaccucgccuggcuccaacaaaaacccggcaaagcacccaaaucccucaucuacuccgccuccaccguccaauccggcgucccaucccgcuucuccggcuccggcuccggcaccgaauucacccucaccaucuccggccuccaacccgaagacuucgccaccuacuacugccaacaauacaacuacuaccccaucaccuucggccucggcacccgccucgaaaucaaacgcaccgucgccgcccccuccgucuucaucuucccccccuccgacgaa

SEQ ID NO: 57685 - RNA, 369 nt, Artificial Sequence
  derived and/or modified sequence opt11 from anti-HIV_Chain
gacauccaaaugacccaaucccccuccucccucuccgccuccaucggcgaccgcgucaccaucaccugccgcgccaaccaacacauccgcuccuuccucaacugguaccaacaaacccccggcaaagcccccaaacuccucaucuacgccgccuccacccuccaacgcggcguccccucccgcuucuccggcuccggcuccggcaccgacuucacccucaccaucaccucccucgaacgcgaagaccucgccaccuacuacugccaacaaaccuacaccucccccaucaccuucggccaaggcacccgccucgaaaucaaacgcaccgucgccgcccccuccguauucaucuucccccccucagacgaa

SEQ ID NO: 57686 - RNA, 369 nt, Artificial Sequence
  derived and/or modified sequence opt11 from anti-HIV_Chain
ucagaaaucguccucacccaaucccccgccacccucucacucucacccggcgaauccgccacacucuccugccgcgccucccaaucccucuccuccucccucgccugguaccaacaaaaacccggccaagccccccgccuccucaucuacgacaccuccgaccgcgccaccggcauccccgcccgauucuccggccgcggcuccggcaccgacuucacccucaccaucuccucccucgaacccgaagacuucgccgucuacuacugccaacaacgauccaacugggccaucaccuucggccaaggcacccgccucgaaaucaaacgcaccgucgccgcccccuccgucuucaucuucccccccuccgac

SEQ ID NO: 57687 - RNA, 369 nt, Artificial Sequence
  derived and/or modified sequence opt11 from anti-HIV_Chain
caaguccucuccgucuccggcacccccggccaacgcgucaucaucuccugcuccggcacauccuccaacgucggcggcaaccucgucuccugguaccaacaccuccccggcgccgccccccgccuccuaauccaccgagacgaccaacgccccuccggcguccccgaccgcuucuccggauccaaauccggcaacuccgccucccucgucaucuccggccuccgcuccgacgacgaagccgacuacuucugcgccgccuacgacuccaccuucucccuccccgucuucggcggcggcacccgccuaaccguccucucccaacccaaagccgcccccuccgucacccucuacgcccccuccuccgaagaa

SEQ ID NO: 57688 - RNA, 369 nt, Artificial Sequence
  derived and/or modified sequence opt11 from anti-HIV_Chain
gacauccaaaugacccaaucccccuccucccucuccgccuccgucggcgaccgcgucaccaucaccugccaagccggccaaggcaucggcuccucccuccaaugguaccaacaaaaacccggcaaagcccccaaacuccucguccacggcgccuccaaccuccaccgcggcguccccucccgcuucuccggcuccggcuuccacaccaccuucucccucaccaucuccggccuccaacgcgacgacuucgccaccuacuucugcgccguccucgaauucuucggccccggcaccaaagucgaaaucaaacgcaccgucgccgcccccuccgucuucaucuucccccccuccgacgaacaacucaaaucc

SEQ ID NO: 57689 - RNA, 369 nt, Artificial Sequence
  derived and/or modified sequence opt11 from anti-HIV_Chain
gaaaucguccucacccaaucccccgccacccuaucccucucccccggcgaacgcgccacccucuccugccgcgccucccaaggccucaacuucgucgucugguaccaacaaaaacgcggccaagcaccccgccuccucauccacgcccccuccgaccgcgcccccggcguccccgaccgcuucuccgcccgcggcuccggcaccgacuucucccucgucaucuccuccgucgaacccgacgacuucgccaucuacuacugccaagaauacuccuccacccccuacaacuucggccccggcacccgcgucgaccgaaaacgaaccgucgccgcccccuccgucuucaucuucccccccuccgacgaacaa

SEQ ID NO: 57690 - RNA, 369 nt, Artificial Sequence
  derived and/or modified sequence opt11 from anti-HIV_Chain
gaaaucguccucacccaaucccccaccacccucucccucucccccggcgaacgcgccacccucuccugccgcgccucccaaggcgucaaccucgucgucugguaccaacaaaaacgcggccaagccccccgccuccucaucuacggccccucagaccgcgcccccggcguccccgaccgcuucuccgcccgcggcuccggcaccgaauucucccucgucaucuccuccgucgaacccgacgacuucgcccucuacuacugccaagaauacuccuccacccccuacaacuucggcaccggcacccgcgucgaccgcaaacgcaccgucgccgcccccuccgucuucaucuucccccccucagacgaacaa

SEQ ID NO: 57691 - RNA, 369 nt, Artificial Sequence
  derived and/or modified sequence opt11 from anti-HIV_Chain
gaaaucguccucacccaaucccccgcaacccucucccuaucccccggagaacgcgccacccucuccugccgcgccucccaaggcgucaacuucgucgucugguaccaacaaaaacgcggccaagccccccgccuccucaucuacggccccuccaaccgagcccccggcguccccgaccgcuucucagcccgcggcuccggcaccgaauucucccucgucaucuccuccgucgaacccgacgacuucgcccucuacuacugccaagaauacuccuccacccccuacaacuucggccccggcacccgcgucgaccgcaaacgaaccgucgccgcccccuccguauucaucuucccccccuccgacgaacaa

SEQ ID NO: 57692 - RNA, 369 nt, Artificial Sequence
  derived and/or modified sequence opt11 from anti-HIV_Chain
gaaaucguccucacccaaucccccgccacccucucccucucccccggcgaacgcgccacccucuccugccgcgccucccaaggccucaacuucgucgucugguaccaacaaaaacgcggccaagccccccgccuccucauccacggccccucccaccgagcccccggcguccccgaccgcuucuccgcccgcggauccggaaccgaauucucccucgucaucuccuccgucgaaccagacgacuucgccaucuacuacugccaagaauacuccuccacccccuacaacuucggccccggcacccgcgucgaccgcaaacgcaccgucgccgcccccuccgucuucaucuucccccccuccgacgaacaa

SEQ ID NO: 57693 - RNA, 369 nt, Artificial Sequence
  derived and/or modified sequence opt11 from anti-HIV_Chain
gaaaucguccucacccaaucccccgccacccucucccucucccccggcgaacgcgccacccucuccugccgcgccucccaaggccucaacuucgucgucugguaccaacaaaaaggcggccaagccccccgccuccucauccacggccccaccgaccgcgcccccggcguccccgaccgcuucuccgcacgcggcuccggcaccgaauucucacucgucaucuccuccgucgaaccagacgacuucgcccucuacuacugccaagaauacuccuccacccccuacaacuucggccccggcacccgcgucgaccgcaaacgcaccgucgccgcccccuccgucuucaucuucccccccuccgacgaacaa

SEQ ID NO: 57694 - RNA, 369 nt, Artificial Sequence
  derived and/or modified sequence opt11 from anti-HIV_Chain
gaaaucguccucacccaaucccccgcaacccucucccucucccccggcgaacgcgccacccucuccugccgcgccucccaaggccucaacuucgucgucugguaccaacaaaaacgcggccaagccccccgccuacucauccacgcccccucaggccgcgcccccggcguccccgaccgcuucuccgcccgcggcuccggcaccgaauucucccucgucaucucuucagucgaacccgacgacuucgccaucuacuacugccaagaauacuccucuacccccuacaacuucggccccggaacccgcgucgaccgcaaacgcaccgucgccgcccccucagucuucaucuucccccccuccgacgaacaa

SEQ ID NO: 57695 - RNA, 369 nt, Artificial Sequence
  derived and/or modified sequence opt11 from anti-HIV_Chain
caaguccaacuaguccaauccggcgccgaagucaaaaaacccggcuccuccgucaaagucucaugcaaaaccuccggcggcuccuucuccaacuacgccuucuccuggguccgccaagcccccggcgaaggccucgaauggaugggccgcaucauccccaucuucggcaccgccaaauacacccaaaaacuccaaggccgcgucaccaucaccgccgacaaauucaccuccaccgucuacauggaacucuccucacuccgcucagaagacaccgccaucuacuacugcgccucccuccaccaaggccccaucggcuacacccccuggcacccccccccccgcgccccccucggccaauccgucugcggc

SEQ ID NO: 57696 - RNA, 369 nt, Artificial Sequence
  derived and/or modified sequence opt11 from anti-HIV_Chain
caaguccaacucgucgaauccggcggcggccuaguccaacccggcggcucccuccgcaucuccugcuccgcaaccggcuucaccuucuccacccacgccaugcacuggguccgccaagcccccggcaaaggccucgaauacgucuccgccaucaacuccaacggccgcuccgccuucuacgccgacuccgucaaaggccgcgucaccaucucccgcgacaacuccaaaaacacccucuuccuccaaaugaccucccuccgcgccgaagacaccgccgucuacuacugcgucaaaggcccccuccuccgcuaccucgacuccuggggccaaggcacccucgucaccgucuccuccgccuccaccaaaggc

SEQ ID NO: 57697 - RNA, 369 nt, Artificial Sequence
  derived and/or modified sequence opt11 from anti-HIV_Chain
gaagugcaauuggucgagagcgggggcgggcuagugcaaccgggcgggagcuugcgcauaagcuguagcgcgaccggguucacguucucgacccaugccaugcacugggucaggcaagcgcccgggaaagggcucgaguacgugagcgcgaucaauagcaauggcaggagcgcguucuaugccgauagugugaaagggcgcgugaccauaagcagggacaauagcaagaacacgcucuuucuccagaugacgagcuugcgcgcggaagauaccgcggucuauuacugugucaagggcccgcucuugcgcuaucuagauagcuggggccagggcacgcucgugaccgugagcucggccucgaccaagggc

SEQ ID NO: 57698 - RNA, 369 nt, Artificial Sequence
  derived and/or modified sequence opt11 from anti-HIV_Chain
gaagaauccggccccggccucguaaaacccucccaaacccucucccucaccugcuccguauccggcgacuccgucucauccggcggcuauuucugguccuggauccgccaacaccccaccaaaggccucgaaugccucggcuacgucuacuacaccggcaacaccuacuacaaccccucccucaaauccccccccaccaucgaagucgccauggccaacaaccaagucucccucaaacucggcucagucaccgccgccgacaccgccgucuacuacugcgcccgcaucaaacgcuuccgcggcggcaacuacuucgacaccuggggccacggccuacucgucaccgucuccuccgccuccaccaaaggc

SEQ ID NO: 57699 - RNA, 369 nt, Artificial Sequence
  derived and/or modified sequence opt11 from anti-HIV_Chain
caaguccagcuccaggaaucgggcucgggcuuggucaagcccucgggcacgcuaucgcuaacgugcgcggucucaaacgggcccauaagcucgggcaauugguggagcugggucaggcaaacgcccgagaaagggcucgaguggauaggcgaggucuaucacucgggcucgaccaaucacaaucccucgcuaaagagcagggccacgaucuuggucgauaaaucgaaaaaucaauucagcuugaacuugcgcucggucacggccgcggacacggccguguacuauugcgcgcgagugcgcgggagcuggaacuuugacuauugggggcaagggauccuggucacggucucgagcgcgagcacgaaaggg

SEQ ID NO: 57700 - RNA, 369 nt, Artificial Sequence
  derived and/or modified sequence opt11 from anti-HIV_HeavyChain
gaagugcaauugcaacagagcgggaccgugcucgcgcgcccgggcgcgagcgugaaaaugagcuguaaagcgagcggguacacguucacgagcuauuggaugcacugggucaagcaaaggcccgggcaagggcucgaguggauaggcgcgaucuaucccgggaacucggacacgagcuauaaccagaaauuuaaagggaaagcgaaauugaccgcggucacgagcgcgagcacggccuauauggagcucucgagcuugaccaaugaagauagcgcggucuauuacuguaccagguggccgcacuauuacgggggcucgcgcuauuacuuugacuauugggggcaagggaccacgcucacggucucaagc

SEQ ID NO: 57701 - RNA, 372 nt, Artificial Sequence
  derived and/or modified sequence opt11 from anti-HIV_Chain
gugguccagcucguggaaucgggcgggggcuugguccagcccgggggaucgcucaggcuaucgugcgcggccucgggcuuugccuuucgcucguacuggaugucgugggugcgccaggccccgggcaggggcuuggaaugggucgcgaacauaaaacaggacgggagcgagaaauauuacgcggacucggucaagggcagguucacgaucucgcgcgauaacacgaaaaauagcuuguacuugcaaaugaacucgcucagggccgaggacacggccguguucuauugcgcgagcaggggcgaucgcuauggcccgaucgauuacuggggccagggcacgcucgugaccgugagcucggccucgaccaagggc

SEQ ID NO: 57702 - RNA, 372 nt, Artificial Sequence
  derived and/or modified sequence opt11 from anti-HIV_Chain
caaguccaacucguccaauccggcgccgaaaucaaaaaacccggcgaaucacucaaaaucuccugcaaagccuccggcuacaccuucaacgacuacuggaucggcuggguccgacaaaugcccggcaaaggccucgaauggaugggcaucuucuaccccgacgacuccgacucaaacuacucccccuccuuccaaggccgcgucaccaucuccgccgacaaaucaaucaccaccgccuaccuccaauggucaacccucaaagccuccgacuccgccauguacuucugcgcccgccuccucggcgacuccggcgccuucgacaucuggggccaaggcaccauggucaucgucuccucagccuccaccaaaggc

SEQ ID NO: 57703 - RNA, 372 nt, Artificial Sequence
  derived and/or modified sequence opt11 from anti-HIV_Chain
cagguccagcucgugcaaucgggcgggggcuuggucaagcccgggggcucgcucaggcuaucgugcgcggccucgggcuuuaccuuuagcucguacucgaugaauugggugcgccaggccccgggcaagggcuuggaaugggucucgagcauaagcucgagcucgagcuauaucuauuacgcggacucggucaagggcagguucacgaucucgcgcgauaacgcgaaaaauagcuuguacuugcaaaugaacucacucagggccgaggacacggccguguacuauugcgcgcgcgagggcucguacuauuacgggauggaugucuggggacagggcacgaccgugaccgugagcucggccucgaccaagggc

SEQ ID NO: 57704 - RNA, 372 nt, Artificial Sequence
  derived and/or modified sequence opt11 from anti-HIV_Chain
gaaaucguccucacccaaucccccgccacccucuccgucucccccggcgaacgagccacccucuccugccgcgccggccaauccgucuccuccgaccucgccugguaccaacacaaacccggccaagccccccgccuccucaucuacgacgccuccaaacgcgccaccggcauccccgcccgcuucucaggcuccggcucaggcaccgacuucacccucaccaucuccucccucgaacccgaagacuucgccgucuacuacugccaacaccgcacaaacuggccccccuccaucaccuucggacaaggcacccgacucgaaaucaaacgcaccgucgccgcccccuccgucuucaucuucccccccuccgac

SEQ ID NO: 57705 - RNA, 372 nt, Artificial Sequence
  derived and/or modified sequence opt11 from anti-HIV_Chain
gaaaucguccucacccaaucccccggcacccucucccucucccccggcgaacgcgccacccucuccugccgcgccucccaauccgucuccucccgcuaccucgccugguaccaacaaaaacccggccaagccccccgccucaucaucuacgacgccuccucccgcgccucaggcauccccgaccgcuucuccggcuccggauccgaaaccgacuucacccucaccaucacccgccuagaacccgaagacuucgccgucuacuacugccaacucuacggcaccucccccaaauucaccuucggccaaggcaccaaacucgaaaucaaacgcaccgucgccgcccccuccgucuucaucuucccccccuccgac

SEQ ID NO: 57706 - RNA, 372 nt, Artificial Sequence
  derived and/or modified sequence opt11 from anti-HIV_Chain
gaaaucguccucacccaaucccccggcacccucucccucucccccggcgaacgcgccacccucuccugccgcgccucccaauccgucuccaacaacuaccucgccugguaccaacaaaaacccggccaagccccccgccuacucauauacggcgccuccucccgagccaccggcauccccgaccgcuucucaggcucaggcuccggcaccgacuucacccucaccaucucacgccucgaacccgaagacuucgccgucuacuacugccaacaauacgcaaccuccucccucuacaccuucggccaaggcaccaaacuagaaaucaaacgcaccgucgccgcccccuccgucuucaucuucccccccuccgac

SEQ ID NO: 57707 - RNA, 372 nt, Artificial Sequence
  derived and/or modified sequence opt11 from anti-HIV_Chain
cccgccacccucgccgucucccccggcgaacgcgccaccaucuccugcaaauccucccaaaaccuccucuacuccgccaacaaccaacacucccucgccugguaccaacaacgccccggccaaccccccaaacuacuccucuacugggccuccacccgccucuccggcguccccgaccgcuucucuggcuccggcuccggcaccgacuucacccucaccaucuccaaccuacaagccgaagacgucgccgucuacuacugccaacaauacuacucacccccccccaccuucggccaaggcaccaaagucgaaauccgccgcaccgucgccgcccccuccgucuucauauucccccccuccgacgaacaacuc

SEQ ID NO: 57708 - RNA, 372 nt, Artificial Sequence
  derived and/or modified sequence opt11 from anti-HIV_Chain
caacccguccucacccaaccccccuccgccuccggcgcccccggccaacgcgucaccaucuccugcuccggcggccccuccaacgucggcggcaacuacgucuacugguaccgccaauuccccggcaccgcccccaaccuacucauccuccgcgacgaccaacgccccuccggcguccccgaccgcuucucagccuccaaauccggcaacuccgccucacucgccaucaccggccuccgccccgacgacgaagccuucuacuucugcgccacauacgacuccgacggcuccauccgccucuucggcggcggcaccgcccucaccguccucucccaacccaaagccgcccccuccgucacccucuuccccccc

SEQ ID NO: 57709 - RNA, 372 nt, Artificial Sequence
  derived and/or modified sequence opt11 from anti-HIV_Chain
aacuucaugcucacacaaccccccuccgccuccggcgcccccggccaacgcgucaccaucuccugcuccggcggccccuccaacgucggcggcaacuacgucuacugguaccgccaauuccccggcaccgcccccaaccuccucauccuccgcgacgaccaacgccccuccggcguccccgaccgcuucuccgccuccaaauccggcaacuccgccucccucgccaucucaggccuccgccccgacgacgaagccuucuacuucugcgccaccuacgacuccgacggcuccauccgccucuucggcggcggcaccacccucaccguccucucccaacccaaagccgcccccuccgucacccucuuccccccc

SEQ ID NO: 57710 - RNA, 372 nt, Artificial Sequence
  derived and/or modified sequence opt11 from anti-HIV_Chain
gacauccaaaugacccaauccccacccucacuauccgccuccguaggcgaccgcgucaccaucaccugccaagccucccaagacaucaacaacuuccucaacugguaccaacaaaaacccggcaaagccccccgccuccucaucuacgacgccuccaaccucgaauccggcgucuccucccgcuucuccggcucccgcuccggcaccgacuucacccucaccaucuccucccuccuccccgaagacaucgccaccuacuccugccaacaauacuccaaccuccccuacaccuucucccaaggcaccaaacucgaaaucaaacgcaccgucgccgcccccucagucuucaucuucccccccuccgacgaacaa

SEQ ID NO: 57711 - RNA, 372 nt, Artificial Sequence
  derived and/or modified sequence opt11 from anti-HIV_Chain
caaguccaacucguccaauccggcaccgccgucaaacgccccggcgccuccguccgcgucuccugccaagccuccggcuacaccuucaucgaccacuucaucuacugguggcgccaagcccccggccaaggccucgaauggcucggcuggaucaacccccucaccucccaacccuccuaccccucccgcuuccaaggccgccucacccucacccgcgacaccuucgacgaaaugcucuacauggaccuccgcggccuccgcuccgacgacaccggcaucuacuucugcgcccgccgccacuccgacuacugcgacuucgacaucuggggcuccggcacccaaaucaucgucuccuccgccuccaccaaaggc

SEQ ID NO: 57712 - RNA, 372 nt, Artificial Sequence
  derived and/or modified sequence opt11 from anti-HIV_Chain
caaguccaacucguccaauccggcgccgcccucaaaaaacccggcgccucccuccgcaucuccugccaagccuacggcuacaaauucaccgaccaccucaucuacugguggcgccaagcccccggccaaggccucgaauggaucggcuggaucaaacccgaaaccggccaacccuccuacuccuacaaauuccaaggacgcgucucccuaacccgcgacaccuuccaagaaauccucuucauggaccuccgcggccuccgcuccgacgacaccgccaucuacuucugcgcccgacgccacuccgacuacugcgacuucgacgucuggggcuccggcucccaagucaucgucuccuccgccuccaccaaaggc

SEQ ID NO: 57713 - RNA, 372 nt, Artificial Sequence
  derived and/or modified sequence opt11 from anti-HIV_Chain
caaguccaacucguccaaucaggcgccgcccucaaaaaacccggcgccucacuccgcaucuccugccaaaccuacggcuacaaauucaccgaccaccucaucuacugguggcgccaagcccccggccaaggacucgaauggaugggcuggaucaaacccgaaaccggccaacccuccuacuccuaccgcuuccaaggccgcgucucccucacccgcgacaccuucgaagaaaucgucuucauggaccuccgcggccuccgauccgacgacaccgccaucuacuucugcgcccgccgccacuccgacuacugcgacuucgacgucuggggcuccggcucccaagucaucgucuccuccgccuccaccaaaggc

SEQ ID NO: 57714 - RNA, 372 nt, Artificial Sequence
  derived and/or modified sequence opt11 from anti-HIV_Chain
caagugcaauugguccagagcggggccgcgcucaagaaaccgggagcgagcuugcgcauaagcugucaaacguacggguacaaguucacggaccaucucauauacugguggagacaagcgcccgggcaagggcucgaguggauaggcuggaucaagcccgagaccgggcaaccgagcuauagcuaucgauuucaagggcgcgugagcuugaccagggacacguucgaggaaauagccuuuauggaucucaggggcuugcgcucggacgauaccgcgaucuauuucugugccaggcgccacaccgacuacugugucuuugacgugugggggagcgggagccagaucauagucucgagcgcgagcacgaaaggg

SEQ ID NO: 57715 - RNA, 372 nt, Artificial Sequence
  derived and/or modified sequence opt11 from anti-HIV_Chain
caaguccaacucguccaauccggcaccgccgucaaacgccccggcgccuccguccgcgucuccugccaagccuccggcuacaccuucaccgacuacuucaucuacugguggcgccaagcccccggccaaggccucgaauggcucggcuggaucaacccccuaaccucccaacccucauaccccucccgcuuccaaggccgccucacacucacccgagacaccuucgacgaaaugcucuacauggaccuccgcggccuccgcuccgacgacaccggcaucuacuucugcgcccgccgccacuccgacuacugcgacuucgacaucuggggcuccggcacccaaaucauagucuccuccgccuccaccaaaggc

SEQ ID NO: 57716 - RNA, 372 nt, Artificial Sequence
  derived and/or modified sequence opt11 from anti-HIV_Chain
caaguccaacucguccaauccggcgccgcccucaaaaaaccaggcgccuccguccgcaucuccugccaagccuacggcuacaaauucaccgaccaccucaucuacugguggcgccaagcccccggccaaggccucgaauggaucggcuggaucaaacccgaaaccggccaacccuccuacgccuacaaauuccaaggccgcgucacccucacccgcgacaccuucgaagaaauccacuucauggaccuccgcggaguccgcaacgacgacaccgccaccuacuucugcgcccgccgccacuccgacuacugcgacuucgacgucuggggcuccggcucccaagucaucgucuccuccgccucaaccaaaggc

SEQ ID NO: 57717 - RNA, 372 nt, Artificial Sequence
  derived and/or modified sequence opt11 from anti-HIV_Chain
caagugcaauugguccagagcggggccgcgcucaagaaaccgggcgcgagcgugcgcauaagcugucaaacguacggguacaaguucacggaccaucucauauacugguggaggcaagcgcccgggcaagggcucgaguggauaggcuggaucaagcccgagaccgggcaaccgagcuauagcuaucgcuuucaagggcgcgugagcuugaccagggacacguucgaggaaauagucuuuauggaucucaggggcuugcgcucggacgauaccgcgaucuauuucugugccaggcgccauagcgauuacugugacuuugacgugugggggagcgggagccaggucuuggucucgagcgcgagcacgaaaggg

SEQ ID NO: 57718 - RNA, 372 nt, Artificial Sequence
  derived and/or modified sequence opt11 from anti-HIV_Chain
caaguccaacucguccaauccggcgccgcccucaaaaaacccggcgccucccuccgcaucuccugccaaaccuacggcuacaaauucaccgaccaccucaucuacugguggcgccaagcccccggccaaggccucgaauggaucggcuggaucaaaccagaaaccggccaacccuccuacuccuaccgcuuccaaggccgcgucucccucacccgcgacaccuucgaagaaaucgucuucauggaccuccgcggccuccgcuccgacgacaccgccaucuacuucugcgcccgccgccacuccgacuacugcgacuucgacgucuggggcuccggcucccaaguccucgucuccuccgccucaaccaaaggc

SEQ ID NO: 57719 - RNA, 372 nt, Artificial Sequence
  derived and/or modified sequence opt11 from anti-HIV_Chain
caagugcaauugguccagagcggggccgcgcucaagaaaccgggcgcgagcgugcgcauaagcugucaaacguacggguacaaguucacggaccaucucauacacugguggaggcaagcgcccgggcaagggcucgaguggauaggcuggaucaagcccgauaccgggcaaccgaguuauagcucgcgcuuucaagggcgcgugagcuugaccagggacacguucgaggaaauagucuuuauggaucucaggggcuugcgcucggacgauaccgcaaucuauuucugugccaggcgccauagcgauuacugugacuuugacgugugggggagcgggagccaggucuuggucucgagcgcgagcacgaaaggg

SEQ ID NO: 57720 - RNA, 372 nt, Artificial Sequence
  derived and/or modified sequence opt11 from anti-HIV_Chain
caaguccaacucguccaauccggagccgcccucaaaaaacccggagccucccuacgcaucuccugccaaaccuacggcuacaaauucaccgaccaccucaucuacugguggcgccaagcacccggccaaggccucgaauggaucggcuggaucaaacccgaaaccggccaacccuccuacuccuaccgcuuccaaggccgcgucucccucacccgagacaccuucgaagaaaucgucuucauggaccuccgcggccuccgcuccgacgacaccgccaucuacuucugcgcccgccgccacuccgacuacugcgacuucgacgucuggggcuccggcucccaagucaucgucuccuccgccuccaccaaaggc

SEQ ID NO: 57721 - RNA, 372 nt, Artificial Sequence
  derived and/or modified sequence opt11 from anti-HIV_Chain
caagugcaauugguccagagcggggccgcgcucaagaaaccgggggcgagcuugcgcauaaguugucaaacguacggguacaaguucacggaccaucuaauauacugguggaggcaagcgcccgggcaagggcucgaguggauaggcuggaucaagcccgagaccgggcaaccgagcuauagcuaucgcuuucaagggcgagugagcuugaccagggacacguucgaggaaauagucuuuauggaucucaggggcuugcgcucggacgauaccgcgaucuauuucugugccaggcgacauagcgauuacugugacuuugacguguggggcggcgggagccaggucauagucucgagcgcgagcacgaaaggg

SEQ ID NO: 57722 - RNA, 372 nt, Artificial Sequence
  derived and/or modified sequence opt11 from anti-HIV_Chain
caaguccaacucguccaauccggcgccgcccucaaaaaacccggcgccucccuacgcaucuccugccucaccuacggcuacaaauucaccgaccaccucaucuacugguggcgccaagcccccggccaaggccucgaauggaucggcuggaucaaacccgaaaccggccaacccuccuacuccuaccgcuuccaaggccgcgucucccucacccgcgacaccuucgaagaaaucgucuucauggaccuccgcggccuccgcuccgacgacaccgccaucuacuucugcgcccgccgacacuccgacuacugcgacuucgacgucuggggcuccggcucacaagucaucgucuccuccgccuccaccaaaggc

SEQ ID NO: 57723 - RNA, 372 nt, Artificial Sequence
  derived and/or modified sequence opt11 from anti-HIV_Chain
caaguccaacucguccaauccggcgccacccucaaaaaacccggcgccuccguccgcaucuccugccaagccuacggcuacaaauucaccgaccaccucauccacugguggcgccaagcccccggccaaggccucgaauggaucggcuggaucaaacccgaaaccggccaacccuccuacgccuacaaauuccaaggccgcgucucccucacccgcgacaccuucgaagaaauccucuucauggaccuacgcggccuacgcuccgacgacaccgccaucuacuucugcgcccgccgccacuccgacuacugcgaccucgacgucuggggcggcggcacccaacuccucgucuccuccgccuccaccaaaggc

SEQ ID NO: 57724 - RNA, 372 nt, Artificial Sequence
  derived and/or modified sequence opt11 from anti-HIV_Chain
caagugcaauugguccagagcggggccgcgcucaagaaaccgggcgcgagcgugcgcauaagcugucaagcguacggguacaaguucacggaccaucucauauacugguggaggcaagcgcccgggcaagggcucgaguggauaggcuggaucaagcccgagaccgggcaaccgagcuauagcuauaaauuucaagggcgcgugaccuugaccagggacacguucgaggaaauacacuuuauggaucucaggggcuugcgcuaugacgauaccgcgaccuauuucugugccaggcgccauagcgauuacugugacuuugacgugugggggagcgggagccaggucucggucucgagcgcgagcacgaaaggg

SEQ ID NO: 57725 - RNA, 372 nt, Artificial Sequence
  derived and/or modified sequence opt11 from anti-HIV_Chain
caaguccaacucguccaauccggcgccgcccucaaaaaacccggcgccucccuccgaaucuccugccaagccuacggcuacaaauucacagaccaccucaucuacugguggcgacaagcccccggccaaggccucgaauggaucggcuggaucaaacccgaaaccggccaacccuccuacuccuacaaauuccaaggccgcgucucccucacccgcgacaccuuccaagaaauccucuucaugaaccuccgcggccuccgcuccgacgacaccgccaucuacuucugcgcccgccgccacuccgacuacugcgacuucgacgucuggggcuccggcucccaaauccuagucuccucagccuccaccaaaggc

SEQ ID NO: 57726 - RNA, 372 nt, Artificial Sequence
  derived and/or modified sequence opt11 from anti-HIV_Chain
caaguccaacucguccaauccggcaccgccgucaaaaaacccggcgccuccguccgcgucuccugccaagccuccggcuacaccuucaccgacuacuucaucuacugguggcgccaagcccccggccaaggccucgaauggcucggcuggaucaacccccgcacaucccaacccuccuaccccuaccgcuuccaaggccgagucacccucacccgcgacaucuucgaagaaaugcucuacauggaccuccgcggccuccgcuccgacgacaccggcaucuacuucugcgcccgccgccacuccgacuacugcgacuucgacaucuggggcuccggcacccaaaucaucgucuccuccgccuccaccaaaggc

SEQ ID NO: 57727 - RNA, 372 nt, Artificial Sequence
  derived and/or modified sequence opt11 from anti-HIV_Chain
caagugcaauugguccagagcggggccgcgcucaagaaaccgggggcgagccugcgcauaagcugucaagcguacggguacaaguucacggacuaucucauacacugguggaggcaagcgcccgggcaagggcucgaguggauaggcuggaucaagcccgagaccgggcaaccgagcuauagcuauaaauuucaagggcgcgugagcuugaccagggacacguucgaggaaauacucuuuauggaucucaggggcuugcgaucggacgauaccgcgaucuauuucugugccaggcgccauagcgauuacugugacuuugacguguggggcggcgggagccaggucuuggucucgagcgcgagcacgaaaggg

SEQ ID NO: 57728 - RNA, 372 nt, Artificial Sequence
  derived and/or modified sequence opt11 from anti-HIV_Chain
gaaguacaacuacucgaauccggcggcgcccucguccaacccggcggcucccuccgccucuccugcgccgccuccggcuucaccuucuccaccuccuccaugucauggguccgccaagcccccggcaaaggccucgaaugggucuccgccaucggcuccggccgcggcuccaccuucuacgccgacuccgucaaaggccgcuucaccaucucccgcgacaacuccaaaaacacccucucccuccaaaugaacucccucaccgccgaagacaccgccaccuacuacugcaccaaaaccggcggccuacuccgcuuccccgaagucuggggcaaaggcaccaccgucaccgucuccuccgcauccaccaaaggc

SEQ ID NO: 57729 - RNA, 372 nt, Artificial Sequence
  derived and/or modified sequence opt11 from anti-HIV_Chain
gaaguccaacucgucgaauccggcggcggccucgucaaacccggcggcucccuccgccucuccugcgccgacuccggcuucaccuuccgcuccuacuccaugcacuggguccgccaagcccccggcaaaggccucgccugggucucauccaucuccucaaccuccaacuacaucuacuacgccgacuccgucaaaggccgcuucacaaucucccgagacaacgccaaaaacucccucuaccuccaaaugaacucccuccgcgccgaagacaccgccgucuacuacugcgcccgcaccuucaucaccgccuccugguucgacuccuggggccaaggcacccucgucaccgucuccuccgccuccaccaaaggc

SEQ ID NO: 57730 - RNA, 372 nt, Artificial Sequence
  derived and/or modified sequence opt11 from anti-HIV_Chain
caagugcaauugguccagagcggggccgaggucaagaaaccgggcgcgagcgugaaagugagcuguaaagcgagcggguacacguucacgaacuauggcgugagcugggucaggcaagcgcccgggcaagggcucgaguggaugggcuggaucucgcccuauagcgggaacacgaacuaugcccagcgcuugcaagaucgcgugaccaugaccacggacacgagcacgaacacggccuauauggagcucaggagcuugcgcucggacgauaccgcggucuauuacugugccgcgcgaucguacuauuacuauagcauggacguaugggggcaagggaccacggucacggucucgagcgcgagcacgaaaggg

SEQ ID NO: 57731 - RNA, 372 nt, Artificial Sequence
  derived and/or modified sequence opt11 from anti-HIV_Chain
caaguccaacucguacaauccggcgccgaacucaaaaaacccggcuccuccgucaaagucuccugcaaagccuccggcggcaccuucuccaacuacgccaucaacuggguccgccaagcccccggccaaggcuucgaauggaugggcggcaucaucccccuauucgccacccccaccuacgcccaaaaauuccaaggccgcguccgcaucaccgccgacgacuccaccuccaccgccuacauggaacucuccucacuccgcuccgacgacaccgccgucuacuucugcgcccgccccaacgucguccgcuccgcacucgacuacuggggccaaggcacccucgucaccgucuccucagccuccaccaaaggc

SEQ ID NO: 57732 - RNA, 372 nt, Artificial Sequence
  derived and/or modified sequence opt11 from anti-HIV_Chain
cagguccagcucguggaaucgggcgggggcgugguccagcccgggaaaucgcucaggcucucgugcgcggccucgggcuuuaccuuuagcacgcacgcgaugcauugggugcgacaggccccgggcaagggccuggacugggucgcggucauaagccaugacggggacaaucaauauuacgcggacgcggucaagggcagguucacgaucucgcgcgaugacucgcgcgauaccguguucuugcaaaugaacucgcucaggaccgaggacacgggcguguacuauugcgcggccgauagcucaggcucgaacugguucgauuacuggggccagggcauacucgugaccgugagcucagccucgaccaagggc

SEQ ID NO: 57733 - RNA, 375 nt, Artificial Sequence
  derived and/or modified sequence opt11 from anti-HIV_Chain
caagugcgacugagccagagcggaggccagaugaagaaaccgggcgagagcaugcgcuugagcugucgcgcgagcggguacgaguucuugaacugucccauaaacuggaucaggcucgcgcccgggcgcaggcccgaguggaugggcuggcucaagcccaggggcggggccgugaacuaugccaggaaauuucaagggcgagugaccaugaccagggacguauacucagacacggccuuucucgagcucaggagcuugaccucggacgauaccgcggucuauuucuguaccaggggcaaguacuguaccgcgcgcgauuacuauaacugggacuuugaacacugggggcgcggggccccggucacggucucgagc

SEQ ID NO: 57734 - RNA, 375 nt, Artificial Sequence
  derived and/or modified sequence opt11 from anti-HIV_Chain
gaaguccaacucguccaaucaggcuccgacguccgcaaacccggcgccaccgucaccgucuccugcaaagccgacgaagacgaagacgacuucaccgccuacaacuacuucaugcacuggguccgccaagcccccggccacggccucgaauggaucggcuggaucaacccccgcaccggccaacccaaccacgccaaacaauuccaaggccgcgucacacucacccgcgaacgcuccacaucaaccgucuucaugaaacucaccaaccuccgccucgacgacaccgcagucuacuucugcgccagaccccuccgaggcggcgacaccuggcacuaccacuccuggggccgcggcaccucccucaccgucucauca

SEQ ID NO: 57735 - RNA, 375 nt, Artificial Sequence
  derived and/or modified sequence opt11 from anti-HIV_Chain
caaguccaacucguccaauccggcggcggccucguccaacccggcgaaucccuccgccucuccugcaccgccuccggcuucaccuucuccuccuacaacaugaacuggguccgccaagcccccggcaaaggccucgaauggaucuccuacaucuccgacaaauccaaaaacaaauacuacgccgacuccguccgcggccgcuucaccaucucccgcgacaacgcccaaaacucccucuuccuccaaauguccucacuccgcgacgaagacaccgccgucuacuacugcacccgcgaaggcccccaacgcuccuucuacuucgacuacuggggccaaggcauccaagucaccgucuccuccgccuccaccaaaggc

SEQ ID NO: 57736 - RNA, 375 nt, Artificial Sequence
  derived and/or modified sequence opt11 from anti-HIV_Chain
gaagugcaauuggucgagagcggggccgaggucaagaaaccgggcucgagcgugaaagugagcuguaaagcgagcggaggcacguucucgagcuauagcauaagcugggucaggcaagcgcccgggcaagggcucgaguggaugggcgggaucauacccauauucgcgaccacgcacuauggccagaaauuucaagggcgcauaaaaauaaccgcggacaagagcacgagcacagccuauauggagcucucgcgcuugcgcucggaagauaccgcggucuauuacugugccagggacagggaauuuuacuuuuacgggauggaugucuggggccagggcacgacagugaccgugagcucggccucgaccaagggc

SEQ ID NO: 57737 - RNA, 375 nt, Artificial Sequence
  derived and/or modified sequence opt11 from anti-HIV_Chain
caauugcaauugcaagagagcgggcccgggcucgugaaaccgugggagaccuuggucuugaccuguagcgugagcgggggcucgaucucgagcggggacuauuacuggggcuggaucaggcaaucgcccgggaaagggcccgaguggauaggcaauaucuuuuacucgagugggaacacguacuauaacacgagcuugaaaucgcgcgugaccauaagcguggacgugagcaagaacagguucucgcucaagcucacgagcaugaccgcggccgauaccgcggucuauuacuguggcaggcucucgaacaagggcugguucgaucccuggggccagggcacgcucgugagcgugagcucggccucgaccaagggc

SEQ ID NO: 57738 - RNA, 375 nt, Artificial Sequence
  derived and/or modified sequence opt11 from anti-HIV_Chain
gaaaucguccucacccaaucccccgccacccucucccucucccccggcgaacgcgccacccucuccugccgagccucacaauccgucuccuccuaccucgccugguaccaacaaaaacccggccaagccccccgccuccucaucuacgacgccuccaaccgcgccaccggcauccccgcccgcuucuccggcuccggcuccgacaccgacuucacccuaaccaucuccucccucgaacccgaagacuucgccgucuacuacugccaacaacgcggcaucuggccccuccaaaucaccuucggccaaggcacccgccucgaaaucaaacgcaccgucgccgcccccucagucuucaucuucccccccucagacgaa

SEQ ID NO: 57739 - RNA, 375 nt, Artificial Sequence
  derived and/or modified sequence opt11 from anti-HIV_Chain
uccgaaaucguccucacccaaucccccggcacccucucccucucccccggcgaacgcgccacccucuccugccgcgccucccaauccgucuccuccuccuaccucgccugguaccaacaaaaacccguccaagccccccgccuccucaucuacggcgccuccucccgcgccaccggcauccccgaccgcuucuccggcuccggcuccggcaccgacuucacccucaccaucucccgccucgaacccgaagacuucgccgucuacuacugccaacaauacggcacccuccacccccgcaccuucggccaaggcaccaaagucgaaaucaaacgcaccgucgccgcccccuccgucuucaucuucccccccuccgac

SEQ ID NO: 57740 - RNA, 375 nt, Artificial Sequence
  derived and/or modified sequence opt11 from anti-HIV_Chain
ucccaagccgucgucacacaaccccccuccgucuccggcgcccccggccaacgcgucaccaucuccugcuccggcggccccuccaacgucggcggcaaccucguauacugguacaaacaauuccccggcaccgcccccaaacuccucauccgccgcgacgaccaacgccccuccggcguccccgaccgcuucuccggcuccaaauccggcaacuccgccucccucgccaucuccggccuccgacccgacgacgaagccuucuacuucugcgccaccuacgacucccacggcuccauccgccucuucggcggcggcacccuccucaccguccucucccaacccaaagccgcccccucagucacccucuuccccccc

SEQ ID NO: 57741 - RNA, 375 nt, Artificial Sequence
  derived and/or modified sequence opt11 from anti-HIV_Chain
gacauccaaaugacccaaucccccuccacccucgccgccuccaucggcggcaccguccgcgucuccugccgcgccucccaauccaucaccggcaacugggucgccugguaccaacaacgccccggcaaagccccccgccuccucaucuaccgcggcgccgcccuccucggcggcguccccucacgcuucuccggcuccgccgccggcaccgacuucacccucaccaucggcaaccuccaagccgaagacuucggcaccuucuacugccaacaauacgacaccuaccccggcaccuucggccaaggcaccaaagucgaagucaaacgcaccgucgccgcccccuccgucuucaucuucccccccuccgacgaacaa

SEQ ID NO: 57742 - RNA, 375 nt, Artificial Sequence
  derived and/or modified sequence opt11 from anti-HIV_Chain
gaaaucgucaugacccaaucccccgacacccucuccgucucccccggcgaacgcgccacccucuccugccgcgccucccaauccgucaacuccaaccuagccugguaccaacaaaaacccggccaagccccccgccuccucaucuacggcgccuccacccgcgccaccgccguccccgcccgcuucuccggcuccggcuccggcaccgaauucacccucaccaucuccucccuccaauccgaagacuccgccgucuacuacugccaacaauacuaccaauggcucuccuacaccuucggccaaggcaccaaacucgaaaucaaacgcaccgucgccgcccccuccgucuucaucuucccccccuccgacgaacaa

SEQ ID NO: 57743 - RNA, 375 nt, Artificial Sequence
  derived and/or modified sequence opt11 from anti-HIV_Chain
cgccaaguccaacucguccaauccggcgccgcccucaaaaaacccggcgccucccuccgcaucuccugccaagccuacggcuacaaauucacagaccaccucaucuacugguggcgccaagcccccggccaaggccucgaauggaucggcuggaucaaacccgaaaccggccaacccuccuacuccuacaaauuccaaggccgcgucucccucacccgagacaccuuccaagaaauccucuucauggaccuccgcggccuccgcuccgacgacaccgccaucuacuucugcgcccgccgccacuccgacuacugcgacuucgacgucuggggcuccggcucccaaauccucgucuccuccgccuccaccaaaggc

SEQ ID NO: 57744 - RNA, 375 nt, Artificial Sequence
  derived and/or modified sequence opt11 from anti-HIV_Chain
caagugcaauugguccagagcggggccgcgcucaagaaaccgggcgcgagcgugcgcauaagcugucaagcguacggguacaaguucacggacuaucucauacacugguggaggcaagcgcccgggcaagggcuagaguggauaggcuggaucaagcccgagaccgggcaaccgagcuauaguuauaaauuucaagggcgcgugacccugaccagggacacguucgaggaaauacucuuuauggaucucaggggccugcgcucggacgauaccgcgaucuauuucugugccaggcgccauagcgauuacugugacuuugacgugugggggagcgggagccaggucauagucucgagcgcgagcacgaaaggggcc

SEQ ID NO: 57745 - RNA, 375 nt, Artificial Sequence
  derived and/or modified sequence opt11 from anti-HIV_Chain
gaagugcaauuggucgagagcgggggcgggcucgugaaaccgggcgggagcuugcgcuugagcugugccgcgagcggguucucguucucggaacauuacaugagcuggaucaggcucgcgcccgggaaagggcucgagugguugaguuauaucucgagcucgaccaggaccacguacucggccgauagcgugcgcgggcgcuuuaccauaagcagggacacggccaagcaauugcucuuucuccauaugucgagcuugcgagcggaagauaccgcggucuauuacugugucaggcucuauggcgggaucaauggcugguucgaucaauggggccagggcacgcuagugagcgugagcucggccucgaccaagggc

SEQ ID NO: 57746 - RNA, 375 nt, Artificial Sequence
  derived and/or modified sequence opt11 from anti-HIV_Chain
caaguccaacucguccaauccggacccggccucgucaaacccuccgaaacccucucccucaccugcuccgucuccaacggcuccaucuccuccggcggcuacuacugguccuggcuccgccaauuccccggcaaaggccucgaauggaucggcuccauccacuacaccggccgcaccuucuacaaccccucccucaugggccgcaccgcccucuccauggacaccuccaacaaccaauucucccucaaaguauccuccgucaccgccgccgacaccgcccucuacuacugcgcccgcgaacuccaauggauguucgucgucgaccccuggggccaaggcacccucgucaccgucuccuccgccuccaccaaaggc

SEQ ID NO: 57747 - RNA, 375 nt, Artificial Sequence
  derived and/or modified sequence opt11 from anti-HIV_Chain
caaguccaacuccaagaauccggccccggccucgucaaacccuccgaaacccucucccuaaccugcuccgucuccaacggcuccaucuccuccggcggcuacuacugguccuggcuccgccaauuccccggcaaaggccucgaauggaucggcuccauccacuacaccggccgcaccauguacaaccccucccucaugggccgccccgcccucuccauggacaccuccaacaaccaauucucccucaaacuccgcucagucaccgccgccgacaccgcccucuacuucugcgcccgcgaccuccaauggaucuucgucgucgaccccuggggccaaggcacccucgucaccgucuccuccgccuccaccaaaggc

SEQ ID NO: 57748 - RNA, 375 nt, Artificial Sequence
  derived and/or modified sequence opt11 from anti-HIV_Chain
gaggugcaguuguuggagagugggggggggcuagugcagccgggggggaguuugagguugaguugugcggugagcggguuuacguuugggggacaugcggugagcugggugaggcaggcgccggggaaggggcuggagugguugagucagauaagugggacggggaguaggacggauuaugcggaugcggugaaggggagguuuacggugagcagggauaauaguaagaagacgguguauuugcagaugaauagcuugaggguggaggauacggcgcuguuuuauugugcgacgaggaguccgggggggggguaugcguucgauauaugggggcagggggcgauggugacggugagcagugcgaguacgaagggg

SEQ ID NO: 57749 - RNA, 375 nt, Artificial Sequence
  derived and/or modified sequence opt11 from anti-HIV_Chain
caaguccaacucguccaauccggcgccgaagucaaaaaacccggcuccuccgucaaagucuccugcaaagucuccuucuucuccaacuacggcaucuccuggguacgccaacgccccggccaaggccucgaauggaugggccgcaucauccccgccaucgacgacaugaccuacgcccaaaccuuccgcggccgcgucaccuucuccgccgacaaauucaccaccaccgccuacauggaacucaccggccucaccuucgaagacaccgccaccuacuucugcgcccgcgacccccaagucaaccgccgcggcaacugcuucgaccacuggggccaaggcacccucgucaccgucuccuccgccuccaccaaaggc

SEQ ID NO: 57750 - RNA, 375 nt, Artificial Sequence
  derived and/or modified sequence opt11 from anti-HIV_Chain
caaguccaacuccaagaauccggccccggccucgucaaacccuccgaaacccucucccucaccugcaccgucuccggcggcuccaucuccuacuacuacugguccuggauccgccaaccccccggcaaaggccucgaauggaucggcgacaucuacuacuccggaaccaccgacuacaaccccucccucaaaucccgcgucaccaucuccgucgacaccuccaaaaaccaauucucccucaaacucuccuccgucaccgccgccgacaccgccgucuacuacugcgcccgccgccgcggccaacgccuccucgccuacuucgacuacuggggccaaggcucccucgucaccgucuccuccgccuccaccaaaggc

SEQ ID NO: 57751 - RNA, 375 nt, Artificial Sequence
  derived and/or modified sequence opt11 from anti-HIV_Chain
caaguccaacuccaagaauccggccccggacccgucaaacccuccgaaacccucucccuaaccugcaccgucuccggcggcuccaugaucuccuacuacugguccuggauccgccaaccccccggcaaaggccucgaauggaucggcuacaucuucaccaacggccgcaccaccuacucacccucccuccgcucccgcgucaccaucucccucgacaccuccaccaaccacuucucccuccgccucaaaucagucaccgccgccgacaccgccaucuacuacugcgcccgccucgacggcgaagccuuccgcuacuaccuugaccucuggggccaaggcaaccucgucaccgucuccuccgccuccaccaaaggc

SEQ ID NO: 57752 - RNA, 375 nt, Artificial Sequence
  derived and/or modified sequence opt11 from anti-HIV_Chain
caagugcaauugguccagagcggggccgaggucaagaaaccgggcgcgagcgugaaagugagcuguaaaccgagcucgaacacguucacgagccauuacauacacugggucaggcaagcgcccgggcaagggcucgaguggaugggcaugaucaaucccgggggcucgaccagguacgcgccaaaguuccagggcagggucacgcucacgcgcgauaccucgaccaggaccguguacauggaauuaagcucgcuaaggagcgaggacacggccguguacuauugcgcgcgcccgcaauauaacuugggcagagacccgcuagaugucuggggcuugggcacgauggugaccgugagcucagccucgaccaagggc

SEQ ID NO: 57753 - RNA, 375 nt, Artificial Sequence
  derived and/or modified sequence opt11 from anti-HIV_Chain
caaguccaacuccaacaauggggcgccggccuccucaaacccuccgaaacccucucccucaccugcgccgucuacggcggcuccuucuccggcuacuacugguccuggauccgccaaccccccggcaaaggccucgaauggaucggcgaaaucaaccacuccggcuccaccaacuacaaccccucccucaaaucccgcgucaccaucuccgucgacaccucaaaaaaccaauucucccucaaacucuccuccgucaccgccgccgacaccgccgucuacuacugcgcccgacuccccaucggcuccggcugguacggccgcgacuacuggggccaaggcacccucgucaccgucuccuccgccuccaccaaaggc

SEQ ID NO: 57754 - RNA, 375 nt, Artificial Sequence
  derived and/or modified sequence opt11 from anti-HIV_Chain
caagugcaauugguccagagcggggccgaggucaagaaaccgggcgcaagcgugaaagugagcuguaaagcgagcgggaacacguucacgagcuauggcauaaccugggucaggcaagcgcccgggcaagggcucgaguggaugggcuggaucucggccuauaacgggaacacgaacuaugcccagaaauugcaagaucgcuugaccaugaccacggacacgagcacgagcacggccuauauggagcucaggagcuugcgcucggacgauaccgcggucuauuacugugccuuuagcaggcacuauggcucgggcaauuacgauuacuggggccagggcacgcucgugaccgugagcucggccucgaccaagggc

SEQ ID NO: 57755 - RNA, 375 nt, Artificial Sequence
  derived and/or modified sequence opt11 from anti-HIV_Chain
caauuucgcuugguacagagcgggcccgaggucaagaacccgggcucgagcgugaccgugagcuguaaagcgagcgggggcacguucucgggcuugggcauaaacugggucaggcaagcgcccgggcaagggcucgagugguugggcgauaucaagaccauguacgggaccacaaacuaugccccgaaauuucaagggcgcgugaccauaaccgcggacgagagcacgagcacgagcuauauggagcucucgggcuugcgcucggaagauaccgcggucuuuuacugugucagggaauuguucgggcaccaucccgcguucggggucuggggccagggcacgagcgugaucgugagcucggccucgaccaagggc

SEQ ID NO: 57756 - RNA, 375 nt, Artificial Sequence
  derived and/or modified sequence opt11 from anti-HIV_Chain
cgcgugcaauugguccagagcggggccgaggucaagaaaccgggcucgagcgugaccgugagcuguaaagcgagcgggggcucguucucgagcuaugccauaagcugggucaggcaagcgcccgggcaagggcucgagugggugggcggggucaagguaauguucgggaccgugcacuauagccagaaagugcaagggcgaguaaccauaaccgcggacgauagcacgggcacgagcuaucucgagcucucgggcuugcgcucggccgauaccgcggucuauuacugugccaggaacgcgggcgcguacuuuuacccguucgauaucuggggccagggcacgcucauaauagugagcucggccucgaccaagggc

SEQ ID NO: 57757 - RNA, 375 nt, Artificial Sequence
  derived and/or modified sequence opt11 from anti-HIV_Chain
caaguccaacuccaagaauccggccccggccucgucaaacccuccgaaacccucucccucaccugcaccgucucaggcggcuccaucucaucccgcucauacuacuggggcuggauccgccaaccccccggcaaaggccucgaaugggucggcuccauauacuacaccggcuccaccuacuacucccccucccucaaaucacgcgucaccaucuccgucgacaccucccaaaaccaauucucccucaaacucaacuccgucaccgccgccgacaccgccgucuacuacugcgcccgccaaaaaggauccggcaccucccuccucuacuggggccaaggcacccuagucaccgucuccuccgccuccaccaaaggc

SEQ ID NO: 57758 - RNA, 375 nt, Artificial Sequence
  derived and/or modified sequence opt11 from anti-HIV_Chain
cagguccagcuagugcaaucgggcacggaagugaaaaagcccgggagcucggucaaggucucgugcaaggccucgggcgggaccuuuagcgauagcgauaucgcgugggugcgccaggccccgggccagggcuuggaauggaugggcgggauaaccccgauguuugacauggccaagagcgcgcaaaaguucaggggcaggcucauaaucacggccgauaaaucgaccgggaccgcguacauggaauugagcucgcucagguacgaggacgcggccguguacuuuugcgcgcgcucgagcgggaacuuugaauuugccuuugaaauaugggggcaagggaccaagaucauagucucgcucgcgagcacgaaaggg

SEQ ID NO: 57759 - RNA, 375 nt, Artificial Sequence
  derived and/or modified sequence opt11 from anti-HIV_Chain
gucgugcaauugguccagagcgggaccgaggucaagaaaccgggcucgagcgugaaagugagcuguaaagcgagcgggggcacguucucgggcucggacauaagcugggucaggcaagcgcccgggcaagggcucgaguggaugggcgggaucauacccauguucgauaucgaggaccaugcccagaaauuucgcgggcgauugaccauaaccgcggacaagagcacgggcgcggccuauauggagcucucgagcuugcgcucggaagaugccgcggucuauuacugugccaggagcucgggcaauuacgauuucgcguucgauaucuggggccagggcacgcgauugauagugagcucggccucgaccaagggc

SEQ ID NO: 57760 - RNA, 375 nt, Artificial Sequence
  derived and/or modified sequence opt11 from anti-HIV_Chain
gucgugcaauuggucgagagcgggaccgaggucaagaaaccgggcucgagcgugaaagugagcuguaaagcgagcgggggcacguucucgggcucggacauaagcugggucaggcaagcacccgggcaagggcucgaguggaugggcgggaucauacccauguucgauaucgagaaccaugccgagaaauuucgagggcgcuugaccauaaccgcggucaagagcacgggagcggccuauauggagcucucgagcuugcgcucggaagaugcagcggucuauuacugugccaggagcucgggcaauuacgauuucgcguacgauaucuggggccagggcacgagagugaucgugagcucggccucgaccaagggc

SEQ ID NO: 57761 - RNA, 378 nt, Artificial Sequence
  derived and/or modified sequence opt11 from anti-HIV_Chain
cagguccagcuagugcaaucgggcucggccaugaaaaagcccggggccucggucagggucucgugcuggaccucggaagauaucuuugacacgaccgagcucauacacugggucaggcaagcgcccgggcaaggacucgaguggauaggaugggucaaggccgugagcggggccgugaacuauggcucgcuagauuucagacacagggucucgcucacgcgcgaucgcgaucucucgaccgcgcacauggacauacgcgggcuaacgcaagaugacacggccacguacuuuugcgcgcgccagaaauuugccaggggcgaucaagggugguuuuucgaucucuggggcaggggcacgcucauagucgugagcucggcc

SEQ ID NO: 57762 - RNA, 378 nt, Artificial Sequence
  derived and/or modified sequence opt11 from anti-HIV_Chain
caaguccaacuccaagaauccggacccggccucgucaaacccuccgaaacccucucccucaccugcaccgucucaggcggcuccaucuccaaccacuacugguccuggauccgccaaccccccggcaaaggccucgaauggaucggcuacaucuaccacuccggcaacaucaacuacaaauccucccucaaaucccgcgccaccaucucaaucgacaccuccaacaaccaauucucccucaaacucuccuccgucaucgccgccgacaccgccgucuacuacugcgcccgcaacuucggccccggcucccccaacuacggcauggacgucuggggccaaggcaccaccgucaccgucuccuccgccuccaccaaaggc

SEQ ID NO: 57763 - RNA, 378 nt, Artificial Sequence
  derived and/or modified sequence opt11 from anti-HIV_Chain
caagugcaauugguccagagcgggggcggggucgugcaaccgggcaggagcuugcgcuugagcugugccgcgagcggguucacguucucgcaccauggaauacacugggucaggcaagcgcccggggaagggcucgaguggguggccgugaucucggaagauggcacgaacauacacuaugaagauagcgugcgcgggcgcuuuaccauaagcagggacaauagcaagaacacggucgaucuacagaugaauagcuugcgcgcggaagauaccgcggucuauuacugugccucgcucauaagcaugcgagauggcgaugccuuugacuugugggggcaagggaccagggucacggucucgagcgcgagcacgaaaggg

SEQ ID NO: 57764 - RNA, 378 nt, Artificial Sequence
  derived and/or modified sequence opt11 from anti-HIV_Chain
caagugcaauugguagagagcgggggagggcuagggcaaccgggagggagcuugagauugagcugugcagcgagcggguucacguucaggaacuaugcaaugagcuggguaaggcaagcggccgggaaagggcuagagugggugagcggggucucgggcgggggagauaccacguacuauggcgauagcgugaaagggcgcuuuacaauaagcagggacaauagcaagaacacgcuauaucuacagaugaauaacuugagagcggaagauacagcgguauauuacugugcaaaggacaagggcgugugggggagcucggacuuugacuauugggggcaagggacauugguaacgguaucgagcgcgagcacgaaaggg

SEQ ID NO: 57765 - RNA, 378 nt, Artificial Sequence
  derived and/or modified sequence opt11 from anti-HIV_Chain
gaagugcaauuggucgagagcgggggcggggucgugcaaccgggaaggagcuugcgcuugagcugugccgcgagcggguucacguucucgcaccauggcauacacugggucaggcaagcgcccggggaagggcucgaguggguggccgugaucucggaagauggcacaaacauacacuaugaagauagcgugcgcgggcgcuuuaccauaagcagggacaauagcaagaacacggucgaucuccagaugaauagcuugcgcgcggaagauaccgcggucuauuacugugccucgcucauaagcaugcgcgauggcgaugccuuugacuugugggggcaagggaccagggucacggucucgagcgcgagcacgaaaggg

SEQ ID NO: 57766 - RNA, 378 nt, Artificial Sequence
  derived and/or modified sequence opt11 from anti-HIV_Chain
cgcggccccgucacccucgccgucucccucggcgaacgcgccaccaucaccugcaaauccucccaauccguccucguccacuccaacaacaaaaacuaccucuccugguaccaacaaaaacccggccaaccccccaaacuccucaucuacugggcauccacccgcgaauccggcguccccgaacgcuucucaggcuccggcuccggcaccgacuucacccucuccaucuccucccuccaagccgaagacgucgccgucuacuacugccaccaauacuucuccaccccccgcaccuucggccaaggcaccaaagucgaaaucaaaggcaccgucgccgcccccuccgucuucaucuucccccccuccgacgaacaacuc

SEQ ID NO: 57767 - RNA, 378 nt, Artificial Sequence
  derived and/or modified sequence opt11 from anti-HIV_Chain
uccgaaaucgucaugacccaaucccccgccacccuauccaugucccccggcgaacgcgccacacucuccugccgcgccucccucuccgucaacaccaaccucgccugguaccaacaaaaacccggccaagccccccgccuccucaucuacggcgccuccacccgcgccaccggcauccccgcccgcuucuccggcuccggcuccggcaccgaauucacccucaccaucuccucccuccaauccgaagacuucgcacucuacuacugccaacaauacaaccacuggccccaaaccuucggccaaggcaccaaagucgaaaucaaacgcaccgucgccgcccccuccgucuucaucuucccccccuccgacgaacaaaaa

SEQ ID NO: 57768 - RNA, 378 nt, Artificial Sequence
  derived and/or modified sequence opt11 from anti-HIV_Chain
ucagaaaucguccucacccaaucccccgccacccucucccucucccccggcgaacgcgccacccucuccugccgcgccucccaaucaaucaacaacuaccucgccugguaccaacaaaaacccggccaagccccccgccuccuaaucuacgacgccuccaaccgcgccaccggcauccccgcccgauucuccggcggcggcuccggcaccgacuucacccuuaccaucuccucccucgaacccgaagacuucgccgucuacuacugccaacaacgagccaacuggcgccuccucaccuucggcggcggcaccaaagucgaaaucaaacgcacagucgccgcccccuccgucuucaucuucccccccuccgacgaacaa

SEQ ID NO: 57769 - RNA, 378 nt, Artificial Sequence
  derived and/or modified sequence opt11 from anti-HIV_Chain
caagugcaauugguccagagcgggggcgcggucaagaaaccgggcgcgagcgugaaagugagcugugaaacguacggguacacguucacggaccauuucaugcacugguggaggcaagcgcccgggcaagggcucgaguggaugggcuggaucaaucccuauagcucggccgugagcuauagcccgcgcuaucaagggcgcgugaccaugaccagggacacguucuuggaaacggucuauauggagcucaggggcuugaaauuugacgauaccgcgaucuauuacugugccacgcccaagagcgggcgcgauuacuggagcuuugacuugugggggcaagggaccuuggucacggucucgagcgcgagcacgaaaggg

SEQ ID NO: 57770 - RNA, 378 nt, Artificial Sequence
  derived and/or modified sequence opt11 from anti-HIV_Chain
ucccaaguccaacucgucgaauccggccccggccucgucaaacccuccgaaacccucucccucacaugcuccgucuccaacggcuccaucuccuccggcggcuacuacugguccuggcuccgccaauuccccggcaaaggccucgaauggaucggcuccauccacuacaccggccgcaccauguacaaccccucccucaugggccgccccgcccucuccauggacaccuccaacaaccaauucucccucaaacucuccuccgucaccgccgccgacaccgcccucuacuucugcgcccgcgaccuccaauggauauucgucgucgaccccuggggccaaggcacccucgucaccgucuccuccgccuccaccaaaggc

SEQ ID NO: 57771 - RNA, 378 nt, Artificial Sequence
  derived and/or modified sequence opt11 from anti-HIV_Chain
ucagucgugcaacuggucgagagcgggcccgggcucgugaaaccaagcgagacccugagcuugaccuguagcgugagcaauggcucgaucucgagcgggggcuauuacuggagcuggcucaggcaauuucccgggaaagggcucgaguggauaggcucgauccauuacacgggcaggaccauguacaaucccucgcucaugggcaggcccgcgcucucgauggauaccucgaacaaucaauuuagccugaaauugcgcucggucacggccgcagacacggcccuguacuuuugcgcgcgcgaucuccaguggauauucguggucgaucccuggggccaaggcacgcucgugaccgugagcucggccucgaccaagggc

SEQ ID NO: 57772 - RNA, 378 nt, Artificial Sequence
  derived and/or modified sequence opt11 from anti-HIV_Chain
agcgggggcaggcuagugcaaccgggcgggagcuugcgcuugagcuguagcgcgagcggguucacgcucucgaacucggccaugagcugggucaggcaagcgcccgggaaagggcucgagugggugagcucgaucuugagcucgggcgugggcacguucuaugccgauagcgugaaagggcgcuuuaccgugagcagggacaauagcaggaacacgcucuaucuccagaugaagucguugcgcgcggaagauaccgcgcucuauuacugugccaagguccagauccagcaacugaacuuuggcgugaucacggacgcgggcuuggacgugugggggaaagggaccacgcucauagucagcagcgcgagcacgaaaggg

SEQ ID NO: 57773 - RNA, 378 nt, Artificial Sequence
  derived and/or modified sequence opt11 from anti-HIV_Chain
caagugcaauugguccagagcggggccgcggucaagaaaccgggcgcgagcgugaaagugagcugugaagcguacggguacaaguucacggaccauuucaugcacugguggaggcaagcgcccgggcaagggcucgaguggaugggcuggaucaaucccuauaccucggccgugaacuauagcccgaaauaucaagggcgcgugaccaugaccagggacacguuccuggaaacggucuauauggagcucaggggcuugcgcguggacgauaccgcgaucuauuacugugccacgcccaagagcgggcgcgauuacuggagcuuugacuugugggggcaagggaccuuggucacggucucgagcgcgagcacgaaaggg

SEQ ID NO: 57774 - RNA, 378 nt, Artificial Sequence
  derived and/or modified sequence opt11 from anti-HIV_Chain
caagugcaauugguccagagcggggccgcggucaagaaaccgggcgcgagcgugaaagugagcugugaaacguacggguacaaguucacggaccauuucaugcacugguggaggcaagcgcccgggcaagggcucgaguggaugggcuggaucaaucccuauagcucggccgugagcuauagcccgcgcuaucaagggcgcgugaccaugaccagggacacguucuuggaaacggucuauauggagcucaggggcuugcgcuuugacgauaccgcgaucuauuacugugccacgcccaagagcgggcgcgauuacuggagcuuugacuugugggggcaagggaccuuggucacggucucgagcgcgagcacgaaaggg

SEQ ID NO: 57775 - RNA, 378 nt, Artificial Sequence
  derived and/or modified sequence opt11 from anti-HIV_Chain
caagugcaauugguccagagcggggccgcggucaagaaaccgggcgcgagcgugaaagugagcugugaaacguacggguacacguucacggaccauuucaugcacugguggaggcaagcgcccgggcaagggcucgaguggaugggcuggaucaaucccuauagcucggccgugagcuauagcccgcgcuaucaagggcgcgugaccaugaccagggacacguucuuggaaacggucuauauggagcucaggggcuugaaauuugacgauaccgcgaucuauuacugugccacgcccaagagcgggcgcgauuacuggagcuuugacuugugggggcaagggaccuuggucacggucucgagcgcgagcacgaaaggg

SEQ ID NO: 57776 - RNA, 378 nt, Artificial Sequence
  derived and/or modified sequence opt11 from anti-HIV_Chain
caagugcaauuaguccagagcggggccgagguaaagaaaccgggcagcagcgugaaagugagcugcaaaacaagcgggguaagguucucgagcaacgccauaagcugggucaggcaagcgcccgggcaagggcucgaguggaugggaaggacaacaccaaugcuaggaggagcgaaccaugcaccgagcuucaaagggcgagugaccauaagcgcggacgagagcacgagaacagucuauauggagaugucgagccugcgauacgaagauaccgcgguauacuacugcgccucgggcaggcgcgagggacugaacuuucuccuggacuauuggggacaagggacacuggucacagucagcagcgcaagcacgaaagga

SEQ ID NO: 57777 - RNA, 378 nt, Artificial Sequence
  derived and/or modified sequence opt11 from anti-HIV_Chain
caaguccaacuccaagaaucaggccccggccucgucaaacccuccgaaacccucucccucaccugcaccgucuccggcggauccaucuccaccuacuacugguccuggauccgccaaccccccggcaaaggccucgaauggaucggcuacaucuccuacuccggcuccaccaacuacaaccccucccucaaaucccgcgucaccaucuccgucgacaccuccaaaaaccaauucucacucaaacucuccuccgucaccgccgccgacacagccgucuacuacugcgcccgccacaaauccguccuccucugguuccgcgaacucgacuacuggggccaaggcacccucgucaccgucuccuccgccuccaccaaaggc

SEQ ID NO: 57778 - RNA, 378 nt, Artificial Sequence
  derived and/or modified sequence opt11 from anti-HIV_Chain
caaguccaacucguccaauccggcgccgaagucaaaaaacccggcgccgccgucaaaaucuccugcaaagcaucccgcuucaccuucuccuccuacuacauccacuggguccgccaagcccccggccaaggccucgaauggaugggcaucaucaaccccuccggcggcuccaccuccaacgcccaaaaauuccaagaccgcgucacccucacacgcgacauguccaccggcaccgucuacauggaacucucccgccucaccuccgaagacaccgccgucuacuacugcgccacccccgaacccuccuccaucgucgccccccucuacuacuggggccaaggaacccucgucaccgucuccuccgccuccaccaaaggc

SEQ ID NO: 57779 - RNA, 378 nt, Artificial Sequence
  derived and/or modified sequence opt11 from anti-HIV_Chain
caagugcaauugguccagagcggggccgagaugaagaaaccgggcgcgagcgugaaagugagcuguaaagcgagcgggcacacguucacgaacuauuacaugcacugggucaggcaagcgccagggcaagggcucgaguggaugggcaugaucaaucccacgggcgauagcacgcgcuaugcccagcgcuuucaagggcgcgugaccaugaccagggacacgagcacgcgcacggucuauauggagcucucgagcuugcgcucggacgauaccgcggucuauuacugugccagggcacaucacgauuucuggcgcgcgcccguggacgugugggggaaagggaccacggucacggucucgagcgcgagcacgaaaggg

SEQ ID NO: 57780 - RNA, 378 nt, Artificial Sequence
  derived and/or modified sequence opt11 from anti-HIV_Chain
caagucguccucauccaauccggcgccgaagucaaacgccccggcuccuccgucaaagucuccugcaaagccuccggcggcuccuuccccaucaccuggguccgccaagcccccggccacggccucgaauggaugggcggcaucaacccauucuucggcaccaccaacuacgcccaaaaauuccaaggccgcgucuccaucaccgccgacgaauccaccuccaccaccuaccuccaccucuccgaccuccgcucagaagacaccgccgucuacuucugcgcccgagaaaaccgcgaaaaauggcucguccuccgcuccugguucgcccccuggggccaaggcacccucgucaccgucuccuccgccuccaccaaaggc

SEQ ID NO: 57781 - RNA, 378 nt, Artificial Sequence
  derived and/or modified sequence opt11 from anti-HIV_Chain
agccagcaauugguccagagcggggcccaggucaagaaaccgggcgcgagcgugcgcgugagcugucaagcgagcggguacacguucacgaaccauuucuugcacugguggaggcaagcgcccaggcaagggcucgaguggaugggauggaucaauccagugcacgggggaaggaacuaugccaggcgcuuucaagggcgcauaaacuuuggcagggacguguaccaggaaacggccuauauggagcucucgggcuugagaaaugacgauaccgcgaccuauuucugugccaggggcgggggcgauggcaggaacuggcacuugcacccgugggggcaagggaccuuggucauagucucggccgcgagcacgaaaggg

SEQ ID NO: 57782 - RNA, 378 nt, Artificial Sequence
  derived and/or modified sequence opt11 from anti-HIV_Chain
gaagugcaagugguagagagugggggcgggcucgugcaaccgggcgggagcuugcgcuugaguugugucgcgagcggguucacguucucggaauauuggaugagcuggguaaggcaagcgccagggaaagggcucgaguggguggcaacgaucaagagagauggaucggaagagagcuauguagauagcgugaaagggagauuuaccauaagcagggacaaugccaagaacucgcucuaucuccagaugaauaguuugcgcgcggaagauacagcggucuauuacugugccaggguaagggacccgaacuauaacuugcacuuugacucgugggggcaagggaccuuggucacggucucgagcgcgagcacgaaaggg

SEQ ID NO: 57783 - RNA, 378 nt, Artificial Sequence
  derived and/or modified sequence opt11 from anti-HIV_Chain
uugguccagcucguggaaucgggcgggggcgugguccagcccgggaaaucgcucaggcucucgugcgcgaccucgggcuuuaccuuuagcacguacgggaugcauugggugcgccaggccccgggcaagggcuuggaaugggucgcggucauaugguaugacgggagcuauaaauauuacgcggacucggucaagggcagguucacgaucucgcgcgauaacucgaaaaauaccuuguuccugcaaaugaacucgcucagggccgaggacacggccauguacuauugcgggcgcgagauggcggucgggggcacgaaagcgcucgaucacuggggccagggcacgcucgugaccgugagcucggccucgaccaagggc

SEQ ID NO: 57784 - RNA, 378 nt, Artificial Sequence
  derived and/or modified sequence opt11 from anti-HIV_Chain
gaguuccagcucgugcaaucgggcgggggcuuggucaagcccgggggcucacuaaggcucucgugcacgggcucgaccuuuagcuuuagcucggacgauaugaauugggugcgccaggccccaggcaagggcuuggaaugggucucgagcaugagcgauagcgggagccauaucuauuacgcggacuuugucaagggcagguucacgaucucgcgcgauaacgcgaaaaagagcuuguacuugcaaaugaacucgcucagggccgaggacacggccguguacuauugcgcgcaaucgcgcccgccccagcgcuuguacgggauggaugucuggggccagggcacgaccgugaccgugagcucggccucgaccaagggc

SEQ ID NO: 57785 - RNA, 381 nt, Artificial Sequence
  derived and/or modified sequence opt11 from anti-HIV_Chain
gaagugcaacuggucgagagcgggggcggggucgugcaaccgggcgggagcuugcgauugagcugugccgcgagcggguucauguucaagaacuaugccaugcacugggucaggcaaccgcccgggaaagggcucgaguggguggcagugaucugguacgggggcagggaccagaacuaugccgauagcgugaaagggcgcuuuaccauaagcagagacgauagcgauaacacgcucuaucuacagaugaauagcuugcgcgcgggcgauaccgcggucuauuucugugccaggaacucgcaagugggcaggcucaugcccgcggccggggucuggggccagggcacgcucgugacagugagcucggccucgaccaagggc

SEQ ID NO: 57786 - RNA, 381 nt, Artificial Sequence
  derived and/or modified sequence opt11 from anti-HIV_Chain
caagggcacuugguccagagcgggggcggggucaagaaacugggcacgagcgugaccauaagcugucucgcgagcgaguacacguucaaugaauuugucauacacuggaucaggcaagcgcccgggcaagggcccuuguggcugggccugaucaagcgcucgggcaggcucaugaccucguaccaguuccaggacaggcucucgcucagacgcgaucgcucgaccgggaccguguucauggaauugcgcgggcucagggucgaugacacggccguguacuauugcgcgcgcgauggcuugggcgaggucgcgcccgcguacuuguacgggaucgaugccuggggccagggcacgaccgugaucgugaccucggccucgacc

SEQ ID NO: 57787 - RNA, 381 nt, Artificial Sequence
  derived and/or modified sequence opt11 from anti-HIV_Chain
caaguccaacuccucgaauccggcggcggccucguccaacgcggcggcucccuccgccucuccugcaccgccuccggcuucguauucaacaacuacuggaugaccuggguccgacaagcccccggcaacggccucgaaugggucgccaacaucgaccaagacggcuccgaaaaacacuaccucgacuccgucaaaggccgcuucaccaucucccgcgacaacgccaaaaacucccucuaccuccaaaugaacucccuccgcgccgaagacaccgccaucuacuacugcgcccgcguccgcuucaaagucaccgccuggcaccgauucgacuccuggggccaaggcgaccucgucaccgucuccuccaccucaaccaaaggc

SEQ ID NO: 57788 - RNA, 381 nt, Artificial Sequence
  derived and/or modified sequence opt11 from anti-HIV_Chain
caauccgcccucacccaaccccccuccgccuccggcacccccggccaacgcgucaccaucuccugcuccggcuccuaccacaacaucggcuccaacgccgucaacugguaccaacaacuccccggcaccgcccccaaacuccucaucuacuccaacgaccaacgccccuccggcguccccgaccgcuucuccggcuccaaaucaggcaccuccgccucccucgccaucuccggccuccaaucugaagacgaagccgacuacuacugcgccgccugggacgacucccuccacgucuucggcaccggcaccaaagucaccguccucggccaacccaaagccaaccccaccgucacccucuucccccccucauccgaagaacuc

SEQ ID NO: 57789 - RNA, 381 nt, Artificial Sequence
  derived and/or modified sequence opt11 from anti-HIV_Chain
caauccguccucacccaaguccucuccgucuccggcacccccggccaacgcgucaucaucuccugcuccggcaccuccuccaacgucggcggcaaccucgucuccugguaccaacaccuccccggcgccgccccccgccuccucauccaccgagacgaccaacgacccuccggcguccccgaccgcuucuccggcuccaaauccggcaacuccgccucccucgucaucuccggccuccgcuccgacgacgaagccgacuacuucugcgccgccuacgacuccaccuucucacuccccgucuucggcggcggcacccgccucaccguccucucccaacccaaagccgccccauccgucacccucuucccccccuccuccgaa

SEQ ID NO: 57790 - RNA, 381 nt, Artificial Sequence
  derived and/or modified sequence opt11 from anti-HIV_Chain
caaguccaacuccuccaauccggcgccgccgucaccaaacccggcgccuccguccgcgucuccugcgaagccuccggcuacaacauccgcgacuacuucauccacugguggcgccaagcccccggccaaggccuccaaugggucggcuggaucaaccccaaaaccggccaacccaacaaccccugccaauuccaaggccgcgucucccucacccgccacgccucaugggacuucgacacauucuccuucuacauggaccucaaagcccuccgcucagacgacaccgccgucuacuucugcgcccgccaacgcuccgacuacugggacuucgacgucuggggcuccggcacccaaguaaccgucuccuccgccuccaccaaa

SEQ ID NO: 57791 - RNA, 381 nt, Artificial Sequence
  derived and/or modified sequence opt11 from anti-HIV_Chain
caaguccaacucguccaaagcggcggcgaaguccgcaaacccggcuccucagucaaaguccccugcaaaaucuccggcaacgccuucuccaacuacggagucaacugggucagacaagcccccggccaaggccuagaaugggucggccgcaucauccccgucaucggcgucgcccaacacgcccccaaauuccaaggccgcgucaccaucaccgccgacaaauccaccaccaccgccuaccucgaacucuccucccuacgcucagacgacaccgcagucuacuucugcgccaaagaccacggcgacccccgcaccggcuacuacuucgacuacuggggccaaggcgcccucgucaccgucuccucagccucaaccaaaggc

SEQ ID NO: 57792 - RNA, 381 nt, Artificial Sequence
  derived and/or modified sequence opt11 from anti-HIV_Chain
caaguccaacucggccaauccggcaccgaagucaaaaaacccggcuucucagucaaagucuccugcaaagccuccggcggcuccuccaccgccuacggcuacuccuggguccgccaagcccccggccaaggcuucgaauggaugggccgcaucauccccuucuacggcaucaucaccuacgcacccaaauuccaaggccgcgucaccaucaccgccgaccgcucaaccuccaccgucuacauggaacucaccucccucaccuucgccgacaccgcccucuucuucugcgcccgcgacuucggcgacccccgcaacggcuacuacuucgacuccugggaccaaggccucuggcucaccgucuccuccgccucaaccaaaggc

SEQ ID NO: 57793 - RNA, 381 nt, Artificial Sequence
  derived and/or modified sequence opt11 from anti-HIV_Chain
caaguccaacucguccaauccggcgccgaagucaaaaaacccggcuccagcgucaaagucuccugcaaagccuccggcggcaccuucuccaacuacgccaucuccuggguccgccaagcccccggccaaggccucgaauggaugggcggcaucauccccaucuucgaagccgccuccuacgcccaaaaauuccaagaccgccucaccaucaccaccgacgaaucaaccaccaccgccuacauggaccucuccucccuccgcuccgaagacaccgccaucuacuacugcgcccgcgcccaaggcgacauacucaccgaaggcuacuucgacuacuggggccaaggcacccucgucaccgucuccuccgccuccaccaaaggc

SEQ ID NO: 57794 - RNA, 381 nt, Artificial Sequence
  derived and/or modified sequence opt11 from anti-HIV_Chain
caaguccaacuccaagaauccggccccggacucgucaaacccuccgaaacccuuucccucaccugcaccgucuccggcggcuccaucucauccgccggcuacuacugguccuggauccgccaacaccccgaaaaaggccucgaauucaucggcuacaucuacuaccucggcaccaccuacuacaaccccucccucaaaucccgcgucuccaucuccaucgacaccuccaacaaccaauucucccucgaacucuccucagucuccgccgccgacaccgcaaucuacuacugcgcccgcgacuacaccgccuccggccgccacuucuucgacuacuggggccaaggcacccucgucaccgucuccucagccuccaccaaaggc

SEQ ID NO: 57795 - RNA, 381 nt, Artificial Sequence
  derived and/or modified sequence opt11 from anti-HIV_Chain
caagugcaacugguacagagcggagccgaagucaaaaaaccgggagcaagcguaaaaguaagcugcaaagcaccaggauacacauucauaggacacuacaugcacuggauaagacaagcacccggacaaggacuggaauggaugggauggauaaacccaaacagcggagacacaaacuacgcccagacauuccaaggaagagugacaaugacgagagacacaagcauaagcacagcauacauggaacuaacaagacuaagaagcgacgacacagcagucuacuacugcgcaagagaccuaagaccaaugagaggcaacugggcaaugcacguauggggagaaggcacgacagugacaguaagcagcgccagcacaaaagga

SEQ ID NO: 57796 - RNA, 381 nt, Artificial Sequence
  derived and/or modified sequence opt11 from anti-HIV_Chain
caaguccaacuccaagaauccggccccggccucguaaaacccuccgaaacccucucacuaaccugcaccgucuucggcgccuccauccgcuccuucuacuggcacuggauccgccaaucccccggcaaaggccucgaauggcucggcuccgucuucgacaacggccucaccaccuacaaccccucccucaaaaaccgccucucaaucucagaagaccccucccgcaaccaaaucucccucaaccuccgcucaaugaccgccgccgacaccgccgucuacuacugcgcccgcgccgacuacgaccuccucaccuccuccuaccacuucgacuccuggggccaaggcacccucgucaccgucuccuccgccuccaccaaaggc

SEQ ID NO: 57797 - RNA, 381 nt, Artificial Sequence
  derived and/or modified sequence opt11 from anti-HIV_Chain
ucgcaacagcucgugcaaucgggcacgcaagugaaaaagcccggggccucggucagggucucgugccaggccucgggcuauaccuuuaccgauuacgugcuccauugguggcgccaggccccgggccagggcuuggaauggaugggguggauaaaaccggucuauggcgcgcgcaauuacgcgcacagguuccagggcaggaucaauuucgaucgcgaugucuaucgcgagaucgcguacauggacuugagcgggcucaggagcgaugacacggccguguacuuuugcgcgcgcgauggcucgggcgaugccacgagcuggcacuugcacccgugggggcaagggacccuggucauagucucgagcgcgagcacgaaaggg

SEQ ID NO: 57798 - RNA, 381 nt, Artificial Sequence
  derived and/or modified sequence opt11 from anti-HIV_Chain
ucccaacaacucguccaauccggcacccaagucaaaaaacccggcgccuccguccgcgucuccugccaagccuccggcuacaccuucaccaacuacauccuccacugguggcgccaagcacccggccgcggccucgaauggaugggccucaucaaacccgucuacggcgccgucaacuacgcccgccaauuccaaggccgaauccaacucacccgcgacaucuaccgcgaaaucgccuuccucgaccucuccggccuccgccccgacgacaccgccgucuacuacugcgcccgcgacgaauccggcuacgaccucaacuggcaccucgacuccuggggccaaggcacccaagucaucgucucccccgccuccaccaaaggc

SEQ ID NO: 57799 - RNA, 381 nt, Artificial Sequence
  derived and/or modified sequence opt11 from anti-HIV_Chain
agccaacaacuaguccaaagcggagcccaagucaaaaaaccaggcgccagccuacgcguaagcugccaagccagcggauacacauucaugaacuaccuccuacacugguggagacaagcccccggacaaggacuagaauggaugggcuggaucaaccccgucuacggagccguaaacuacgcccaccgcuuccaaggccgccuaaccuucagcagagacguauacagagaaauagccuacauggaccucaacggccuacgcucagacgacaccgcagucuacuucugcgccagagacggcagcggagacgaccgcaacuggcaccuagaccccuggggccaaggcacacucguaauaguaagcucagccucaaccaaaggc

SEQ ID NO: 57800 - RNA, 381 nt, Artificial Sequence
  derived and/or modified sequence opt11 from anti-HIV_Chain
ucccaacaacucguccaauccggcacccaagucaaaaaacccggcgccucaguccgcaucuccugccaagccucaggcuacaccuucaccgacuacguccuccacugguggcgccaagcccccggccaaggccucgaauggaugggcuggaucaaacccgucuacggcgcacgcaacuacgcccgccgcuuccaaggccgcaucaacuucgaccgcgacaucuaccgcgaaaucgccuuccucgaccucuccggccuccgcuccgacgacacagcccgcuacuucugcgcccgcgacggcuccggcgacgacaccuccuggcaccuccaccccuggggccaaggcacccucgucaucgucuccgccgccuccaccaaaggc

SEQ ID NO: 57801 - RNA, 381 nt, Artificial Sequence
  derived and/or modified sequence opt11 from anti-HIV_Chain
ucgcaacagcuagugcaaucgggcacgcaagugaaaaagaccggggccucggucagggucucgugccaggccucgggcuaugacuuuaccaaguacuugauccauugguggcgccaggccccgggacagggcuuggaauggaugggguggaugaaaccggucuauggcgcgaccaauuacgcgcacagguuccagggcaggaucucguucacgcgcgauaucuaucgcgagaucgcguucauggacuugaacgggcucaggagcgaugacacggccguguacuuuugcgcgcgcgacggcgggggcgaugacaggaccuggcuccuggacgcgugggggcaagggaccuuggucauagucucgagcgcgagcacgaaaggg

SEQ ID NO: 57802 - RNA, 381 nt, Artificial Sequence
  derived and/or modified sequence opt11 from anti-HIV_Chain
agccagcaauugguccagagcgggacccaggucaagaaaccgggcgcaagcgugcgcgugagcugucaagcgagcggauacacguucaugaacuacaucauacacugguggaggcaagcgcccgggcaaaggcucgaguggaugggcuggaucaaucccguguucggggccaggaacuacgcccaccgcuuucaagggcgcauaaacuuugacagggacauaaacagggaaacguuccagauggaccucacaggccuacgcucggacgauaccgcagucuacuacugugccagggacgggagcggggacgcgcgcgacuggcaucuccaccccuggggccagggcacgcucguaaucgugagcucggccucgacaaagggc

SEQ ID NO: 57803 - RNA, 381 nt, Artificial Sequence
  derived and/or modified sequence opt11 from anti-HIV_Chain
ucccaacaccucguccaauccggcacccaagucaaaaaacccggcgccucaguccgcgucuccugccaagccuccggcuacaccuucaccaacuacauccuccacugguggcgccaagcccccggccaaggccucgaauggaugggccucaucaaacccgucuucggcgccgucaacuacgcccgccaauuccaaggccgcauccaacucacccgcgacaucaaccgcgaaaucgccuuccuagaccucuccggccuccgcuccgacgacaccgccgucuacuacugcgcccgcgacgaauccggcgacgaccucaaauggcaccuccaccccuggggccaaggaacccaagucaucgucucccccgccuccaccaaaggc

SEQ ID NO: 57804 - RNA, 381 nt, Artificial Sequence
  derived and/or modified sequence opt11 from anti-HIV_Chain
agccagcaacugguccagagcgggacccaggucaagaaaccgggcgcgagcgugcgcgugagcugccaagcgagcggguacacguucaugaacuauaucauacacugguggaggcaagcgcccgggcaaaggcuagaguggaugggcuggaucaaucccguguucggggccaggaacuaugcccaucgcuuccaagggcgcauaaacuucgacagggacauaaacagggaaacauuccagauggagcucacgggccugcgaucggacgauaccgcagucuauuacugcgccagggacgggagcggagacgcgcgcgacuggcaucucgaccccuggggccagggcacgcucguaaucgugagcucagccucgaccaagggc

SEQ ID NO: 57805 - RNA, 381 nt, Artificial Sequence
  derived and/or modified sequence opt11 from anti-HIV_Chain
ucgcaacagcuagugcaaucgggcacgcaagugaaaaagccaggggccucggucaggaucucgugccaggccucgggauauaccuuuaccgauuacgugcuccauugguggcgacaggccccgggccagggcuuggaauggaugggguggauaaaaccggucuauggcgcgcgcaauuacgcgcgcagguuccagggcaggaucaauuucgaucgcgauaucuaucgcgagaucgcguacauggacuugagcgggcucaggagcgaugacacggccagguacuuuugcgcgcgcgauggcucgggcgaugacacgagcuggcacuugcacccgugggggcaagggaccuuggucauagucucggccgcgagcacgaaaggg

SEQ ID NO: 57806 - RNA, 381 nt, Artificial Sequence
  derived and/or modified sequence opt11 from anti-HIV_Chain
ucccaacaacucguccaauccggcacccaagucaaaaaacccggcgccuccguccgcaucuccugccaagccuccggcuacuccuucaccgacuacguccuccacugguaccgccaagcccccggccaaggccuagaauggaugggcuggaucaaacccgucuacggcgcccgcaacuacgcacgccgcuuccaaggccgcaucaacuucgaccgcgacaucuaccgagaaaucgccuucauggaccucucaggccuccgcuccgacgacaccgcccucuacuucugcgcccgcgacggauccggcgacgacaccuccugguaccucgaccccuggggccaaggcacccucgucaucgucuccgcagccuccaccaaaggc

SEQ ID NO: 57807 - RNA, 381 nt, Artificial Sequence
  derived and/or modified sequence opt11 from anti-HIV_Chain
ucgcaacagcucgugcaaucgggcacgcaagugaaaaagcccggggcaucggucaggaucucgugccaggccucgggcuauagcuuuaccgauuacgugcuccauugguggcgccaggccccgggccagggccuggaauggaugggguggauaaaaccggucuauggcgcgcgcaauuacgcgcgcagguuccagggcaggaucaauuucgaucgcgauaucuaucgcgagaucgcguucauggacuugagcgggcucaggagcgaugacacggccuuguacuuuugcgcgcgcgauggcucgggcgaugacacgagcuggcacuuggacccgugggggcaagggacccuggucauagucucggcagcgagcacgaaaggg

SEQ ID NO: 57808 - RNA, 381 nt, Artificial Sequence
  derived and/or modified sequence opt11 from anti-HIV_Chain
ucccaacaccucguccaauccggcacccaagucaaaaaacccggcgccuccguccgcgucuccugccaagccuccggcuacaccuucacaaacuacauccuccacugguggcgacaagcccccggccaaggccucgaauggaugggccucaucaaacccgucuucggcgccgucaacuacgcccgacaauuccaaggccgcauccaacucacacgcgacaucuaccgcgaaaucgccuuccucgaccucuccggccuccgcuccgacgacaccgccgucuacuacugcgcccgcgacgaauccggcgacgaccucaaauggcaccuccaccccuggggccaaggcacccaagucaucgucucacccgccuccaccaaaggc

SEQ ID NO: 57809 - RNA, 381 nt, Artificial Sequence
  derived and/or modified sequence opt11 from anti-HIV_Chain
caaguccaacucgucgaauccggcggcggcgucguccaacccggcaaaucccuccgccucucaugcgccaucuccggcuuccucuucaacaacuacggcggccaauggguccgccaagcccccggcaaaggccucgaaugggucgcagccaucuccuacgacggaaacaaccgcuacuacgccgacuccgccaaaggccgcuuccucaucucccgcgacacccccaaaaacauccucuaccuccaaaucuacucccuccgccucgacgacacagccgucuacuacugcgcccgcgacuccgucuccaaauccuacuccgccccccccgaauucuggggccaaggcaccgucgucaccgucuccuccgccuccaccaaaggc

SEQ ID NO: 57810 - RNA, 381 nt, Artificial Sequence
  derived and/or modified sequence opt11 from anti-HIV_Chain
caaguccaccucgaagaauccggccccggccucguaaaaaccucccaaacccucucccuaaccugcuccgucuccuccuacuccaucucccgcuccggauacuucuggaccuggauccgacaacgccccggcaaaggccucgaauggaucggcuacaucuacuucaacggccgcaccaccuacaaccccucccucaaaucccgcaucaccaucucccgcgacaccucccacucccaauucucccucacccucaacucccucuccgccgccgacaccgccgucuacuacugcggccgcugccaagacggccucgccucccgccccaucgacuucuggggccaaggcacccucgucaccgucuccuccgccuccaccaaaggc

SEQ ID NO: 57811 - RNA, 381 nt, Artificial Sequence
  derived and/or modified sequence opt11 from anti-HIV_Chain
caagugcaauugguagagagcgggggcggggucgugcaaccgggcaggagcuugcgcuugagcugugccacgagcggguucacgagcaagaacuauggcgugcacugggucaggcaagcgcccgggaaagggcucgaguggguggccgugaucugguacgauggcucgaacaaguucuaugccgauagcgugaaagggcgcuuuaccauaagcagagacaggagcaagaacauggucuaucuccagaugaauagccugcgaguggaagauaccgcgaucuauuacugugccagggacucggucgcguucgugcucgagggcccgaucgauuacuggggccagggaacgcucgugaccgugagcucagccucgaccaagggc

SEQ ID NO: 57812 - RNA, 384 nt, Artificial Sequence
  derived and/or modified sequence opt11 from anti-HIV_Chain
caagugcaauugguccagagcgggggcgggguaaagaaaccgggcacgagcgcgagcuuuagcugucgcacgagcgaugacauauacgauaacgaguucuuugacucggcauuuaugcauugggugcgcuugaucccgggccagcgcccggaauggaugggguggaugaacccgcgcucgggcgcggucaauuacgcgcgccagcuccagcccagggucucgauguaucgcgaucgcgaucucucgaccgcguacauggaauuuaaaucgcucacgagcgcagacacgggcacguacuuuugcgcgcgcaagaaaaggggcgauggcuuuaacuuguacuuugacuugugggggcgcgggagccaggucauagucucgagcgcg

SEQ ID NO: 57813 - RNA, 384 nt, Artificial Sequence
  derived and/or modified sequence opt11 from anti-HIV_Chain
caaggccaccucguccaauccggcggcggcgucaaaaaacucggcaccuccgucaccaucuccugccucgccuccgaagacacauucaacgaauucgucauccacuggauccgccaagcccccggccaaggcccccuauggcucggccucaucaaacgcuccggccgccucaugaccucauaccaauuccaagaccgacucucccuccgccgcgaccgcuccaccggcaccgucuucauggaacuccgcggccuccgcgucgacgacaccgccgucuacuacugcgcccgcgacggccucggcgaaguagcccccgccuaccucuacggcaucgacgccuggggccaaggcaccaccgucaucgucaccuccgccuccaccucc

SEQ ID NO: 57814 - RNA, 384 nt, Artificial Sequence
  derived and/or modified sequence opt11 from anti-HIV_Chain
caauccgcccucacccaaccccccuccgucuccggcgcccccggccaacgcgucaccaucuccugcuccggcggccccuccaacgucggcggcaacuacgucuacugguaccgccaauuccccggcaccgcccccaaacuccucauacuccgcgacgaccaacgacccuccggcguccccgaccgcuucuccgccuccaaaucaggcaacucagccucccucgccaucucaggccuacgacccgacgacgaagccuucuacuucugcgccaccuacgacucccaaggcuccuuccgcgucuucggcggcggcaccgcccucaccguccucucccaacccaaagccgcccccuccgucacccucuaccccccauccuccgaagaa

SEQ ID NO: 57815 - RNA, 384 nt, Artificial Sequence
  derived and/or modified sequence opt11 from anti-HIV_Chain
aacuucaugcucacccaaccccccuccgccuccggcacccccggccaacgcgucaccaucuccugcuccggcggcggcuccaacaucggcggcaaccucgucuccugguaccaacacuuccccggcgccgcccccaaacuccucaucuaccgcaacgaccaacgccccuccggcguccccgaccgcuucuccggcuccaaauccggcaccuccgccucccucgccaucuccggacuccgcuccgacgacaaagccaccuacuucugcgccgccuacgacuccacccucucccuccgccuauucggcggcggcaccacccucaccguccucucccaacccaaagccgcccccuccgucacccucuucccccccuccuccgaagaa

SEQ ID NO: 57816 - RNA, 384 nt, Artificial Sequence
  derived and/or modified sequence opt11 from anti-HIV_Chain
aacuucaugcucacccaaccccccuccgucuccgccacccccggccaaaccgucaccaucuccugcuccggcuccggcuccaacgucggcggcaaccacgucuacugguaccgccaacuccccggcgccgcccccacccucgucaucuccaaaaccgaccaccgccccucccgcguccccgaccgcuucuccggcuccaaauccggcaacuccgccucccuagccaucuccggccuccgccccgacgacgaagccgucuacuucugcgccaccuacgacaccggccucucccuccgccucuucggcggcggcacccgccucaccguccucucccaacccaaagccgcccccuccgucacccaauucccccccuccuccgaagaa

SEQ ID NO: 57817 - RNA, 384 nt, Artificial Sequence
  derived and/or modified sequence opt11 from anti-HIV_Chain
caauccgcccucacccaaccacccuccgccuccggcgcccccggccaacgcgucaccaucuccugcuccggcggccccuccaacgucggcggcaacuacgucuacugguaccgccaauuccccggcaccgcccccaaacuccucauccuccgcgacgaccaacgccccuccggcguccccgaccgcuucuccgccuccaaauccggcaacuccgccucccucgccaucuccggccuccgacccgacgacgaagcccucuacuucugcgccaccuacgacuccgacggcuccauccgccucuucggcggcggcaccgcccucaccguccucucccaaccaaaagccgcccccuccgucacccuauucccacccggcugggaagaa

SEQ ID NO: 57818 - RNA, 384 nt, Artificial Sequence
  derived and/or modified sequence opt11 from anti-HIV_Chain
caaguccaacuccuccaauccggcgccgccgucaccaaacccggcgccuccguccgcgucuccugcgaagccucaggcuacaacauccgcgacuacuucauccacugguggcgccaagcccccggccaaggccuacaaugggucggcuggaucaacccaaaaaccggccaacccaacaacccccgccucuuccaaggccgcgucucccucacccgccacgccuccugggacuucgacaccuucuccuucuacauggaccucaaagccguccgcuccgacgacacagccgucuacuucugcgcccgccaacgcuccgacuacugggacuucgacgucuggggcuccggcacccaagucaccgucuccucagccuccaccaaaggc

SEQ ID NO: 57819 - RNA, 384 nt, Artificial Sequence
  derived and/or modified sequence opt11 from anti-HIV_Chain
caaguccaacuccuccaaucaggcgccgucgucaccaaacccggcgccuccguccgcgucuccugcgaagccuccggcuacaaaauccgcgacuacuucauccacugguggcgccaagcccccggccaaggccuccaaugggucggcuggaucaacccccaaaccggccaacccaacaucccccgccccuuccaaggccgcgucacccucacccgccacgccuccugggacuucgacaccuucuccuucuacauggaccucaaagcccuccgcuccgacgacaccgccaucuacuucugcgcccgccgccgcuccgacuacugcgacuucgacgucuggggcuccggcacccacgucaccgucuccuccgccuccaccaaaggc

SEQ ID NO: 57820 - RNA, 384 nt, Artificial Sequence
  derived and/or modified sequence opt11 from anti-HIV_Chain
caagugcaauugcuccagagcggggccgcagucacgaaaccgggcgcgagcgugcgcgugagcugugaagcgagcggguacaauaucagggacuacuucauacacugguggaggcaagcgcccgggcaagggcuccagugggugggauggaucaaucccaagaccgggcaaccgaacaaucccaggcaauuucaagggcgcgugagcuugaccaggcaagcgagcugggacuuugacacgaucucguucuauauggaucucaaggccuugcgcuuggacgauaccgcggucuauuucugugccagacaaaggagcgauuacugggacuuugacgugugggggagcgggacccaggucacggucucgagcgcgagcacgaaaggg

SEQ ID NO: 57821 - RNA, 384 nt, Artificial Sequence
  derived and/or modified sequence opt11 from anti-HIV_Chain
caaguccaacuccuccaauccggcgccgccgucaccaaacccggcgccuccguccgcgucuccugcgaagccucaggcuacaacauccgcgacuacuucauccacugguggcgccaagcccccggccaaggccuccaaugggucggcuggaucaaccccaaaaccggccaacccaacaacccacgccaauuccaaggccgcgucucccucacccgccacgccuccugggacuucgacaccuucucauucuacauggaccucaaagcccuccgcuccgacgacaccgccgucuacuucugcgcccgccaacgcuccgacuacugggacuucgacgucuggggcuccggcacacaagucaccgucuacuccgccuccaccaaaggc

SEQ ID NO: 57822 - RNA, 384 nt, Artificial Sequence
  derived and/or modified sequence opt11 from anti-HIV_Chain
caagugcaauugcucccguucgggggcgcggucacgaaaccgggcgcgagcgugcgcgugagcugugaagcgagcggguacaauaucagggacuauuucauacacugguggaggcaagcgcccgggcaagggcuacagugggugggcuggaucaaucccaagaccgggcaaccgaacaauccaugucaauuucaagggcgcgugagcuugaccaggcccgcgagcugggacuuugacacgaucucguucuauauggaucucaaggccuugcgcuuggacgauaccgcggucuauuucugugccaggcaaaggagcgauuacugggacuuugacgugugggggagcgggacacaggucacggucucgagcgcgagcacgaaaggg

SEQ ID NO: 57823 - RNA, 384 nt, Artificial Sequence
  derived and/or modified sequence opt11 from anti-HIV_Chain
caaguccaccuaucccaauccggcgccgccgucaccaaacccggcgccuccguccgcgucuccugcgaagccuccggcuacaaaaucuccgaccacuucauccacugguggcgccaagcccccggccaaggccuccaaugggucggcuggaucaaccccaaaaccggccaacccaacaacccccgccaauuccaaggccgcgucucccucacccgccaagccuccugggacuucgacaccuacucauucuacauggaccucaaagcccuccgcuccgacgacaccgccaucuacuucugcgcccgccaacgcuccgacuucugggacuucgacgucuggggcuccggcacacaagucaccgucuccucagccuccaccaaaggc

SEQ ID NO: 57824 - RNA, 384 nt, Artificial Sequence
  derived and/or modified sequence opt11 from anti-HIV_Chain
caaguccaccucucccaauccggcgccgccgucaccaaacccggcgccucaguccgcgucuccugcgaagccuccggcuacaaaaucuccgaccacuucauccacugguggcgccaagcccccggccaaggccuccaaugggucggcuggaucaaccccaaaaccggccaaccaaacaacccccgccaauuccaaggccgcgucucccucacccgccaagccuccugggacuucgacaccuacuccuucuacauggaccucaaagccguccgcuccgacgacaccgccaucuacuucugcgcccgacaacgcuccgacuucugggacuucgacgucuggggcuccggcacccaagucaccguauccuccgccuccaccaaaggc

SEQ ID NO: 57825 - RNA, 384 nt, Artificial Sequence
  derived and/or modified sequence opt11 from anti-HIV_Chain
caaguccaacuccuccaauccggcgccgccgucaccaaacccggcgccuccguccgcgucuccugcgaagccuccggcuacaaaaucuccgaccacuucauccacugguggcgccaagcccccggccaaggccuccaaugggucggcuggaucaaccccaaaaccggccaacccaacaacccccgccaauuccaaggccgcaucucccucacccgccaagcauccugggauuucgacaccuucuccuucuacauggaccucaaagcccuccgcuccgacgacaccgccgucuacuucugcgcccgccaacgcuccgacuacugggacuucgacgucuggggcuccggcacccaagucaccgucuccuccgccuccaccaaagga

SEQ ID NO: 57826 - RNA, 384 nt, Artificial Sequence
  derived and/or modified sequence opt11 from anti-HIV_Chain
caaguccaacuccuccaauccggcgccgccgucaccaaacccggcgccuccguccgcgucuccugcgaagccuccggcuacaacauccgcgacuacuucauccacugguggcgccaagcccccggccaaggccuccaaugggucggcuggaucaaccccaaaaccggccaacccaacaacccccgccaauuccaaggccgcgucucccucacccgccacgccuccugggacuucgacaccuucuccuucuacauggaccucaaaggccuccgcuccgacgacaccgccaucuacuucugcgcccgccaacgcuccgacuacugggacuucgacgucuggggcuccggcacccaagucaccgucuccuccgccuccaccaaaggc

SEQ ID NO: 57827 - RNA, 384 nt, Artificial Sequence
  derived and/or modified sequence opt11 from anti-HIV_Chain
caaguccaacuccuccaauccggcgccgccgucaccaaacccggcgccuccguccgcgucuccugcgaagccuccggauacaacauccgcgacuacuucauccacugguggcgccaagcccccggccaaggccuccaaugggucggcuggaucaaccccaaaaccggccaacccaacaacccccgccaauuccaaggccgagucucccucacccgccacgccuccugggacuucgacaccuucuccuucuacauggaccucaaagcccuccgcuccgacgacaccgccgucuacuucugcgcccgccaacgcuccgacuacugggacuucgacgucuggggcuccggcacccaagucaccgucuccucagccuccaccaaaggc

SEQ ID NO: 57828 - RNA, 384 nt, Artificial Sequence
  derived and/or modified sequence opt11 from anti-HIV_Chain
cacguccaacuccuccaauccggcgccgccgucacaaaacccggcgccuccguccgcgucuccugcgaagccuccggcuacaacauccgcgacuacuucauccacugguggcgccaagcccccggccaaggccuccaaugggucggcuggaucaaccccaaaaccggccaacccaacaacccccgccaauuccaaggccgagucucccucacccgccaagccuccugggacuucgacaccuucuccuucuacauggaccucaaagcccuccgccucgacgacaccgccaucuacuucugcgcccgccaaagauccgacuacugggacuucgacgucuggggcuccggcacccaagucaccgucuccuccgccuccaccaaaggc

SEQ ID NO: 57829 - RNA, 384 nt, Artificial Sequence
  derived and/or modified sequence opt11 from anti-HIV_Chain
caaguccaccucucccacuccggcgccgccgucaccaaacccggcgccuccguccgcguauccugcgaagccuccggcuacaaaaucuccgaccacuucauccacugguggcgccaagcccccggccaaggccuccaaugggucggcuggaucaacccaaaaaccggccaacccaacaacccccgccaauuccaaggccgcaucucccucacccgccaagccuccugggacuucgacaccuucuccuucuacauggaccucaaagcccuccgcuccgacgacaccgccgucuacuucugcgcccgccaacgcuccgacuacugggacuucgacgucuggggcuccggcacccaagucaccgucuccucagccuccaccaaaggc

SEQ ID NO: 57830 - RNA, 384 nt, Artificial Sequence
  derived and/or modified sequence opt11 from anti-HIV_Chain
caaguccaccucucccaauccggcgccgucguaaccaaacccggcgccuccguccgcgucuccugcgaagccuccggauacaaaaucuccgaccacuucauccacugguggcgccaagcccccggccaaggccuccaaugggucggcuggaucaaccccaaaaccggccaacccaacaacccccgccaauuccaaggccgcaucucccucacccgccaagccuccugggacuucgacaccuucuccuucuacauggaccucaaagcccuccgauccgacgacaccgccgucuacuucugcgcccgccaacgcuccgacuacugggacuucgacgucuggggcucaggcacccaagucaccgucuccuccgccuccaccaaaggc

SEQ ID NO: 57831 - RNA, 384 nt, Artificial Sequence
  derived and/or modified sequence opt11 from anti-HIV_Chain
caaguccaccucucacaauccggcgccgucgucaccaaacccggcgccuccguccgcgucuccugcgaagccuccggcuacaaaaucuccgaccacuucauccacugguggcgccaagccccaggccaaggccuccaaugggucggcuggaucaaccccaaaaccggccaacccaacaacccccgccaauuccaaggccgcaucucccuaacccgccaagccuccugggacaucgacacauucuccuucuacauggaccucaaagcacuccgcuccgacgacaccgccgucuacuucugcgcccgccaccgcuccgacuacugggacuucgacgucuggggcuccggcacccaagucaccgucuccuccgccuccaccaaaggc

SEQ ID NO: 57832 - RNA, 384 nt, Artificial Sequence
  derived and/or modified sequence opt11 from anti-HIV_Chain
caaguccaccucucccaauccggcgccgucgucaccaaacccggcgccucaguccgcgucuccugcgaagccuccggcuacaaaaucuccgaccacuucauccacugguggcgccaagcccccggccaaggccuccaaugggucggcuggaucaaccccaaaaccggccaacccaacaucccccgccaauuccaaggccgcaucucccucacacgccaagccuccggcgacuucgacaccuucucauucuacauggaccucaaagcccuccgcuccgacgacaccgccgucuacuucugcgcccgccaacgcuccgacuacugggacuucggcgucuggggcuccggcacccaagucaccguauccuccgccuccaccaaaggc

SEQ ID NO: 57833 - RNA, 384 nt, Artificial Sequence
  derived and/or modified sequence opt11 from anti-HIV_Chain
caagugcacuugagccagagcggggccguggucacgaaaccgggcgcaagugugcgcgugagcugugaagcgagcggguacaagauaucgggccauuucauacacugguggaggcaagcgcccgggcaagggcuccagugggugggcuggaucaaucccaagacagggcaaccgaacaaucccaggcaauuucaagggcgcaucagcuugaccaggcaagcgagcugggacuuugacacguucucguucuauauggaucucaaggccuugcgcucggacgauaccgcggucuauuucugugccaggcacaggagcgauuacugggacuuugacgugugggggagcgggacccaggucacggucucgagcgcgagcacgaaaggg

SEQ ID NO: 57834 - RNA, 384 nt, Artificial Sequence
  derived and/or modified sequence opt11 from anti-HIV_Chain
caaguccaccuaucccaauccggcgcagccgucaccaaacccggcgccucaguccgcgucuccugcgaagccuccggcuacaaaaucucagaccacuucauccacugguggcgccaagccccaggccaaggccuccaaugggucggcuggaucaaccccaaaacaggccaacccaacaacccccgccaauuccaaggccgcaucucccucacacgccaagccuccugggacuucgacaccuucuccuucuacauggaccucaaagcccuccgcuccgacgacaccgccgucuacuucugcgcccgccaccgcuccgacuacugggacuucgacgucuggggcuccggcacccaagucaccgucuccuccgccuccaccaaaggc

SEQ ID NO: 57835 - RNA, 384 nt, Artificial Sequence
  derived and/or modified sequence opt11 from anti-HIV_Chain
caaguccaccucucacaauccggcgccgccgucaccaaacccggcgccucaguccgcgucuccugcgaagccuccggcuacaaaaucuccgaccacuucauccacugguggcgccaagcccccggccaaggccuccaaugggucggcuggaucaaccccaaaaccggccaacccaacaaccccagacaauuccaaggccgcgucucccucacccgacaagccuccugggacuucgacaccuacuccuucuacaugggccucaaagccguccgcuccgacgacacagccaucuacuucugcgcccgccaacgcuccgacuucugggacuucgacgucuggggcuccggcacccaagucaccgucuccuccgccuccaccaaaggc

SEQ ID NO: 57836 - RNA, 384 nt, Artificial Sequence
  derived and/or modified sequence opt11 from anti-HIV_Chain
caaguccaccucucccaauccggcgccgucguaaccaaacccggcgccuccguccgcgucuccugcgaagccuccggcuacaaaaucuccgaccacuucauccacugguggcgccaagcccccggccaaggccuccaaugggucggcuggaucaaccccaaaaccggccaacccaacaacccccgccaauuccaaggccgcaucucccucacccgccaagccuccugggacuucgacaccuucuccuucuacauggaccuaaaagcccuccgcuccgacgacaccgccgucuacuucugcgcccgccaccgcuccgacuacugggacuucgacguauggggcucaggcacccaaguaaccgucuccuccgccucaaccaaaggc

SEQ ID NO: 57837 - RNA, 384 nt, Artificial Sequence
  derived and/or modified sequence opt11 from anti-HIV_Chain
caagugcacuugagccagagcggggccguggucacgaaaccgggcgcgagcgugcgagugagcugugaagcgagcggguacaagauaucggaccauuucauacacugguggaggcaagcgcccgggcaagggcuccaguggguaggcuggaucaaucccaagaccgggcaaccgaacaaucccaggcaauuucaagggcgcaucagcuugaccaggcaagcgagcugggacuuugacacguucucguucuauauggaucucgaggccuugcgcucggacgauaccgcggucuauuucugugccaggcaaaggagcgauuacugggacuuugacgugugggggagcgggacccaggucacggucucgagcgcgagcacgaaaggg

SEQ ID NO: 57838 - RNA, 384 nt, Artificial Sequence
  derived and/or modified sequence opt11 from anti-HIV_Chain
caaguccaccucucccaauccggcgccgccgucaccaaacccggagccuccguacgcgucuccugcgaagcauccggcuacaaaauccgcgacuacuccauccacugguggcgccaagcccccggccaaggccuccaaugggucggcuggauaaacccccaaaccggccaacccaacaucccccgccccuuccaaggccgcaucucccucacccgccaagccuccugggacuucgacaccuucuccuucuacauggaccucgaagcccuccgcuccgacgacaccgcagucuacuucugcgcccgccaacgcucagacuacugggacuucgacgucuggggcuccggcacccaagucaccgucuccuccgccuccaccaaaggc

SEQ ID NO: 57839 - RNA, 384 nt, Artificial Sequence
  derived and/or modified sequence opt11 from anti-HIV_Chain
caaguccaccucucccaaucaggcgccgccgucaccaaacccggcgcauccguccgcgucuccugcgaagccuccggcuacaaaaucuccgaccacuucauccacugguggcgccaagcccccggccaaggccuccaaugggucggcuggaucaaccccaaaaccggccaacccaacaacccccgccaauuccaaggacgcaucucccucacccgccaagccucaugggacuucgacaccuucuccuucuacauggaccucaaagcccuccgcuccgacgacaccgccgucuacuucugcgcccgccaacgcuccgacuaccgcgacuucgacgucuggggcuccggcacccaagucaccgucuccuccgccuccaccaaaggc

SEQ ID NO: 57840 - RNA, 384 nt, Artificial Sequence
  derived and/or modified sequence opt11 from anti-HIV_Chain
caaguccaccucucccaauccggcgccgucgucaccaaacccggcgccuccguccgcgucuccugcgaagccucaggcuacaaaaucuccgaccacuucauccacugguggcgccaagcccccggccaaggaccccaaugggucggcuggaucaaccccaaaaccggccaacccaacaacccccgccaauuccaaggccgcaucucccucacccgccaagccuccugggacuucgacaccuucuccuucuacauggaccuaaaagcccuccgcucagacgacaccgccgucuacuucugcgcccgccaccgcuccgacuacugggacuucgacgucuggggcuccggcacccaagucaccgucuccucagccuccaccaaaggc

SEQ ID NO: 57841 - RNA, 384 nt, Artificial Sequence
  derived and/or modified sequence opt11 from anti-HIV_Chain
caagugcgauugcuccagagcggggccgcggucacgaaaccgggcgcgagcgugcgcgugagcugugaagcgagcggguacgagaucagggacuauuucauacacugguggaggcaagcgcccgggcaagggcuccagugggugggcuggaucaaucccaagaccgggcaaccgaacaaucccaggcaauuucaagggcgagugagcuugaccaggcaagcgagcugggacuuugacucguacucguucuauauggaucucaaggccuugcgcucggacgauaccgcggucuauuucugugccaggcaaaggagcgauuacugggacuuugacgugugggggagcgggacccaggucacggucucgagcgcaagcacgaaaggg

SEQ ID NO: 57842 - RNA, 384 nt, Artificial Sequence
  derived and/or modified sequence opt11 from anti-HIV_Chain
caagugcgcuugcuacagagcggggccgcggucacgaaaccgggcgcgagcgugcgcgugagcugugaagcgagcggguacgagaucagggacuauuucauacacugguggaggcaagcgcccgggcaagggcuccagugggugggcuggaucaaucccaagaccggacaaccgaacaaucccaggcaauuucaagggcgcgugagcuugacaagacaagcgagcugggacuuugacucguacucguucuauauggaucucaaggccuugcgcucggacgauaccggggucuauuucugugccaggcaaaggagcgauuacugggacuuugacgugugggggagcgggacccaggucacggucucgagcgcgagcacgaaaggg

SEQ ID NO: 57843 - RNA, 384 nt, Artificial Sequence
  derived and/or modified sequence opt11 from anti-HIV_Chain
caaguccgccuccuccaauccggagccgccgucaccaaacccggcgccuccguccgcgucuccugcgaagccuccggcuacgaaauccgcgacuacuucauccacugguggcgccaagcccccggccaaggccuacaaugggucggcuggaucaaccccaaaaccggccaacccaacaacccccgccaauuccaaggccgcgucucccucacccgccaagccuccugggacuucgacuccuacuccuucuacauggaccucaaagcccuccgcuccgacgacaccgccgucuacuucugcgcccgccaacgcuccgacuacugggacuucgacgucuggggcuccggcucccaagucaccgucuccuccgccuccaccaaaggc

SEQ ID NO: 57844 - RNA, 384 nt, Artificial Sequence
  derived and/or modified sequence opt11 from anti-HIV_Chain
caaguccaacuccuccaauccggcgccgccgucaccaaacccggcgccucaguccgagucuccugcgaagccuccggcuacaacauccgcgacuacuucauccacugguggcgccaagcccccggccaaggccuacaaugggucggcuggaucaaccccaaaaccggccaacccaacaaccccugccaauuccaaggccgagucucccucacccgccaagccuccugggacuucgacaccaucuccuucuacauggaccucaaagcccuccgccucgacgacaccgccgucuacuucugcgcccgccaacgcuccgacuacugggacuucgacgucuggggcuccggcacccaagucaccgucuccuccgccuccaccaaaggc

SEQ ID NO: 57845 - RNA, 384 nt, Artificial Sequence
  derived and/or modified sequence opt11 from anti-HIV_Chain
caagugcaauugcuccagagcggggccgcggucacgaaaccgggcgcaagcgugcgcgugagcugugaagcgagcggguacaauaucagggacuauuucauacacugguggaggcaagcgcccgggcaagggcuccagugggugggcuggaucaaucccaagaccgggcaaccgaacaaucccaggcaauuucaagggcgagugagccugaccaggcacgcgagcugggacuuugacacguucucguucuauauggaucucaaggccuugcgcucggacgauacagcggucuauuucugugccaggcaaaggagugauuacugggacuuugacguaugggggagcgggacccaggucauagucucgagcgcgagcacgaaaggg

SEQ ID NO: 57846 - RNA, 384 nt, Artificial Sequence
  derived and/or modified sequence opt11 from anti-HIV_Chain
cagguccagcucgugcaaucgggcgcggacgugaaaaagcccggggccacggucacggucucgugcaagaccgaugaagaugaagaugacuuucgcgcgcacuugaugcaguggaugcgccaggccccgggccagcgccuggaaugggucggguggauaaaaccgcaaacgggccagcccucguacgggcaaaaguuccagggcagggucacgcucacgcgcgaggucucgaccucgaccguguuccugcaauugcgcaaucucaggagcgaugacacggccguguacuauugcgcgcgaccgcgcgggggcagggacaauuggucguuccaugucuggggcaggggcacgcucgugaccgugagcucggccucaaccaagggc

SEQ ID NO: 57847 - RNA, 384 nt, Artificial Sequence
  derived and/or modified sequence opt11 from anti-HIV_Chain
gaagugcaauuggucgagagcggggccgaggucaagaaaccgggcgcgagcgugaaagugagcuguaaagugagcgggaacucgcucacggaauuuagcauacacugggucaggcaagcgcccgggaaagggcucgaguggaugggcggguucgauccagaggaaggggaaacggucccggcccagaaauuuaaagggcgcuugaccaugaccgaggacacgagcacgaacacggccuauauggagcucucgagcuugcgaucggaagauaccgcggucuauuacuguagcacggaaccgcgagagauggggacccugaccgcgggauuugaauauugggggcaagggacccuggucacggucucgagcgcgagcacgaaaggg

SEQ ID NO: 57848 - RNA, 384 nt, Artificial Sequence
  derived and/or modified sequence opt11 from anti-HIV_Chain
cgagugcaauugggccagagcggggcagaggucaagaaaccgggcgcgagcgugaaagugagcuguaaagugagcgggaacucgcucacggaauuuagcauacacugggucaggcaagcgccagggaaagggcucgaguggaugggcggguucgaucccgaggaaggggaaacggucccggcccagaaauuuaaagggcgcgugaccaugaccgaggacacgagcacgaacacggccuauauggagcuaucgagcuugcgcucggaagauaccgcggucuauuacuguagcacggaaccgcgagagauggggaccuugaccgcgggcuuugaauauugggggcaagggaccuuggucauagucucgagcgcgagcacgaaaggg

SEQ ID NO: 57849 - RNA, 384 nt, Artificial Sequence
  derived and/or modified sequence opt11 from anti-HIV_Chain
caagugcaauugguccagagcggggccgaugucaagaaaccgggcgcgagcgugaccgugagcuguaaaacggacgaggacgaggacgauuucagggcccaucucgugcaauggaugaggcaagcgcccgggcaaaggcucgagugggugggcuggaucaagccccagaccgggcaaccgagcuaugcccagaaauuucaagggcgcgugaccuugaccagagaagugagcacgagcacggucuuucuccagcucaggaacuugcgcucggacgauaccgcggucuauuacugugccaggcccaggggcgggcgcgauaacuggagcuuucacgugugggggcgcgggaccuuggucacggucucgagcgcgagcacgaaaggg

SEQ ID NO: 57850 - RNA, 384 nt, Artificial Sequence
  derived and/or modified sequence opt11 from anti-HIV_Chain
caaguccaacuccaagaauccggccccggccucgucaaacccuccgaaacccucucccucacuugcuccgucuccggcgccuccaucuccaacuucuacuggaccuggauacgccaacccgccggaaaaggccucgaaugggucggccgccucuacuccuccgaccgcaccaacuacaaccccucccucaacggccgcgucaccaugucccucgacaccuccaaaaaccaauucucacuccgccucaccuccaugaccgacgccgacaccgccaucuacuucugcgcccgcgaaaaaggccaauggcucaccgucccccccuacuacuucgacuccuggggccaaggcauccucgucaccgucuccuccgccuccaccaaaggc

SEQ ID NO: 57851 - RNA, 384 nt, Artificial Sequence
  derived and/or modified sequence opt11 from anti-HIV_Chain
caaguccaacucguccaauccggcgccgaaguccgcaaacccggcgccuccgucaaagucucaugcaaaaccuccggcuacaccuucaccaacuccuacauccacuggguacgccaagcccccggccaaggccucgaauggaugggcaucaucaacccccccggcggcaacaccuacuacgcccaaaaauuccacggccgcgucacacucacccgcgacaccuccaccuccaccgucuacauggaacucaacucccuccgcuccgaagacaccgccgucuacuucugcgcccgcccccacucccccaccaacauccccucccgcccccucgacuacuggggccaaggcacccucgucaccgucuccuccgccuccaccaaaggc

SEQ ID NO: 57852 - RNA, 384 nt, Artificial Sequence
  derived and/or modified sequence opt11 from anti-HIV_Chain
caaguccaacuccaagaauccggccccggccucgucaaacccuccggcacccucucccucacaugcaacgucuacggcggcucaaugaucuccuacuacuggucauggauccgccaaccacccggcaaaggccucgaauggaucggccacgucuacaacuccggcaacaccaaauacucccccucccucaaaaaccgcgucaccauauccauggacaccucccgcaaccucuucucccucaaagucaccuccgucacccccgccgacaccgccgucuacuacugcgcccgcgccgacuacgacaacaucugggacucccgcggcggcuucgaccucuggggacaaggcacccucgucaccgucuccuccgccucaaccaaaggc

SEQ ID NO: 57853 - RNA, 384 nt, Artificial Sequence
  derived and/or modified sequence opt11 from anti-HIV_Chain
caagugcaauugguccagagcggggccgaggucaagaaaccgggcucgagcgugaaagugagcuguaaagcgagcgggggcacgcucucgagcuauaccauaagcugggucaggcaagcgcccgggcaagggcucgaguggaugggcaggcucauacccuuggucgauaucacgaccuaugcccagaaauuucaagggcgcgugaccauaaccgcggacacgagcacgaacacggccuauauggagcucucgaacuugcgcucggaagauaccgcgaucuaucacugugccacgagcacgaugauagccgcggucauaaacgaugccuuugacuugugggggcaagggaccacggucacggucucgagcgcgagcacgaaaggg

SEQ ID NO: 57854 - RNA, 384 nt, Artificial Sequence
  derived and/or modified sequence opt11 from anti-HIV_Chain
caagugcaauugguccagagcggggccgaggucaagaaaccgggcgcgagcgugaaaauaagcuguaaagcgagcggguacucguucaggaacuaugccgugcacugggucaggcaagcgccagggcaagggcucgaguggaugggcgagaucaauggcgggaacgggaacacggaauauagccagaaaucgcaagggcgccugaccauaaccagggacauaagcgcgaccacggccuauauggagcucucgagcuugcgcucggacgauaccgcggucuauuacugugccagggucgcguacgugcacguggucacgaccaggagcuuggacaauugggggcaagggaccuuggucacggucucgagcgcgagcacgaaaggg

SEQ ID NO: 57855 - RNA, 384 nt, Artificial Sequence
  derived and/or modified sequence opt11 from anti-HIV_Chain
caaguccgccucucacaauccggcgccgccgucaugaaaaccggcgccuccgucaccaucuccugcgaaaccgaaggcuucaacuucgucaacuacaucauccacuggguccgccgcccccccggccgcggcuucgaauggcucggcaugaucgacccccgcaacggccaccccugguucgcccaaaccguccgcggccgccucucacuccgccgcgacaccuucaacgaaaucgucuacaugacccucuccggccucaccaccgacgacaccggccucuacuucugcgcccgcaacgaaccccaauaccacucccuccccggcauguucgacuacuggggacaaggcacccccgucaccgucucauccgccuccaccaaaggc

SEQ ID NO: 57856 - RNA, 384 nt, Artificial Sequence
  derived and/or modified sequence opt11 from anti-HIV_Chain
caagugcgcuugagccagagcggggccgcggucgugaaaacgggcgcgagcgugaccauaagcugugaaacggaaggguacaauuucgugaacuauaucauacacugggucaggcgcccgcccgggcgcggguucgagugguugggcaugaucgaucccaggaacgggcacccgugguuugcccagaccgugcgcgggcgcuugagcuugcgcagagacacguucaaggaaacggucuauaugacgcucucgggcuugacaucggacgauaccggggucuauuucugugccaggaacgagccccaguaccauagcuugcccgggauguuugacuauugggggcacgggaccccggucacggucucgagcgcgagcacgaaaggg

SEQ ID NO: 57857 - RNA, 384 nt, Artificial Sequence
  derived and/or modified sequence opt11 from anti-HIV_Chain
caagggcaauugguccagagcgggggcggggucaagaaauugggcacgagcgugaccauaagcugucucgcgagcgaguacacguucaaugaauuugucauacacuggaucaggcaagcgcccgggcaagggcccuuguggcugggcuugaucaagagaucgggcaggcucaugaccucguaccaguuccaggacaggcucucgcucaggcgcgaucgcucgaccgggaccguguucauggaauugcgcgggcucagggucgaugacacggccguguacuauugcgcgcgcgauggcuugggcgaggucgcgccagcguacuuguacgggaucgaugccuggggccagggcacgaccgugaucgugaccucagccucgaccuca

SEQ ID NO: 57858 - RNA, 384 nt, Artificial Sequence
  derived and/or modified sequence opt11 from anti-HIV_Chain
caagugcaauugguccagagcggggccgaggucaagaaaccgggcgcgagcgugaaagugagcuguaaagcgagcggguacacguucacgagcuaugacauaaacugggucaggcaagcgaccgggcaagggcucgaguggaugggcuggaugaaucccaauagcgggaacacgggcuaugcacagaccuuucaagggcgcgugaccaugaccaggaacacgagcauaagcacggccuauauggagcucucgagcuugcgcucggaagauaccgcggucuauuacugugccagggacaggugguugccccaguacuauuacuauggcauggacgugugggggcaagggaccacggucacggucucgagcgcgagcacgaaaggg

SEQ ID NO: 57859 - RNA, 384 nt, Artificial Sequence
  derived and/or modified sequence opt11 from anti-HIV_Chain
cagguccagcucgugcaaucgggcgcggaagugaaaaagcccgggagcucgaugaaggucucgugcaagagcucgggcgggaccuuuagcaaucacgcaaucucgugggugcgccaggccccgggcaagggcuuggaauggaugggcgggauaaucccgaugucgggcacgaccaauuacuugcaaaaguuccagggcagggucacgaucacggccgaugaauuugccacgaccgcguacauggaauugagcucgcuaacgagcgaggacacggccguguacuauugcgcgcgcgcacgcgcggacucgcacacgcccauagacgcguucgauaucuggggcccgggcacgcgcgugaucgugagcucggccucgaccaagggc

SEQ ID NO: 57860 - RNA, 384 nt, Artificial Sequence
  derived and/or modified sequence opt11 from anti-HIV_Chain
caagugcaauugguccagagcggggccgaggucaagaaaccgggcgcgagcgugaaagugagcuguaaagugagcggguacacgcucacggaauugagcauacacugggucaggcaagcgcccgggaaaaggcuagaguggaugggcggguucgaucccgaggacggggaaaggaucuaugcccagaaauuucaagggcgcgugaccaugaccgaggacacgagcacggacacggccuauauggagcuaaauagcuugcgcucggacgauaccgcggucuauuacugugccacgggcgggcucuauugcucgagcauaagcuguaucauggacgugugggggcaagggaccacggucacggucucgagcgcgagcacgaaaggg

SEQ ID NO: 57861 - RNA, 384 nt, Artificial Sequence
  derived and/or modified sequence opt11 from anti-HIV_Chain
caagugcaauugguccagagcggggccgaggucaagaugccgggcgcgagcgugaaagugagcuguaaagugagcggguacucgcucacggaacugagcauacacugggucaggcaagcgcccgggaaaaggcucgaguggaugggcggguucgaucccgaggacgaugaaaggaucuaugcccagaaauuucaagaucgcgugaccaugaccgaggacacgagcacggacacggccuauauggaucucaauagccugcgcucggaagauaccgcggucuauuacuguaccacgggcgggcucuauugcucgagcauaagcuguaucauggacgugugggggcaagggaccacggucauagucucgagcgcgagcacgaaaggg

SEQ ID NO: 57862 - RNA, 387 nt, Artificial Sequence
  derived and/or modified sequence opt11 from anti-HIV_Chain
gaagugcaauugagcgagagcgggggcggguucgugaaaccgggcgggagcuugcgcuugagcugugaagcgagcggguucacguucaauaacuaugcaaugagcuggguaaggcaagcgcccgggaaagggcucgagugggugagcgugaccucggcccauggugggagcgcguacuauggcgaguucgugaaagggcgcuuuacaaugagcagggaccauuucauagacacggucuaucucgagaugaauggcuugaccguggaagauaccgcggucuauuacugugucagggucacguucuaucacgagggcucgggcuauuacuaucgcgcgggcaauuacuuugacucgugggggaaagggaccaggguaguggucucggcc

SEQ ID NO: 57863 - RNA, 387 nt, Artificial Sequence
  derived and/or modified sequence opt11 from anti-HIV_Chain
gaagugcaauugagcgagagcgggggcggguucgugaaaccgggcgggagcuugcgcuugagcugugaagcgagcggguucacguucaauaacuaugccaugagcuggguaaggcaagcgcccgggaaagggcucgagugggugagcgugaccucggcccauggcgggagcgcguacuauggcgaguucgugaaagggcgcuuuaccaugagcagggaccauuucauagacacggucuaucucgagaugaaucgcuugaccguggaagauaccgcggucuauuacugugucagggucacguucuaucacgagggcucgggcuauuacuaucgcgcgggcaauuacuuugacucgugggggaaagggaccagggucguggucucggcc

SEQ ID NO: 57864 - RNA, 387 nt, Artificial Sequence
  derived and/or modified sequence opt11 from anti-HIV_Chain
gaaguccaacucuccgaauccggcggcggcgucgucaaacccggcggcucccuccgacucuccugcgaagccuccggcuucaccuucuccaacuacgcaauguccuggguccgacaagcccccggcaaaggccucgaaugggucucagucaccggcggccacggcaccuacggcuacuacggcgaauucgucaaaggccgauucaccaucucccgcgaccacuccauggacaccgucuaccuccaaaugaaccgccuccgcgucgaagacaccgccgucuacuacugcguccgcacccccuacuaccacgaauccuccggcuacuacuaccgcgccggcaacuacuucgacuucuggggcaaaggcacccuagucaucgucuccgcc

SEQ ID NO: 57865 - RNA, 387 nt, Artificial Sequence
  derived and/or modified sequence opt11 from anti-HIV_Chain
gaagugcaauugagcgagagcgggggcggguucgugaaaccgggcgggagccugcgcuugagcugugaagcgagcggguucacguucaauaacuaugccaugggcugggucaggcaagcgcccgggaaagggcucgagugggugagcgugaccucggcccauggagggagcgcguacuuuggcgaguucgugaaagggcgauuuaccaugagcagggaccauuucauagacacggucuaucucgagaugaaucgcuugaccguggaagauaccgcggucuauuacuguguaagggucacguucuaucacgagggcucgggcuauuacuaucgagcgggcaauuacuuugacucgugggggcaagggaccuuggucauagucucggcc

SEQ ID NO: 57866 - RNA, 387 nt, Artificial Sequence
  derived and/or modified sequence opt11 from anti-HIV_Chain
caagugcaauuggucgagagcgggggagggcucgugcaaccgggcgggagcuugcgauugagcugugccgcgagcggguucacguucucgacccauuggaugcacugggucaggcaagcgccagggaaagggcucgugugggugagcaggauccauagcgauggcaggagcacgagcuaugccgauagcgugaaagggcgauuuaccauaagcagggacaaugccaagaacacgcucuaucuacagaugaauagcuugcgcgcggaagauaccgcggucuauuacugugccaggggcgcggccguguucggggucgugaucauaggcgggauggaucucuggggacagggcacgaccgugaccgugagcucggccucgaccaagggc

SEQ ID NO: 57867 - RNA, 387 nt, Artificial Sequence
  derived and/or modified sequence opt11 from anti-HIV_Chain
caagugcaauuggucgagagcgggggcgcgcucgugcaaccgggcgggagcuugcgcuugagcugugccgcgagcggguucucguucucgagcuaugccaugagcugggucaggcaagcacccgggaaagggcucgagugggugagcgcgaucucgcgcucgggcgggagcacguacuaugccgauagcgugaaagggcgcuuuaccauaagcauagacaauagcaauaacacgcuauaucuccagaugaauagcuugcgcguggaagauaccgcggucuauuacugugccaagcgcgaggccuuuuacuauggcgcgggcggguacgggauggaugucuggggccagggcacgaccgugaccgugagcucggccucgaccaagggc

SEQ ID NO: 57868 - RNA, 387 nt, Artificial Sequence
  derived and/or modified sequence opt11 from anti-HIV_Chain
uuccaaggccaccucguccaauccggcggcggcgucaaaaaacccggcaccuccgucacccucuccugccucgccuccgaauacaccuucaccgaauucaccauccacuggauccgccaagcccccggccaaggcccccucuggcucggccucaucaaacgcucaggccgccuaaugaccuccuaccgcuuccaagaccgccucucccuccgccgcgaccgcuccaccggcaccgucuucauggaacuccgcucccuccgaaccgacgacaccgccguauacuacugcgcccgcgacggccucggcgaacucgcccccgccuaccacuacggcaucgacgccuggggccaaggcaccacagucaucgucaccuccgccuccaccuca

SEQ ID NO: 57869 - RNA, 387 nt, Artificial Sequence
  derived and/or modified sequence opt11 from anti-HIV_Chain
caagggcucuugguccagagcgggggcggggucaagaaauugggcacgagcgugaccauaagcugucucgcgagcgaguacacguucaaugaguucgucauacacuggaucaggcaagcgcccgggcaagggcccuugugguugggcuugaucaagcgcucgggcaggcucaugaccucguaccaguuccaggacaggcucucgcucaggcgcgaucgcucgaccgggaccguguucauggaauugcgcgggcucaggguagaugacacggccguguacuauugcgcgcgcgauggcuugggcgaagucgcgcccgcguacuuguacgggaucgaugccuggggccagggcacgaccgugaucgugaccucggccucgaccaagggc

SEQ ID NO: 57870 - RNA, 387 nt, Artificial Sequence
  derived and/or modified sequence opt11 from anti-HIV_Chain
aacuucaugcucacccaacccgccuccgucuccggcucccccggccaauccaucaccaucuccugcucaggcaccggcuccgacaucggcgucuacaacuacgucuccugguaccaacaacaccccggcaaagccccccgccucaugaucuacgacgucaccaaccgccccuccggcgucuccaaccgcuucuccggcuccaaauccggcuucaccgccucccucaccaucuccggccuccaaggcgacgacgaagccgacuacuacugcuccuccuacuccuccaccaacaccuacgucuucggcaccggcacccacgucaccguacucggccaacccaaagccaaccccaccgucacccucuucccccccuccuccgaagaacuc

SEQ ID NO: 57871 - RNA, 387 nt, Artificial Sequence
  derived and/or modified sequence opt11 from anti-HIV_Chain
caauccgcccucacccaaccccgcuccgucuccggcucccccggccaauccgucaccaucucaugcaccggcaccucauccgacgucggcgccuacaacuacgucuccugguaccgccaacaccccggcaaagcccccaaacucaugaucaacgacgucuccaaacgccccuccggcguccccgaccgcuucuccggcuccaaauccggcaacaccgccucccucaccaucuccggccuccaagccgaagacgaagccgacuacuacugcugcuccuacgccggcaccuacuccuacgucuucggcaccggcaccaaagucaccguccucggccaacccaaagccaaccccaccgucacccucuucccacccucauccgaagaacuc

SEQ ID NO: 57872 - RNA, 387 nt, Artificial Sequence
  derived and/or modified sequence opt11 from anti-HIV_Chain
caagggcaauugguccagagcgggggcgggcucaagaaaccgggcacgagcgugaccauaagcugucucgcgagcgaguacacguucaaugaauuugucauacacuggaucaggcaagcgcccgggcaagggcccuugugguugggauugaucaagcgcucgggcaggcuaaugacagcguacaauuuccaggacaggcucucgcucaggcgcgaucgcucgaccgggaccguguucauggaauugcgcgggcucaggcccgaugacacggccguguacuauugcgcgcgcgauggcuugggcgaggucgcgcccgauuacagguacgggaucgaugucuggggccagggcucgaccgugaucgugacagcggccucgaccaagggc

SEQ ID NO: 57873 - RNA, 387 nt, Artificial Sequence
  derived and/or modified sequence opt11 from anti-HIV_Chain
aacuucaugcucacccaaccccccuccgccuccggcgcccccggccaacgcgucaccaucuccugcuccggcggccccuccaacgucggcggcaacuacgucuacugguaccgccaauuccccggcacagcccccaaccuccucauccuccgcgacgaccaacgccccuccggcguccccgaccgcuucuccgccuccaaauccggcaacuccgccucccucgccaucuccggccuccgacccgacgacgaagccuucuacuucugcgccaccuacgacuccgacggcuccauccgccucuucggcggcggcaccacccucaccguccucucccaacccaaagccgcccccuccgucacccucuucccccccuccuccgaagaacuc

SEQ ID NO: 57874 - RNA, 387 nt, Artificial Sequence
  derived and/or modified sequence opt11 from anti-HIV_Chain
caacucguccucacccaacccccauccgucuccggcgcccccggccaacgcgucaccaucuccugcuccggcggccccuccaacgucggaggcaaccuagucuacugguacaaacaauuccccggcaccgcccccaaacuccucauccgccgagacgaccaacgcccauccggcguccccgaccgcuucuccggcuccaaauccggcaacuccgccucccucaccaucuccggccuccgccccgacgacgaagccuucuacuucugcgccaccuacgacucccaaggcuccacccgccuauucggcggcggcaccguccucaccguccucucccaacccaaagccgcccccuccgucacccucuucccacccuccuccgaagaacua

SEQ ID NO: 57875 - RNA, 387 nt, Artificial Sequence
  derived and/or modified sequence opt11 from anti-HIV_Chain
aacuucaugcucacccaaccccccuccgucuccggcgcccccggccaacgugucaccaucuccugcuccggcggccccuccaacgucggcggcaaccucgucuacugguacaaacaauuccccggcaccgcccccaaacuccucauccgccgcgacgaccaacgccccuccggcguccccgaccgcuucuccggcuccaaauccggcaacuccgccucccucgccaucuccggccuccgccccgacgacgaagccuucuacuucugcgccaccuacgacucccacggcuccauccgccucuucggcggcggcacccuccucaccguccucucccaacccaaagccgcccccucagucacccucuucccccccuccuccgaagaacuc

SEQ ID NO: 57876 - RNA, 387 nt, Artificial Sequence
  derived and/or modified sequence opt11 from anti-HIV_Chain
caauccgcccucacccgcacccccuccgucucaggcgcccccggccaacgagucaccaucuccugcuccggcggccccuccaacgucggcggcaacuacgucuacugguaccaacaauuccccggcgccgcccccaaacuccuaauccgccgcgacgaccaacgcccauccggcguccccgaccgcuucuccggcuccaaauccggcaacuccgccucacucgccaucuccggccuccgccucgacgacgaagccuacuacuucugcgccaccuacgacuccggcugguccauccgccucuucggcggcggcacccgccucaccguccucucccaacccaaagccgcccccuccgucacccuauucccacccucauccgaagaacuc

SEQ ID NO: 57877 - RNA, 387 nt, Artificial Sequence
  derived and/or modified sequence opt11 from anti-HIV_Chain
caauccgcccucacccaaccccccuccgucuccgccacccccggccaaaccgucaccaucuccugcuccggcuccggcuccaacgucggcggcaaccacgucuacugguaccgccaacuccccggcgccgccccaacccuccuuaucuccaaaaccgaccaccgccccucccgcguccccgaccgcuucuccgcauccaaauccggcaacuccgccucccucgccaucuccggccuccgccccgacgacgaagccaucuacuucugcgccaccuacgacacaggccucucccuccgccucuucggcggcggcacacgccucaccguccucucccaacccaaagccgcccccuccgucacccucuucccccccuccuccgaagaacuc

SEQ ID NO: 57878 - RNA, 387 nt, Artificial Sequence
  derived and/or modified sequence opt11 from anti-HIV_Chain
cagguccagcucuuggaaucgggcccgggcuuggucacgcccucgggcacgcuaucgcucgcgugcgcggucucgggcgcgagcauaagcucgagccauugguggaccuggguaaggcaaucgcccggaaaagggcucgaguggauaggcgagaucgaucgcaggggcacgaccaauuacaaucccucgcucaggagcagggucacgaucuugcucgauaacucgaaaaaucaauuuagcuugagcuugcgcucggucacggccgcggacacggccguguacuauugcacgaaaguguacgcgggcuuguucaaugaaaggaccuauggaauggacgugugggggcacgggaccacgguccuggucucgagcgcgagcacgaaaggg

SEQ ID NO: 57879 - RNA, 387 nt, Artificial Sequence
  derived and/or modified sequence opt11 from anti-HIV_Chain
caagccgucgucacccaaccacccuccgucuccgcuacccccggccaaaccgucaccaucuccugcuccggcucaggcuccaacgucggcggcaaccacgucuacugguaccgacaacuccccggcgccgcccccacccuccucaucucaaaaaccaaccgccgccccucccaaguccccgaccgcuucuccggcuccaaaucaggcaacuccgccucccucgccaucuccggccuccgccccgacgacgaagccgacuacuucugcgccaccuacgacaccgaccucucccuccgccucuucggcggcggcacccgccucaccguccucucccaacccaaagccgcccccuccgucacccucuucccccccucauccgaagaacuc

SEQ ID NO: 57880 - RNA, 387 nt, Artificial Sequence
  derived and/or modified sequence opt11 from anti-HIV_Chain
caauccgcccucacccaaccccccuccgucuccggcacccccggccaaaacgucaccaucuccugcuccggcggcggcuccgacgucggcggcaaccucgucuccugguaccaacacuucccaggcgccgcccccaaacuccucauccaccgcgacaaccaacgccccuccggcguccccgaccgcuucuccgcccucaaauccggcaacuccgccucccucgccaucuccggccuccgcuccgacgacgaagccuucuacuucugcgccgucuacgacuccucccucucccucggccucuucggcggcggcaccaaacucaccguccucucccaacccaaagccgcccccuccgucacccucuucccccccuccuccgaagaacuc

SEQ ID NO: 57881 - RNA, 387 nt, Artificial Sequence
  derived and/or modified sequence opt11 from anti-HIV_Chain
caauccgcccucacccaaccccccuccgccuccggcacccccggccaacgcgucaccaucuccugcuccggcggcggcuccaacaucggcggcaaccucgucuccugguaccaacacuuccccggcaccgcccccaaacuccucaucuaccgcaacgaccaacgccccuccggcguccccgaccgcuucuccggcuccaaauccggcaccuccgccucccucaccaucuccggccuccgauccgacgacgaagccaccuacuucugcgccgccuacgacuccucacucucccuccgccucuucggcggcggcaccacccucaacguccucucacaacccaaagccgcccccuccgucacccucuucccccccuccuccgaagaacuc

SEQ ID NO: 57882 - RNA, 387 nt, Artificial Sequence
  derived and/or modified sequence opt11 from anti-HIV_Chain
caauccgcccucacccaaccccccuccgucuccgccacccccggccaaaccgucaccaucuccugcuccggcuccggcuccaacgucggcggcaaccacgucuacugguaccgccaacucccaggcgccgcccccacccuccucaucuccaaaaccaaccaccgccccucccaaguccccgaccgcuucuccgccuccaaauccggcaacuccgccucccucgccaucuccggccuacgccccgacgacgaagccgacuacuucugcggcaccuacgacaccucccucucccuccgccucuucggcggcggcacccgccucaccguccucucccaacccaaagccgcccccuccgucacccucuucccccccuccuccgaagaacuc

SEQ ID NO: 57883 - RNA, 387 nt, Artificial Sequence
  derived and/or modified sequence opt11 from anti-HIV_Chain
caauccguacucacccaaguccucuccgucuccggcacccccggccaacgcgucaucaucucaugcuccggcaccuccuccaacgucggcggcaaccucgucucaugguaccaacaccuccccggcgccgccccccgccuacucauccaccgcgacgaccaacgccccuccggcguccccgaccgcuucuccggcuccaaauccggcaacucagccucccuagucaucuccggccuccgcuccgacgacgaagccgacuacuucugcggcgccuacgacuccaccuucucccuccccguauucggcggcggcacccgccucaccguccucucccaacccaaagccgcccccuccgucacccucuucccccccuccuccgaagaacuc

SEQ ID NO: 57884 - RNA, 387 nt, Artificial Sequence
  derived and/or modified sequence opt11 from anti-HIV_Chain
caauccgcccucacccaaccccccgccaccucaggcacccccggccaacgcgucaccaucuccugcuccggcggaggcucaaacgucggcggcaaccucgucuccugguaccaacaauuccccggcgccgcccccaaacuaauccuccaccgcgacggccaacgccccuccggcguccccgaccgcuucuccgccuccaaauccggcaccuccgccucccucaccaucuccggccuccgauccgacgacgaagccaccuacuucugcgccgccuucgacuccgcccucucccucccccucuucggcggcggcaccaaacucaccguccucucccaacccaaagccgcccccuccgucacccucuucccccccuccuccgaagaacuc

SEQ ID NO: 57885 - RNA, 387 nt, Artificial Sequence
  derived and/or modified sequence opt11 from anti-HIV_Chain
caacucguccucacccaaccccccuccgucuccgccacucccggccaaaccgucaccaucuccugcuccggcuccggcuccaacgucggcggcaaccacgucuacugguaccgccaacuccccggcgccgcccccacccucgucaucuccaaaaccgaccaccgccccucccgcguccccgaccgcuucuccggcuccaaauccggcaacuccgccucccucgccaucuccggccuccgccccgacgacgaagccgccuacuucugcgccaccuacgacaccggccucucccuccgccuauucggcggcggcacccgccucgccguacucucccaacccaaagccgcccccuccgucacccucuucccccccuccuccgaagaacuc

SEQ ID NO: 57886 - RNA, 387 nt, Artificial Sequence
  derived and/or modified sequence opt11 from anti-HIV_Chain
caauccgcccucacccaaccacccucugucuccggcacccccggccaaaacgucaccaucuccugcuccggcggcggcuccaacguaggcggcaaccucgucuccugguaccaacacuuccccggcgccgcccccaaacuccucauccaccgcgacaaccaacgacccuccggcguacccgaccgcuucuccguccucaaauccggcaacuccgcaucccucgccaucuccggcccccgcuccgacgacgaagccuucuacuucugcgccgucuacgacuccucccucucccucggccucuucggcggcggcaccaaacucaccguccucucccaacccaaagccgcccccuccgucacccucuucccacccuccuccgaagaacuc

SEQ ID NO: 57887 - RNA, 387 nt, Artificial Sequence
  derived and/or modified sequence opt11 from anti-HIV_Chain
caaaccgucgucacccaaccccccuccgccuccggcacccccggccaacgcgucaccaucuccugcuccggcggcggcuccaacauaggcggcaaccucgucuccugguaccaacacuuccccggcgccgcccccaaacuccucaucuaccgcaacgaccaacgccccuccggcguccccgaccgcuucucaggcuccaaauccggcaccuccgccucccucaccaucuccggccuccgauccgacgacgaagccacauacuucugcgccgccuacgacugcacccucucccuccgccucuucggcggcggcaccacccucaacguccucucccaacccaaagccgcccccuccgucacccucuucccccccuccuccgaagaacua

SEQ ID NO: 57888 - RNA, 387 nt, Artificial Sequence
  derived and/or modified sequence opt11 from anti-HIV_Chain
caauccgcccucacccaaacccccuccguauccggcgcccccggccaacgcgucaccaucuccugcucuggcggccccuccaacgucggcggcaacuacgucuacugguaccaacaauuccccggcgccgcccccaaacuccucauccgccgcgacgaccaacgccccuccggcguccccgaccgcuucuccggcuccaaauccggcaacuccgccucccucgccaucucaggccuccgacucgacgacgaagccuacuacuucugcgccaccuacgacuccggcugguccauccgccucuucggcggcggcacccgccucaccguccucucccaacccaaagccgcccccuccgucacccucuucccccccuccuccgaagaacuc

SEQ ID NO: 57889 - RNA, 387 nt, Artificial Sequence
  derived and/or modified sequence opt11 from anti-HIV_Chain
caauccguccuaacccaaccccccuccgccuccggcgcccccggccaacgcgucacaaucuccugcucaggcggccccuccaacgucggcggcaacuacgucuacugguaccgacaauuccccggcaccgcccccaaccuccucauccuccgcgacgaccaacgccccuccggcguccccgaccgcuucuccgccuccaaauccggcaacuccgccucccucgccaucuccggccuccgccccgacgacgaagccuucuacuucugcgccaccuacgacuccgacggcuccguccgccucuucggcggcggcaccacccucaccguccucucccaacccaaagccgcccccuccgucacccucuucccccccuccaacggcggccgu

SEQ ID NO: 57890 - RNA, 387 nt, Artificial Sequence
  derived and/or modified sequence opt11 from anti-HIV_Chain
caagggcaauugguccagagcgggggcggggucaagaaaccgggcacgagcgugaccauaagcugucucgcgagcgaguacacguucaaugaauuugucauacacuggaucaggcaagcgcccgggcaagggcccuugugguugggcuugaucaagcgcucaggcaggcucaugaccucguacaaguuccaggacaggcucaaucucaggcgcgaucgcucgaccgggaccguguucauggaauugcgcgggcucaggcccgaugacacggccguguacuauugcgcgcgcgauggcuugggcgaggucgcgcccgauuacagguacgggaucgaugucuggggccagggcucgaccgugaucgugaccgcggccucgaccaagggc

SEQ ID NO: 57891 - RNA, 387 nt, Artificial Sequence
  derived and/or modified sequence opt11 from anti-HIV_Chain
gagguccagcucguggaaucgggcgcggaagugaaaaagcccggggccucggucaaggucgcgugcaaggucucgggcaagaaauugagcgaucucucgauccauugggugcgccaggccccgggcaagggcuuggaauggaugggaggguuugacgaggaagauggcaagaucucguacgagcgcaaguuccagggcagggucacgaugacggaagauaccgcgcgagauacagcguucauggaaaugagcucgcuaaggagcgaugacacggccguguacuuuugcgcggccgcgcccaggcucgaucucggggaauugagcucgggcuuucacuuuugggggcucgggacuuugguaucgguaucgagcgcgagcacgaaaggg

SEQ ID NO: 57892 - RNA, 387 nt, Artificial Sequence
  derived and/or modified sequence opt11 from anti-HIV_Chain
caagggcaauugguccagagcgggggcgggggcaagaaauugggcacgagcgugaccauaagcugucucgcgagcgaguacacguucaaugaauuugucauacacuggaucaggcaagcgcccgggcaagggcccuugugguugggcuugaucaagcgcucgggcaggcucaugaccucguaccaguuccaggacagacucucgcucaggcgcgaucgcucgaccgggaccguguucauggaauugcgcgggcucagggucgaugacacggccguguacuauugcgcgcgcgauggcuugggcgaggucgcgcccgcguacuuguacgggaucgaugccuggggccagggcacgacagugaucgugagcucggccucgaccaagggc

SEQ ID NO: 57893 - RNA, 387 nt, Artificial Sequence
  derived and/or modified sequence opt11 from anti-HIV_Chain
gaagugcaauuggucgagagcggggccgaggucaagaaaccgggcgcgagcgugaaagugagcuguaaagugagcggguacacgcucucggacuugagcaugcacugggucaggcaagcgcccgggaaagggcucgaguggaugggcggguucgaugaagaggacggggaaauaaccuaugcccagaaauuucaagggcgcgugagcaugaccgaggacacgagcagggacacggccuauauggagcucucgagcuugcgcucggaagauaccgcggucuauuacugugccacggccccgcgcuuggaauugggcgagcucucgagcggguuccauuacuggggcuugggcacgcucgugacagugagcucggccucgaccaagggc

SEQ ID NO: 57894 - RNA, 387 nt, Artificial Sequence
  derived and/or modified sequence opt11 from anti-HIV_Chain
caagggcaauugguccagagcgggggcggggucaagaaaacgggaacgagcgugaccauaagcugucucgcgagcgaguacacguucacggaauuuaccauacacuggaucaggcaagcgcccgggcaagggccauugugguugggcuugaucaagcgcucgggcaggcucaugaccgcgaacagguuccaggacaggcuaucgcucaggcgcgaucgcucgaccgggacaguguucauggaauugcgcucgcucaggaucgaugacacggccguguacuauugcgcgcgcgauggcuugggcgagcucgcgcccgcguaccauuacgggaucgacgucuggggccagggcacgaccauaaucgugaccucggccucgaccaagggc

SEQ ID NO: 57895 - RNA, 387 nt, Artificial Sequence
  derived and/or modified sequence opt11 from anti-HIV_Chain
caagggcaauugguccagagcgggggcggggucaagaaauugggcacgagcgugaccauaagcugucucgcgagcgaguacacguucaaugaauuugucauacacuggaucaggcaagcgcccgggcaagggcccuugugguugggcuugaucaagcgcucgggcaggcucaugaccucguaccaguuccaggacaggcucucgcucagacgcgaucgcucgaccgggaccguguucauggaauugcgcgggcucagggucgaugacacggccguguacuauugcgcgcgcgauggcuugggagaggucgcgcccgcguacuuguacgggaucgaugccuggggccagggcacgaccgugaucgugaccucggccucgaccaagggc

SEQ ID NO: 57896 - RNA, 387 nt, Artificial Sequence
  derived and/or modified sequence opt11 from anti-HIV_Chain
caagggcaauugguccagagcgggggcggggucaagaaacugggcacgagcgugaccauacccugccucgcgagcgaguacacguucaaugaauuugucauacacuggaucaggcaagcgcccgggcaagggccccugugguugggccugaucaagcgcucgggcaggcucaugaccucguaccaguuccaggacaggcucucgcucaggcgcgaucgcucgaccgggaccguguucauggaacugcgcgggcucagggucgaugacacggccguguacuauugcgcgcgcgauggcuugggcgaggucgcgcccgcguacuuguacgggaucgaugccuggggccagggcacgaccgugaucgugaccucagccucgaccaagggc

SEQ ID NO: 57897 - RNA, 387 nt, Artificial Sequence
  derived and/or modified sequence opt11 from anti-HIV_Chain
caagggcaauugguccagagcgggggcggggucaagaaaccgggcacgagcgugaccauaagcugucucgcgagcgaguacacguucaaugaauuugucauacacuggaucaggcaagcgcccgggcaagggcccgugugguugggcuugaucaagcgcucgggcaggcucaugaccucguacaaguuccaggacaggcucucgcucaggcgcgaucgcucgaccgggaccguguucauggaauugcgcgggcucaggcucgaugacacggcaguguacuauugcgcgcgcgauggccugggcgaggucgcgcccgcguacuuguacgggaucgaugccuggggccagggcucaaaagugaucgugaccccggccucgaccaagggc

SEQ ID NO: 57898 - RNA, 387 nt, Artificial Sequence
  derived and/or modified sequence opt11 from anti-HIV_Chain
caagcccgccucgaccaauggggcaccggccuccucaaaccauccgaaacccucucccuaaaaugcgccgucuucggcguccucuucaccgacuacaacuggaccuggguccgccaaucccccggcaaagaacucgaauggaucggccaccucgaccaccgaggcggcggcaacuacaaccccucccucgaaucccgagucaccaucucccucgacuacuccaaagcccaauucucccuccaccucaaauccgucaccgucgccgacaccgcccgcuacuacugcgccggagccgucaaaggcuucugguucgacgaccccuacaccugguucggccccuggucccaaggcacccucgucaccgucgccuccgccuccaccaaagga

SEQ ID NO: 57899 - RNA, 387 nt, Artificial Sequence
  derived and/or modified sequence opt11 from anti-HIV_Chain
caagcacgccucgaccaauggggcaccggccuccucaaacccucagaaacccucucccucaaaugcgccgucuucggcguccucuucaccgacuacaacuggaccuggguacgccaaucccccggcaaaggccucgaauggaucggccaccucgaccaccgcggcggcggcuccuacaaccccucccuagaaucccgcgucuccaucucccucgacuacuccaaagcccaauucucccuccaccucaaauccgucaccgucgccgacaccgcccucuacuacugcgccggcgccgucaaaggcuucugguucgacgaacccuccaccugguucggccccuggucccaaggcaccauggucaccgucgccuccgccucaaccaaaggc

SEQ ID NO: 57900 - RNA, 387 nt, Artificial Sequence
  derived and/or modified sequence opt11 from anti-HIV_Chain
caagggcacuugguccagagcgggggcggggucaagaaauugggcacgagcgugaccauaagcugucucgcgagcgaggacacguucaaugaauuugucauacacuggaucaggcaagcgccagggcaagggccauugugguugggcuugaucaagcgcucgggcaggcucaugaccucguaccaguuccaggacaggcuaucgcuaaggcgcgaucgcucgaccgggaccguguucauggaacugcgcgggcucagggucgaugacacggccguguacuauugcgcgcgcgauggccugggcgaggucgcgcccgcguacuuguacgggaucgaugccuggggccagggcacgaccgugaucgugaccucggccucgacaaagggc

SEQ ID NO: 57901 - RNA, 387 nt, Artificial Sequence
  derived and/or modified sequence opt11 from anti-HIV_Chain
cagguccagcucgugcaaucggaagcggaagugaaaaagcccgggagcucggucaaggucucgugcaaggccucgggcgggaccuuucgcggguacacgaucucgugggugcgccaggccccgggccagggcuuggaauggauggggcgcauaaucccgaucuugggcaaggccauauacgcgcccucguuccagggcagggucacgcucacggccgauaaaucgaccgggacagcguacauggaauugagcaggcucaggagcgaugacacggccguguacuauugcgcgaaagugaaaaugcgcgggagcucgggcuauuacuaucucuuugacgauugggggcaagggaccuuggucacggucucgagcgcgagcacgaaaggg

SEQ ID NO: 57902 - RNA, 387 nt, Artificial Sequence
  derived and/or modified sequence opt11 from anti-HIV_Chain
caagcccgccucgaccaauggggcaccggccuccucaaacccuccgaaacccucucccucaaaugcgccgucuucggcguccucuucaccgacuacaacuggaccuggguccgccaaucccccggcaaaggccucgaauggaucggccaccucgaccaccgcggcggcggcaacuacaaccccucccucgaaucccgcgucaccaucucccucgacuacuccaaagcccaauucucccuccaccucaaauccgucaccgucgccgacaccgcccucuacuacugcgccggcgccgucaaaggcuucugguucgacgaagucuacaacugguucggccccuggucccaaggcacccucgucaccgucgccuccgccuccaccaaaggc

SEQ ID NO: 57903 - RNA, 387 nt, Artificial Sequence
  derived and/or modified sequence opt11 from anti-HIV_Chain
caaggacaauugguccagagcgggggcggggucaagaaaccgggcacgagcgugaccauaagcugucucgcgagcgaguacacguucacggaauuuaccauacacuggaucaggcaagcgccagggcaagggccccugugguugggccugaucaagcgcucgggcaggcuaaugaccgcguacagguuccaggacaggcuaucgcucaggcgcgaucgcucgaccgggaccguguucauggaacugcgcaaucucaggauggaugacacggccguguacuauugcgcgcgcgauggcuugggcgagcucgcgcccgcguaccaguacgggaucgaugucuggggccagggcacgaccgugaucgugagcucggccucgaccaagggc

SEQ ID NO: 57904 - RNA, 387 nt, Artificial Sequence
  derived and/or modified sequence opt11 from anti-HIV_Chain
caaguccgccucguccaauccggcccccaagucaaacgccccggcgccuccauccgacucuccugcgaauccuccggcuaccgcuuccaagacuacaucgucgccuggauccgccaaacccgaggccaaggcuucgaauucgucggcauggucaacccccgaggcggacgccccuggcccuccucccgcuuccgagaccgcgucacccucacacgcgacaucgaauccgaaaccuucuaccucggccucaacgaccucaccuccgacgacaccgccaccuacuucugcgcccgccucgaagccgacggcuccgacuacucccccaaaauguucgacuucuggggccaaggaacaaaaaucgucgucucccccgccuccaccaaaggc

SEQ ID NO: 57905 - RNA, 387 nt, Artificial Sequence
  derived and/or modified sequence opt11 from anti-HIV_Chain
caaguccgccucguccaauccggcccacaagucaaaacccccggcgccuccaugcgcgucucaugcgaagcauccggcuaccgcuuccucgacuacaucaucgucuggauccgccaaacccacggccaacacuucgaauacgucggcaugaucaacccacgaggcggaacccccuggcccuccuccaaauuccgcgaccgccuaucccucacccgcgacauccacaccgacaccuucuaccucggccucaacaaccucggcuccgacgacaccgccaucuacuucugcgcccgccuagaagccgacggcgacgacuacucccccaaaauguucgaccacuggggccaaggcacccgcaucaucgucuccgccgccucaaccaaaggc

SEQ ID NO: 57906 - RNA, 387 nt, Artificial Sequence
  derived and/or modified sequence opt11 from anti-HIV_Chain
caaguccgccucguccaauccggcccccaagucaaaaccccaggcgccuccauccgccucuccugcgaagccuccggcuaccgcuuccuagacuacuucaucgucuggguccgccaaacccccggccaaggcuucgaauacgucggcaugaucaacccccgcggcggccgccccugguccuccuggaaauuccgcgaccgccucucccucacccgcgaaaucgacaccgacaccuucuaccucggccucuccaaccuccgcuccgacgacaccgccaucuacuucugcgcccgccucgaagccgacggcgacgacuacucccccaaaauggucgacuacuggggccaaggcaccaaaaucaucgucucagccgccucaaccaaaggc

SEQ ID NO: 57907 - RNA, 387 nt, Artificial Sequence
  derived and/or modified sequence opt11 from anti-HIV_Chain
caggucaggcucgugcaaucgggcccgcaagugaaaaggcccggggccucgaucaggcucucgugcgagaccucgggcuaucgauuucaagauuacauagucgcguggauacgccagaccaggggccagcgcuuugaauuugucgggauggugaacccgcgcgggggcaggcccuggcccucgagcaaguucagggacagggucacgcucacgcgcgauaucgagagcgagaccuuucacuugggcuugaacgaucucacgagcgaugacacggccacguacuuuugcgcgcgcuuggaagcggacggggccgauuacucgcccaagauguuugacuuuugggggcaagggaccaagaucguggucucgcccgcgagcacgaaaggg

SEQ ID NO: 57908 - RNA, 387 nt, Artificial Sequence
  derived and/or modified sequence opt11 from anti-HIV_Chain
caaguccgccucguccaauccggcccccaagucaaaacccccggcgccuccaugcgcaucuccugcgaagccuccggcuaccgcuuccaagacuacaucaucgucuggauccgccaaacccacggccaaggcuucgaauacgucggcaugaucaacccccgcggcggcacccccugguccucauccaaauuccgcgaccgccucucccucacccgcgacaucuacaccgacaccuucuaccuaggccucaacaaccucggcuccgacgacaccgccaucuacuucugcgcccgacucgaagccgacggcggcgacuacucccccaaaauguucgacuacuggggccaaggcacccgcaucaucguaucagccgccuccaccaaaggc

SEQ ID NO: 57909 - RNA, 387 nt, Artificial Sequence
  derived and/or modified sequence opt11 from anti-HIV_Chain
caagggcaacugguacagagcgggggcggggucaagaaaccgggcgcgagcgugaccauaagcugucuagcgagcgaguacacguucaaugaauuugucauacacuggaucaggcaagcgcccgggcaagggccccuguggcugggcuugaucaagcgcucgggcagacuaaugaccgcguacaaguuccaggacaggcucucgcucaggcgcgaucgcucgaccgggaccguguucauggaauugcgcgggcucaggcccgaggacacggccguguacuauugcgcgagagauggcuugggcgaggucgcgcccgauuacagguacgggaucgaugucuggggccagggcucgaccgugaucgugagcgcggccucgaccaagggc

SEQ ID NO: 57910 - RNA, 387 nt, Artificial Sequence
  derived and/or modified sequence opt11 from anti-HIV_Chain
caaguccgccucguccaauccggcccccaaaugaaaacccccggcgccucccuccgccucuccugcgaagucuccggcuaccgcuuccuagacuacuucaucgucuggguccgccaaaccggcggccaaggcuucgaauacgucggcaugaucaacccccgcggcggccgccccugguccuccuggaaauuccgcgaccgccucucccucacccgcgacaucgaaaccgacaccuucuaccucggccuaaacaaccuccgauccgacgacaccgccaucuacuucugcgcccgccucgaagccgacggcgacaacuacucccccaaaauggucgacuacuggggccaaggcaccaaaaucaucgucucccccgccuccaccaaaggc

SEQ ID NO: 57911 - RNA, 387 nt, Artificial Sequence
  derived and/or modified sequence opt11 from anti-HIV_Chain
caagugagccugguccagagcgggccccaggucaagaccccgggcgcgagcaugcgcgugagcugugaaacgagcggguacagguucuuggacuauaucauagucuggaucaggcaaacacacgggcaacauuucgaguacgugggcaugaucaaucccagaggcgggaccccguggccgagcucgaaauuucgcgaucgccugaccaugaccagggacauacacacggacacguucuaucucgggcucaauaaccugcgcucggacgacaccgcgaucuauuucugugccaggcucgaggccgauggcgaugacuauagcccgaaaauguucgauuacuggggccagggcacgcgcauaaucgugagcgcggccucgaccaagggc

SEQ ID NO: 57912 - RNA, 387 nt, Artificial Sequence
  derived and/or modified sequence opt11 from anti-HIV_Chain
caagugcgcuugguccagagcgggccccaggucaagaccgcgggcgcgagcaugcgcguaagcugcgaagcgagcggguacagguuccuggacuauaucauagucuggaucaggcaaacgcacgggcaacauuucgaguacgugggcaugaucaaucccaggggcgggaccccguggccgagcucaaaauuucgcgaccgccugaccuugaccagggacauauacacggacacguucuaucucgggcucaauaacuugggcucgggcgauaccgcgaucuauuucugugccaggcucgaggccgauggcgaugacuacagcccgaaaauguucgauuacuggggccagggcacgcgcauaaucgugagcgcggccucgaccaaaggc

SEQ ID NO: 57913 - RNA, 387 nt, Artificial Sequence
  derived and/or modified sequence opt11 from anti-HIV_Chain
caagggcaauugguccagagcgggggcggggucaagaaaccgggcacgagcgugaccauaagcugucucgcgagcgaguacacguucaaugaauuugucauacacuggaucaggcaagcgcccgggcaagggcccgugugguugggcuugaucaagcgcucgggcaggcucaugaccucguacaaguuccaggacaggcucucgcucaggcgcgaucgcucgaccgggaccguguucauggaauugcgcgggcucaggcucgaugacacggccguguacuauugcgcgcgcgacggcuugggcgaggucgcgcccgcguacuuguacgggaucgaugccuggggccagggcucgaccgugaucgugaccucggccucgaccaagggc

SEQ ID NO: 57914 - RNA, 387 nt, Artificial Sequence
  derived and/or modified sequence opt11 from anti-HIV_Chain
caagggcaauuaguccagagcgggggcgggcuaaagaaaccgggcacgagcgugaccauaagcugucucgcgagcgaguacacguucaaugaauuugucauacacuggaucaggcaagcgcccgggcaagggcccuugugguugggcuugaucaagcgcucgggcaggcucaugaccgcguacaauuuccaggacaggcucaggcucaggcgcgaucgcucgaccgggaccguguucauggaauugcgcgggcucaggcccgaugacacggccguguacuauugcgcgcgagauggcuugggcgaggucgcgcccgauuacagguacgggaucgaugucuggggccagggcucgacagugauagugaccgcggccucgaccaagggc

SEQ ID NO: 57915 - RNA, 387 nt, Artificial Sequence
  derived and/or modified sequence opt11 from anti-HIV_Chain
caagggcacuugguccagagcgggggcggggucaagaaacugggcacgagcgugaccauaagcugucucgugagcgaguacacguucaaugaauuugucauacacuggaucaggcaagcgcccgggcaagggcccuugugguugggccuaaucaagcgcucgggcaggcucaugaccucauaccaguuccaggacaggcucucgcucaggcgcgaucgcucgaccggaaccguguucauggaauugcgcgggcucagggucgaugacacggccguguacuauugcgcgcgagauggccugggcgaggucgcgcccgcguaccuguacgggaucgaugccuggggccagggcacgaccguaaucgugaccucggccucgaccaagggc

SEQ ID NO: 57916 - RNA, 387 nt, Artificial Sequence
  derived and/or modified sequence opt11 from anti-HIV_Chain
caagggcaacugguccagagcgggggcggggucaagaaauugggaacgagcgugaccauaagcugucucgcgagcgaguacacguucaaugaauuugucauacacuggaucaggcaagcgcccgggcaagggcccuugugguugggcuugaucaagcgaucgggcaggcucaugaccucguaccaguuccaggacagacucucacucaggcgcgaucgcucgacagggaccguguucauggaauugcgagggcucagggucgaugacacggccguguacuauugcgcgcgcgauggcuugggcgaggucgcgcccgcguacuuguacgggaucgaugccuggggccagggcacgaccgugauagugagcucggccucgaccaagggc

SEQ ID NO: 57917 - RNA, 387 nt, Artificial Sequence
  derived and/or modified sequence opt11 from anti-HIV_Chain
caagggcacuugguccagagcgggggcggggucaagaaauugggcacgagcgugaccauaagcugucuagcgagcgaguacacguucaaugaauuugucauacacuggaucaggcaagcgcccgggcaagggccccugugguugggcuugaucaagcgaucgggcaggcucaugaccucguaccaguuccaggacaggcucucgcucaggcgcgaucgcucgaccgggaccguguucauggaauugcgcgggcucagggucgaugacacggccguguacuauugcgcgcgcgauggcuugggagaggucgcgcccgcguacuuguacgggaucgaugccuggggccagggcacgaccgugaucgugaccucggccucgaccaagggc

SEQ ID NO: 57918 - RNA, 387 nt, Artificial Sequence
  derived and/or modified sequence opt11 from anti-HIV_Chain
caaguccaacucguccaauccggcuccgaacucaaaaaacccggcgccuccgucaaagucuccugcaaagccuccggcuacaccuucaccucauacgccaucaacuggguccgccaagcccccggccaaggccucgaauggaugggcuggaucaacaccaacaccggcaaccccaccuacgcccaaggcuucaccggccgcuucgucuucucccucgaaaccuccguauccacagccuaccuccaaaucaacucccucaaagccgaagacaccgccgucuacuacugcgcccgcgaccuccucgaaucccgcaccuacuacaacgacauccgcgacugcuggggccaaggcacccucgucaccgucuccuccgccuccaccaaaggc

SEQ ID NO: 57919 - RNA, 387 nt, Artificial Sequence
  derived and/or modified sequence opt11 from anti-HIV_Chain
caaguccaacuaguccaauccggcgccgaagucaaaaaacccggcgccuccgucaaagucuccugcaaagccuccggcuacaccuucaccgacuacuacauccacuggguccgccaagcccccggccaaggccucgaauggaugggcuggaucaaccccucaaccggcggcaccaacuucguccaaaaauuccucggccgcgucaccaugaccuccgacaccuccaucaacaccgccuacauggaacuccgccgccucaaaaacgacgacgccgccaucuacuacugcgccaccuacuccacccgccaauucuuccacuacuacuacgucaccgacgucuggggccaaggcaccaccgucaccgucuccuccgccuccaccaaaggc

SEQ ID NO: 57920 - RNA, 387 nt, Artificial Sequence
  derived and/or modified sequence opt11 from anti-HIV_Chain
uuccaaggacaauugguccagagcgggggcggggucaagaaaccgggcucgagcgugaccauaagcugucucgcgagcgaguacacguucacggaauuuaccauacacuggaucaggcaagcgcccgggcaagggcccuugugguugggauugaucaagcgcucgggcaggcucaugaccucguacggguuccaggacaggcucucagucaggcgcgaucgcucgaccggaaccguguucauggaacugcgcucgcuaaggaccgaugacacggccguguacuauugcgcgcgcgauggcuugggcgagcucgcgcccgcguaccauuacgggaucgaugucuggggccagggcacgaccgugaucgugaccucggccucgaccucg

SEQ ID NO: 57921 - RNA, 387 nt, Artificial Sequence
  derived and/or modified sequence opt11 from anti-HIV_Chain
caagugcaauuggucgagagcgggggcggggucgugcaaccgggcaggagcuugcgcuugagcugugccgcgagcggguucacguucucgagcuaugcaaugcacugggucaggcaagcgcccgggaaagggcucgaguggguggccgugaucucguacgauggcucgaacaaguacuaugccgauagcgugaaagggcgcuuuaccauaagcagggacgauagcaagagcacggucuaucuccagaucaauagcuugcgcgcggccgauacagcggucuauuucugugccagggaagggggcuugcgcuuucucgagugguuguucuggggccagggcacgcucgugaccgugagcucgggagagagcucggcaucgaccaagggc

SEQ ID NO: 57922 - RNA, 390 nt, Artificial Sequence
  derived and/or modified sequence opt11 from anti-HIV_Chain
caaguccaacucguccaauccggcgccgucgucaaaucccccggcuccucagccaaacucuccugccgccuccucggcgacgaauucggcaccuacuucaucuccuggauccgccaagcccccggccgcggccucgaaugggucggcggcaucgucccccacucccaacuccaauccucagcccaaaaauuccacggccgauucuucaucaccggaggcgucaccccccccaucaucuuccuccaacucaccaacgucaccuucgaagacaccggcaccuacuucugcgcccgcgaacgcggccgccaccgcgaccccaaaaccggcaaaucccuccgaggccgcuacuucgacuucuggggccgcggcacaggcgucaccgucuccccc

SEQ ID NO: 57923 - RNA, 390 nt, Artificial Sequence
  derived and/or modified sequence opt11 from anti-HIV_Chain
caaauagaauugcgccagagcggagccgcaaugaaaagcccgggcucgagcgugaagcugagcuguaccgugcucggggaaaacuucgggaccuauuucauaagcuggaucaggcaagcacccgggcaaggacucgagugggugggcgggaucgugccccacagccagcuccagagcucggcccagaaauuccacgggcgcauaaaaauaagcgggggcgggaccccgcccguagucucgcucgagcucacgaacgugaccuucgacgauaccgggaccuauuucugcgccagagaaagaggcagacacguggaaccgaaaacgggcgaccgcuuggccgggcgcuacuucgauaucuggggcaggggcacgggccuacgcgugagcccg

SEQ ID NO: 57924 - RNA, 390 nt, Artificial Sequence
  derived and/or modified sequence opt11 from anti-HIV_Chain
gaagugcaauugguagagagcgggggcgggcucgugaaaccgggcgggagcuugcgcuugagcugugaagcgagcggguucacguucacgaacgcguggaugaacugggucaggcaagcgcccgggaaagggcuagagugggugggcaggaucaagagccagacccauggcgggaccacgcgcuaugccgcgcccgugaaagggcgcuuuaccauaagcagggacgauagcaagcacacacucuaucuccagauggaucgccugaccacggaagauaccgcggucuauuacuguaccgggaccauaaccgggagcacguucuauuacuauggcauggacgugugggggcaagggaccacggucacggucucgcccgcgagcacgaaaggg

SEQ ID NO: 57925 - RNA, 390 nt, Artificial Sequence
  derived and/or modified sequence opt11 from anti-HIV_Chain
gucguccaacucguccaauccggccccggccucgucaaaccaucccaaacccucucccucaccugcaccgucuccggcggcuccaucuccuccggcgacuucuacugguccuggauccgccaaccccccggcaaaggccucgaauggaucggcuacaucuacuacuccggcuccaccuacuacaaccccucccucaaaucacgccucaccaucuccguagacaccuccaaaaaccaauucucccuccgccucuccuccgucaccgccgccgacaccgccgucuacuacugcgcccgcgaccucaacucacgcaucgucggcgcccucgacgccuucgacaucuggggccaaggcaccauggucaccgucuccuccgccuccaccaaaggc

SEQ ID NO: 57926 - RNA, 390 nt, Artificial Sequence
  derived and/or modified sequence opt11 from anti-HIV_Chain
gagguccagcuagugcaaucgggcgggggccugguccagcccgggcgcucgcucaggcucucgugcgcggccucgggcuuuaccuuugacgauuacgcgaugcauugggugcgccaggccccgggcaagggcuuggaaugggucucgggcauaagcuggaacucgggcacgaucggguacgcggacucggucaggggcagguucacgaucucgcgcgaugacgcgaaaagcucauuguaccugcaaaugaacucgcucaggaccgaggacacggccuuguacuauugcgcgaaagauggcugggucgggagcgggagcucgaccuugcgcgggagcgauuacuggggacagggcacgcucgugacagugagcucggcaucgaccaaggga

SEQ ID NO: 57927 - RNA, 390 nt, Artificial Sequence
  derived and/or modified sequence opt11 from anti-HIV_Chain
caauccguccucacccaaccccccuccgccuccggaucccccggccaauccaucaccaucuccugcaccggcaccuccuccgacgucggcggcuacaacuacgucucaugguaccaacaaccccccggcaaagcccccaaagucaucaucuacgaagucuccaaacgccccuccggcguccccgaccgcuucuccggcucaaaauccggcaacaccgccucccucaccgucuccggccuccaagccgaagacgaagccgacuacuacugcuccuccuacgccggcuccaacaacuucgucuucggaaccggcaccgaagucaccgucgucggccaacccaaagccaaccccaccgucacccucuucccccccuccuccgaagaacuucuc

SEQ ID NO: 57928 - RNA, 390 nt, Artificial Sequence
  derived and/or modified sequence opt11 from anti-HIV_Chain
caagccgucgucacccaagaacccucacucaccgucucccccggcggcaccgucacccucaccugcgccuccuccaccggcgccgucaccucaggcuucuacccccacugguuccaacaaaaacccggccaagccccccgcgcccucaucuacuccaccuccaaccgcuacuccuggacccccgcccgcuucuccggcucccuccuaggcggcaaagccgcccucacccucuccggcguccaacccgaagacgaagccgaauacuacugccuccuccuccccuacuacggcggccccuggaucuucggcggcggcaccaaacucaccguccucggccaacccaaagccgcccccuccgucacccucuucccccccuccuccgaagaacuc

SEQ ID NO: 57929 - RNA, 390 nt, Artificial Sequence
  derived and/or modified sequence opt11 from anti-HIV_Chain
caauccgcccucacccaaccccccuccgccuccggcgcccccggccaacgcgucaccaucuccugcuccggcggccccuccaacgucggcggcaacuacgucuacugguaccgccaauuccccggcaccgcccccacccuccuaauccuccgcgacgaccaacgccccuccggcguccccgaccgcuucuccgccucaaaauccggcaacuccgccucccucgccaucuccggccuccgccccgacgacgaaggcuucuacuucugcgccaccuacgacuccgacggcuccauccgccuauucggaggaggcaccgcacucaccguccucucccaacccaaagccgcacccuccgucacccucuucccccccuccuccgaagaacucaaa

SEQ ID NO: 57930 - RNA, 390 nt, Artificial Sequence
  derived and/or modified sequence opt11 from anti-HIV_Chain
caaguccaacucgucgaaucaggcuccgacguccgcaaacccggcgccaccgucaccgucuccugcaaagccgacgaagacgaagacgacuucaccgccuacaacuacuucaugcacuggguccgccaagcccccggccacggccucgaauggaucggcuggaucaacccccgcaccggccaacccaaccacgccaaacaauuccaaggccgcgucacccucacccgcgaacgcuccaccuccaccgucuucaugaaacucaccaaccuccgccucgacgacaccgccgucuacuucugcgcacgcccccuccgaggcggcgacaccuggcacuaccacuccuggggccgcggcaccucccucaccgucuccuccgccucaaccaaaggc

SEQ ID NO: 57931 - RNA, 390 nt, Artificial Sequence
  derived and/or modified sequence opt11 from anti-HIV_Chain
gaaguccaacucgucgaauccggcuccgacguccgcaaacccggcgccaccgucaccgucuccugcaaagcagacgaagacgaagacgacuucaccgccuacaacuacuucaugcacuggguccgccaagcacccggccacggccucgaauggaucggcuggaucaacccccgcaccggccaaccaaaccacgccaaacaauuccaaggccgagucacccucacccgcgaacgcuccaccuccaccgucuucaugaaacucaccaaccuccgccucgacgacaccgccgucuacuucugcgcccgcccccuccgcggcggcgacaccuggcacuaccacuccuggggccgcggcaccucccuaaccguauccuccgccuccaccaaaggc

SEQ ID NO: 57932 - RNA, 390 nt, Artificial Sequence
  derived and/or modified sequence opt11 from anti-HIV_Chain
gaaguccaacucguccaaucaggcuccgacguccgcaaacccggcgccaccgucaccgucuccugcaaagccgacgaagacgaagacgacuucaccgcauacgacuacuucaugcacuggguccgccaagcccccggccacggccucgaauggaucggcuggaucaacccacgcaccggccaaccaaaccacgccaaacaauuccaaggccgcgucacccucacccgcgaacgcuccaccuccaccgucuucaugaaacucaccaaccuccgacucgacgacaccgccgucuacuucugcgcccgcccccuccgcggcggagacaccuggcacuaccacagcuggggccgcggcaccucccucaccgucuccucagcauccaccaaaggc

SEQ ID NO: 57933 - RNA, 390 nt, Artificial Sequence
  derived and/or modified sequence opt11 from anti-HIV_Chain
caaguccaacucguccaauccggcuccgacguccgcaaacccggcgccaccgucaccgucucaugcaaagccgacgaagacgaagacgacuucaccgccuacaacuacuucaugcacuggguccgccaagcccccggacacggccucgaauggaucggcuggaucaacccccgcaccggccaacccaaccacgccaaacaauuccaaggccgagucacccucacccgcgaacgcuccaccuccaccgucuucaugaaacucaccaaccuccgccucgacgacaccgccgucuacuucugcgcccgcccccuccgcggcggcgacaccuggcacuaccacuccuggggccgcggcaccucccucaccgucuccuccgccuccaccaaaggc

SEQ ID NO: 57934 - RNA, 390 nt, Artificial Sequence
  derived and/or modified sequence opt11 from anti-HIV_Chain
caaguccaacucguccaauccggcuccgacguccgcaaacccggcgccaccgucaccgucucaugcaaagccgacgaagacgaagacgacuucaccgccuacaacuacuucaugcacuggguccgccaagcccccggccacggccucgaauggaucggcuggaucaacccccgcaccggccaacccaaccacgccaaacaauuccaaggccgcgucacccucacccgcgaacgcuccaccuccaccgucuucaugaaacucaccaaccuccgccucgacgacaccgccgucuacuucugcgcccgcccccuccgcggcggcgacaccuggcacuaccacucccgcggccgcggcaccucccucaccgucuccuccgccuccaccaaaggc

SEQ ID NO: 57935 - RNA, 390 nt, Artificial Sequence
  derived and/or modified sequence opt11 from anti-HIV_Chain
gaaguccaacucgucgaauccggcuccgacguccgcaaacccggcgccaccgucaccgucuccugcaaagccgacgaagacgaagacgacuucacagccuacaacuacuucaugcacuggguccgccaagccccaggccaaggccuagaauggaucggcuggaucaacccccgaaccggccaacccaaccacgccaaacaauuccaaggccgcgucacccucacccgcgaacgauccaccuccacagucuucaugaaacuaaccaaccuccgccucgacgacaccgccgucuacuucugcgcccgcccccuccgcggcggcgacaccuggcacuaccacucauggggccgcggcaccucccucaccgucuccuccgccuccaccaaagga

SEQ ID NO: 57936 - RNA, 390 nt, Artificial Sequence
  derived and/or modified sequence opt11 from anti-HIV_Chain
gucguccaacucguccaaucaggcuccgacguccgcaaacccggcgccaccgucaccgucuccugcaaagccgacgaagacgaagacgacuucaccgcauacaacuacuucaugcacuggguccgccaagcccccggccacggccucgaauggaucggauggaucaacccccgcaccggccaacccaaccacgccaaacaauuccaaggccgcgucacccuaacccgcgaacgcucaaccuccaccgucuucaugaaacucaccaaccuccgacucgacgacaccgccgucuacuucugcgcccgcccccuccgcggcggcgacaccuggcacuaccacuccuggggccgcggcaccucccucaccguaucauccgccucaaccaaaggc

SEQ ID NO: 57937 - RNA, 390 nt, Artificial Sequence
  derived and/or modified sequence opt11 from anti-HIV_Chain
gaaguccaacucguccaauccggcuccgacguccgcaaacccggcgccaccguaaccgucuccugcaaagccgacgaagacgaagacgacuucaccgccuacaacuacuucaugcacuggguccgccaagcccccggccacggccucgaauggaucggcuggaucaacccccgcaccggccaacccaaccacgccaaacaauuccaaggccgcgucacccucacccgcgaacgcuccaccuccaccgucuucaugaaacuaaccaaccuacgccucgacgacaccgccgucuacuucugcgcccgaccacuacgcggcggcgacacauggcacuaccacucauggggccgcggcaccucacucaccgucuccuccgccuccaccaaaggc

SEQ ID NO: 57938 - RNA, 390 nt, Artificial Sequence
  derived and/or modified sequence opt11 from anti-HIV_Chain
gaaguccaacucguacaauccggcuccgacgucaaaaaacccggcaccaccgucaccaucuccugcaaagccgacgaagacgaagacgacuucaccgccuacaacuacuucaugcacuggguccgccaagcccccggccaaggccucgaauggaucggcuggaucaacccccgaaccggccaaccaaaccacgcaaaacaacuccaaggccgcgucacccucacccgcgaacgauccaccuccaccgucuucaugaaacuaaccaaccuccgccucgacgacaccgccgucuacuucugcgcccgaccacuccgcggcggcgacaccuggcacuaccacuccuggggccgaggcaccucccucaucgucuccuccgccucaaccaaaggc

SEQ ID NO: 57939 - RNA, 390 nt, Artificial Sequence
  derived and/or modified sequence opt11 from anti-HIV_Chain
caagugcaauuggucgagagcgggggcgggcucgugaaaccgggcgggagcuugcgccugagcugugccgcgagcggguucucguucaaugaauauuacaugagcuggaucaggcaagcgcccgggcaagggcucgaguggguggccaauaucgggagcucggacgcguacacgaucuaugccgauagcgugaaagggcgcuuuaccauaagcagggacaaugccgagaacacggucuaucuccagaugaauagcuugcgcggggaagauaccgcggucuauuacugugccaggaucgagggcuauugcucgaacucgcgcuguagcaauuacuuugacccguggggacaaggggcauuggucacggucucgagcgcgagcacgaaaggg

SEQ ID NO: 57940 - RNA, 390 nt, Artificial Sequence
  derived and/or modified sequence opt11 from anti-HIV_Chain
caagugcaauugguccagagcggggccgaggucaagaaaccgggcgcgagcgugaaagugagcuguaaagugagcggguacccgcucgcggaauugagcgugcacugggucaggcaagugcccgggaaagggcucgagugggugggcggguucgaucccgaggaagggaaaacggucuaugcccagaaauuucaagggcgcgugaccaugaccgaggacaggagcacggacacggucuauauggagcucauaucguugcgcuaugaagauaccgcggucuauuacugugccacggacaaucccgugcuccagcucggggaauugagcagcagccuggacuauugggggcaagggacccuggucacagucucgagcgcgagcacgaaaggg

SEQ ID NO: 57941 - RNA, 390 nt, Artificial Sequence
  derived and/or modified sequence opt11 from anti-HIV_Chain
gaaguccaacuaguccaauccggcgccgaagucaaaaaacccggcgaaucccuccgcaucuccugcaaaaccuccggcuacaacuucaacgacgacuggaucgccuggguccgccaacgccccgacaaaggccccgaauggaugggcaucuucuaccccggcgacucccaagccaccuacucccccuccuuccaaggccacgucaccuucuccgccgacaccuccaucuccaccgccuaccuccaauggaccucccucaaagccuccgacaccgccaucuacuacugcgcccgaacccgcugcuucggcgccaacugcuucaacuucauggacgucuggggcaaaggcaccgcacucaccgucaccgucuccuccgccuccaccaaaggc

SEQ ID NO: 57942 - RNA, 390 nt, Artificial Sequence
  derived and/or modified sequence opt11 from anti-HIV_Chain
caggugcagcuggugcaguugcugcagagcggggcggaggugaagaagccggggaguagugugaaggugagcugucagauaagcggguauggguuuagcaauuaugcgauaaguugggugaggcaggcgccggggcagggguuggagugguuggggaggauagugccggcgguggggaugacggaguaugcgcagaaguuucaggggagggugacguuuacggcggauaggaguacgauaacggcguauauggaucugaggggguugaggagcgacgauacggcgguguauuauugugugagggauccgcagguggaggugagggggaaugcguuugauauaugggggcaggggacgauggugacggugagcagugcgaguacgaagggg

SEQ ID NO: 57943 - RNA, 390 nt, Artificial Sequence
  derived and/or modified sequence opt11 from anti-HIV_Chain
caaguccaccuccaacaauggggcgccggccuccucaaacccucagaaacccucucccuaaccugcgccgucuccggcggauccuucuccggauucuucuggaccuggauccgccaaucccccggcaaaggccucgaauggaucggcgaagucaaccacucaggcuucacccacuccaaccccucacucgaaucccgcgccaccaucuccgucgccgccuccaacacccaauucucccuccgacucgccuccgucaccgccgccgacaccgccaucuacuucugcgcccuccgauacuucgacuggucccccuuccgccgcgacaccuacggcaccgacgucuggggccaaggcaccaccgucaucgucuccuccgccuccaccaaaggc

SEQ ID NO: 57944 - RNA, 390 nt, Artificial Sequence
  derived and/or modified sequence opt11 from anti-HIV_Chain
caagugcgccuagaacagagcgggggcgcgcucagaaaaccgggcgcgagcgugacccugagcugccaagcaagcggauacaacuucguaaaauacaucauacacugggucaggcaaaggcccgggcucggauucgagugggugggcaugaucgaccccuaccgcgggcgcccgugguacgcccacagcuucgccgggcgccuaagccugagcagggacacaagcacagaaacgcucuacaugacgcucucgagccuaaaaucggacgacaccgcaaccuacuucugcgccagggccgaggccgcaagcgacagccacagcaggcccauaauggacuggacguggaggauccugugccuacucgcggucgugcccgcgagcacaaaagga

SEQ ID NO: 57945 - RNA, 390 nt, Artificial Sequence
  derived and/or modified sequence opt11 from anti-HIV_Chain
caaguccgccucgaacaauccggcgccgccguccgcaaaccaggcgccuccgucacccucuccugccaagccuccggcuacaacuucgucaacuacaucauccacuggguccgccaacgccccggccucgacuucgaaugggucggcaugaucgaccccuaccgcggccgccccugguccgcccacaaauuccaaggccgccucucccucucccgcgacgucucaacagaaauccucuacaugacccucaacucccuccgcucagacgacaccgccaccuacuucugcgcccgcgccgaagccgaaucccaaucccacucacgcccaaucauguucgacuccuggggccaaggcucccgcgucaccgucuccuccgccucaaccaaaggc

SEQ ID NO: 57946 - RNA, 390 nt, Artificial Sequence
  derived and/or modified sequence opt11 from anti-HIV_Chain
caagugcgauuggaacagagcggggccgcggucaagaaaccgggcgcgagcgugaccauaagcugucaagcgagcggguacaauuucgugaaauuuuucauacacugggucaggcaaaggcccgggcaaggguucgagugggugggcaugaucgagcccuaucgcgggcgcccguggucggccgggaacuuucaagggcgccugagcuugagcagggacgugaguacggaaacgcucuauaugacgcucaauaacuugcgcucggacgauaccgcggucuauuucugugccaggcucgaggccgagagcgauagccauagcaggcccauaauguuugaccauugggggcacgggagcuuggucacggucucgagcgcgagcacgaaaggg

SEQ ID NO: 57947 - RNA, 390 nt, Artificial Sequence
  derived and/or modified sequence opt11 from anti-HIV_Chain
caggucaggcucgagcaaucgggcgcggccgugcgcaagcccggggccucggucacgcucucgugccaggccucgggcuauaacuuugucaauuacauaauccauugggugcgccagcgcccgggccuggacuuugaaugggucgggaugauagacccguacaggggcaggcccuggagcgcgcacaaguucgagggcaggcucucacucucgcgcgaugucucgaccgaggucuuguacaugacccugagcucgcucaggagcgaugacacggccacguacuuuugcgcgcgcgcggaagcggaaucgcaaucgcacucgcgcccgaucauguucgauuacuggggccagggcucgcgcgugaccgugagcucggccucaaccaagggc

SEQ ID NO: 57948 - RNA, 390 nt, Artificial Sequence
  derived and/or modified sequence opt11 from anti-HIV_Chain
caagugcgccuggaacagagcgggaccgcggucaggaaaccgggcgcgagcgugaccauaagcugucaagcgagcggguacaauuucgugaaauuuuucauacacggggucaggcaaaggcccgggcaaggguucgaguggguaggcaugaucgagcccuuucgcgggcgaccguggucggccgggaacuuucaagggcgcuugagcuugagcagggacgugagcacggaaacgcucuauaugacgcucaauaaccugcgcucggacgacaccgcggucuauuucugugccaggcuagaggccgagagcgauagccauagcaggccaauaauguuugaccauugggggcacgggagccuggucacagucucgagcgcgagcacgaaagga

SEQ ID NO: 57949 - RNA, 390 nt, Artificial Sequence
  derived and/or modified sequence opt11 from anti-HIV_Chain
caaguccgccucgaacaaucaggcaccgccaugcgcaaacccggcgccuccgucacccucuccugccaagccuccggcuacaacuucgucaaauacaucguacacuggguccgccaaaaacccggccuaggcuucgaaugggucggcaugaucgaccccuaccgcggccgccccugguccgcccacaaauuccaaggccgccuaucccucucccgcgacaccuccauggaaauccucuacaugacccucaccucccucaaaucagacgacaccgccaccuacuucugcgcccgcgccgaagccgccuccgacucccacucccgccccaucauguucgaccacuggggccaaggcucccgcgucaccgucuccuccgccuccaccaaaggc

SEQ ID NO: 57950 - RNA, 390 nt, Artificial Sequence
  derived and/or modified sequence opt11 from anti-HIV_Chain
caaguccgccucgaacaauccggcgcagccaugcgcaaacccggcgccuccgucacccuauccugccaagccuccggcuacaacuucgucaaauacaucguccacuggguccgccaaaaacccggccucggcuucgaaugggucggcaugaucgaccccuaccgcggccgccccuggucagcccacaaauuccaaggccgacuaucccucucacgcgacaccuccauggaaauccucuacaugacccucaccucccucaaauccgacgacaccgccacauacuucugcgcccgcgccgaagccgccuccgacucacacucccgccccaucauguucgaccacuggggccaaggcucccgagucaccgucuccuccgccucaaccaaaggc

SEQ ID NO: 57951 - RNA, 390 nt, Artificial Sequence
  derived and/or modified sequence opt11 from anti-HIV_Chain
caaguccgccucgaacaauccggcgccgccaugcgcaaacccggcgccuccguaacccucuccugccaagccucaggcuacaacuucgucaaauacaucauccacuggguccgccaaaaacccggccucggcuucgaaugggucggcaugaucgaccccuaccgcggccgccccugguccgcccacaaauuccaaggccgccucucccucucccgcgacaccuccauggaaauccucuacaugacccucaccucccucaaauccgacgacaccgccaccuacuucugcgcccgcgccgaagccgccuccgacucccacucccgccccaucauguucgaccacuggggccaaggcucccgcgucaccgucuccuccgccuccaccaaaggc

SEQ ID NO: 57952 - RNA, 390 nt, Artificial Sequence
  derived and/or modified sequence opt11 from anti-HIV_Chain
caaguccgccucgaacaauccggcaacgccguccgcaaacccggcgccuccgucaccaucuccugccaagccuccggcuacaacuucgucaaauucuucauccacuggguccgacaacgccccggccaaggcuucgaaugggucggcaugaucgaaccauuccgcggccgccccugguccgccggcaacuuccaaggccgccuaucccuaucccgcgacgucuccaccgaaacacucuacaugacccucaacaaccuccgcuccgacgacaccgccgucuacuucugcgcccgccucgaagccgaauccgacucccacucccgccccauaauguucgaccacuggggccacggcucccucgucaccgucuccuccgccuccaccaaaggc

SEQ ID NO: 57953 - RNA, 390 nt, Artificial Sequence
  derived and/or modified sequence opt11 from anti-HIV_Chain
caaguccgccuagaacaauccggcgccgccguccgcaaacccggcgccuccgucacccucuccugccaagccuccggcuacaacuucguccgcuacaucauccacuggguccgccaacgccccggccucgacuucgaauggguaggcaugaucgaccccuaccgcggccgacccugguccgcccacaaauucggcggccgccucucccucaccagagacgucuccaccgaaauccucuacaugacccucaccucacuccgcuccgacgacaccgccaccuacuucugcgcccgcgcagaagccgaaucccaaucccacucccgccccaucauguucgacuccuggggacaaggcucccgcgucaccgucuccuccgccuccaccaaaggc

SEQ ID NO: 57954 - RNA, 390 nt, Artificial Sequence
  derived and/or modified sequence opt11 from anti-HIV_Chain
caggucaggcucgagcaaucgggcgcggccgugcgcaagcccggggccucggucacgcucucgugccaggccucgggcuauaacuuugucaauuacauaauccauugggugcgccagcgcccgggcuuggacuuugaaugggucgggaugauagacccguacaggggcaggcccuggagcgcgcacaaguuccagggcaggcucucgcucucgcgcgaugucucgaccgagaucuuguacaugaccuugagcucgcucagaagcgaugacacagccacguacuuuugcgcgcgcgcggaagcggaaucgcaaucgcacucgcgcccgaucauguucgauuucuggggccagggcucacgcgugaccgugagcucagccucgaccaagggc

SEQ ID NO: 57955 - RNA, 390 nt, Artificial Sequence
  derived and/or modified sequence opt11 from anti-HIV_Chain
caagugcgccuggaacagagcgggaccgcggucaggaaaccgggcgcaagcgugaccauaagcugucaagcgagcggguacaauuucgugaaauuuuucauacacugggucaggcaaagacccgggcaaggguucgagugggugggcaugaucgagcccuuucgcgggcgcccguggucggcagggaacuuucaaggacgcuugagccugagcagggacgugagcacggaaacgcucuauaugacgcucaauaacuugcgcucggacgauaccgcggucuauuucugugccaggcucgaggccgagagcgauagccauagcaggcccauaauguuugaccauuggggacacgggagcuuggucacggucucgagcgcgagcacgaaaggg

SEQ ID NO: 57956 - RNA, 390 nt, Artificial Sequence
  derived and/or modified sequence opt11 from anti-HIV_Chain
caaguccgccucgaacaauccggcgccgccaugcgcaaacccggcgccuccgucacccucuccugccaagccuccggcuacaacuucgucaaauacaucguccacuggguccgccaaaaacccggccucggcuucgaaugggucggcaugaucgaccccuaccgcggccgccccugguccgcccacaaauuccaaggccgccucucccucucccgcgacaccucaauggaaauccucuacaugacccucacaucccucaccuccgacgacaccgccaccuacuucugcgcccgcgccgaagccgccuccgacucccacucccgccccaucauguucgaccacuggggccaaggcucacgcgucaccgucuccuccgccuccaccaaaggc

SEQ ID NO: 57957 - RNA, 390 nt, Artificial Sequence
  derived and/or modified sequence opt11 from anti-HIV_Chain
gagguccagcucgugcaaucgggcgggggcuugguccagcccgggggcucgcucaggcucucgugcgcggccucgggccugaccuuucgcaauuucgcgaugucgugggugcgccaggccccgggcaagggcuuggaaugggucucgaguauaagcgggagcgggggcucgaccuauuacgcggacucggucaagggcagguucacgauaucgcgagauaacucgaaaaauacauuguacuugcaaaugaacucgcucaggggcgaggacacggccguguacuuuugcgcgaaaggggucggguacgauaucuugaccgggcucggggacgcguucgauaucuggggccagggcacggucguggccgugagcucggcaucgaccaagggc

SEQ ID NO: 57958 - RNA, 393 nt, Artificial Sequence
  derived and/or modified sequence opt11 from anti-HIV_Chain
caaguccaacucguccaauccggagccgccguccgcaaacccggcgccuccguaaccgucuccugcaaauucgccgaagacgacgacuacuccccccacugggucaaccccgcccccgaacacuacauccacuuccuccgccaagcccccggccaacaacucgaauggcucgccuggaugaaccccaccaacggcgccgucaacuacgccuggcaacuccacggccgccucaccgccacccgcgacggcuccaugaccaccgccuuccucgaaguccgcucccuccgauccgacgacaccgccgucuacuacugcgcccgcgcccaaaaacgcggccgcuccgaaugggccuacgcccacuggggccaaggcacacccguccucgucuccucc

SEQ ID NO: 57959 - RNA, 393 nt, Artificial Sequence
  derived and/or modified sequence opt11 from anti-HIV_Chain
caaguccaacuccaacaauggggcgccggccuccucaaacccuccgaaacccucucacucaccugcgccgucuacgccggcuccuucuccggcuacuacuggaccuggauccgccaaccccccggcaaaggccucgaauggaucggcgaagucaaccacggcggcuccaccaacuacaaccccucacucaaaucccgcgucacccucuccgucgacaccuccaaaaaccaauucucccucaaacucaccuccgucaccgccgccgacaccgccgucuacuacugcgcccgagucucccgcuacgacuucugguccggcaacuacggcuccuacggccucgacgucuggggccaaggcaccaccgucaccgucuccuccgccucaaccaaaggc

SEQ ID NO: 57960 - RNA, 393 nt, Artificial Sequence
  derived and/or modified sequence opt11 from anti-HIV_Chain
gaaguacaacucguccaaucaggcggcggcgucguccaacccggacgcucccuccgccucuccugcgucgucuccggcuucaccuucuccuccuucaccuuccacuggguccgccaagcccccggcaaaggccucgaaugggucgccggcauguccuuccacgccaccuacaucuacuacgccgacuccgucaaaggccgcuucaccaucucccgcgacgacucccaagacacccucuaccucgaaauggacucccuccgcuccgaagacaccgccaucuacuacugcgccagagaccccggcauccacgacuacggcgacuacgcccccggcgccuucgacuacuggggccaaggcucccccgucaccgucuccuccgccuccaccaaaggc

SEQ ID NO: 57961 - RNA, 393 nt, Artificial Sequence
  derived and/or modified sequence opt11 from anti-HIV_Chain
cagguccagcucgugcaaucgggcacggaagugcaaaagcccggggccucggucaaggucucgugcaagaccucgggcuauaccuuuagcaaguacuauauccauugggugcgccaggccccgggccagggcuuggaaugggucgggcgcauaaacacggacucgggcgggaccgauuacgcggaaaaguuccagggcagggucacgaugacgcgcgauaccucgaucacgaccguguacuuggaaaugcgcgggcuaacgagcgaugacacggccgcguucuauugcgcgcgcgggcccccgcacgcgggcggguggacgaucuauuacuauggacuggacgugugggggcaagggaccucggucauagucucgagcgcgagcacgaaaggg

SEQ ID NO: 57962 - RNA, 393 nt, Artificial Sequence
  derived and/or modified sequence opt11 from anti-HIV_Chain
cgcaccgucgucacccaaccccccuccgucuccggcgcccccggccaacgcgucaccaucuccugcaccggcucauccuccaacaucggcgccggcuacgacguccacugguaccaacaacuccccggcaccgcccccaaacuccucaucuacggcaacuccaaccgccccuccggcguccccgaccgauucuccggcuccaaauccggaaccuccgccucccuagccaucaccggccuccaagccgaagacgaagccgacuacuacugccaaucauacgacuccucccucuccggcuccggcgucuucggcaccggcaccaaagucaccguccucggccaacccaaagccaaccccaccgucacccucuucccacccuccuccgaagaacuc

SEQ ID NO: 57963 - RNA, 393 nt, Artificial Sequence
  derived and/or modified sequence opt11 from anti-HIV_Chain
caagugcaauugcaacagugggggagcgggcucuugaaaccgagcgagaccuugagcuugaccugugccguguacgggggcucguucaggagcuauuacuggaacuggaucaggcaaucgcccgggaaagggcucgaguggauaggcgaggucucgcacucgggcucgaccaauuacaaucccgcgcucaagagcagggucacgauaucggucgauaccucgaaaaaucaauuuagccugaaagugaaaucggucacggccgcggacacggccuuguacuauugcucgcgcgggcgcgggaaaaggugcucgggcgcguacuguuucgcgggcuauuucgauagcuggggccagggcgggcucguggucgugagcucggccucgacaaagggc

SEQ ID NO: 57964 - RNA, 393 nt, Artificial Sequence
  derived and/or modified sequence opt11 from anti-HIV_Chain
caaguccaccucguccaauccggcgccgaagucaaaaaacccggcuccuccguacgcgucuccugcgaagccuccggcuggaccuucggcuccgucaacuccgccaucaccuggguccgccaagcccccggccaaggccucgaauggaugggccgcacaaucccauuccucggcaucuccaacuacgcccaaaaauuccaaggccgcgucaccaucaccgccgacaaaucaaccaacaucgccuacgucgacgucaccucacucaccucccaagacaccgccgucuacuacugcgcccgccucaucaccggcaugaccgcccccugguucuacuacauggacgucuggggcaaaggcaccaccgucaccgucuccuccgccuccaccaaaggc

SEQ ID NO: 57965 - RNA, 393 nt, Artificial Sequence
  derived and/or modified sequence opt11 from anti-HIV_Chain
caaguccaccuccaagaauccggcccccgccucguccgcuccuccgaaacccucucacucaccugcuccguccccggcggcuccaucgucaaccccaucaccaacuacuacugguccuggauacgccaauccccccgcaaaggccuccaauggaucggcgacaucuacuacaccggcaccuccucccgcaaccccucccucgacucccgcgucuccaucucaauggaugucucccgcaaacaaaucucccucacccucuacucagucaccgccgccgacaccgccguccacuacugcgccucccaaucccucuccugguaccgccccuccggcuacuucgaauccuggggccaaggcauccucgucaccgucuccucagccuccaccaaaggc

SEQ ID NO: 57966 - RNA, 393 nt, Artificial Sequence
  derived and/or modified sequence opt11 from anti-HIV_LightChain
augaaacuccccguccgccuccucguccucauguucuggauccccgccuccuccuccgacaucgucaugacccaauccccccucucccuccccgucacccccggcgaacccgccuccaucuccugccgcuccucccaacgccuccucuccuccuacggccacaccuaccuccacugguaccuccaaaaacccggccaauccccccaacuccucaucuacgaagucuccaaccgcuucuccggcguccccgaccgcuucuccggcuccggcuccggcaccgacuucacccucaaaaucucccgcgucgaagccgaagacgucggcgucuacuacugcucccaauccacccacgucccccucaccuucggccaaggcaccaaagucgaaaucaaa

SEQ ID NO: 57967 - RNA, 396 nt, Artificial Sequence
  derived and/or modified sequence opt11 from anti-HIV_Chain
caaguccaacuccaagaaucaggccccggccucgucaaacccuccgaaacccucuccgucaccugcuccgucuccggcgacuccaugaacaacuacuacuggaccuggauccgccaaucccccggcaaaggccucgaauggaucggauacaucuccgaccgcgccuccgccaccuacaaccccucccucaacucccgcgucgucaucucccgcgacaccuccaaaaaccaacucucccuaaaacucaacuccgucacccccgccgacaccgccgucuacuacugcgccaccgcccgccgcggccaacgcaucuacggcgucgucuccuucggcgaauucuucuacuacuacucaauggacgucuggggcaaaggcaccaccgucaccgucuccucc

SEQ ID NO: 57968 - RNA, 396 nt, Artificial Sequence
  derived and/or modified sequence opt11 from anti-HIV_Chain
caaguccaacuccaagaauccggccccggccucgucaaaccccccgaaacccucucccucaccugcuccgucuccggcgccucagucaacgacgccuacuggucauggauccgccaaucacccggcaaacgccccgaaugggucggcuacguccaccacuccggcgacaccaacuacaaccccucccucaaacgccgcgucaccuucucccucgacaccgcaaaaaacgaagucucccucaaacucgucgcccucaccgccgcagacuccgccgucuacuucugcgcccgcgcccuccacggaaaacgcaucuacggcaucgucgcccuaggcgaacucuucaccuacuucuacauggacgucuggggcaaaggcaccaccgucaccgucucauca

SEQ ID NO: 57969 - RNA, 396 nt, Artificial Sequence
  derived and/or modified sequence opt11 from anti-HIV_Chain
caaguccaacuccaagaauccggccccggccucgucaaacccuccgaaacccucucccucacaugcuccgucuccggcgccuccaucuccgacuccuacugguccuggauccgccgcucccccggcaaaggccucgaauggaucggcuacguccacaaauccggcgacaccaacuacucacccucccucaaaucccgcgucaaccucucccucgacaccuccaaaaaccaagucucccucucccucgucgccgccaccgccgccgacuccggcaaauacuacugcgcccgcacccuccacggccgccgcaucuacggaaucgucgccuucaacgaaugguucaccuacuucuacauggacgucuggggcaacggcacccaagucaccgucuccucc

SEQ ID NO: 57970 - RNA, 396 nt, Artificial Sequence
  derived and/or modified sequence opt11 from anti-HIV_Chain
caaguccaccuccaagaauccggccccggccucgucaaacccuccgaaacccucucccuaaccugcaacgucuccggcacccucguccgcgacaacuacugguccuggaugcgccaaccccucggcaaacaacccgaauggaucggcuacguccacgacuccggcgacaccaacuacaaccccucccucaaaucccgcguccaccucucccucgacaaauccaacaaccucgucucccuacgccuaaccgcagucaccgccgccgacuccgccaccuacuacugcgcaaccaccaaacacggccgccgcaucuacggcaucgucgccuucaacgaaugguucaccuacuucuacauggacgucuggggcaaaggcaccaccgucaccgucuccucc

SEQ ID NO: 57971 - RNA, 396 nt, Artificial Sequence
  derived and/or modified sequence opt11 from anti-HIV_Chain
caaguccaacuacaagaauccggccccggccuagucaaacccuccgaaacccucuccgucaccugcuccgucuccggcgacuccaugaacaacuacuacuggaccuggauccgccaaucccccggcaaaggccucgaauggaucggcuacaucuccgaccgcgaauccgccaccuacaaccccucccucaacucacgcgucgucaucucccgcgacaccuccaccaaccaacucucccuaaaacucaacuccgucacccccgccgacaccgccgucuacuacugcgccaccgcccgccgcggccaacgcaucuacggcgucgucuccuucggcgaauucuucuacuacuacuccauggacgucuggggccgcggcaccaccgucaccgucuccucc

SEQ ID NO: 57972 - RNA, 396 nt, Artificial Sequence
  derived and/or modified sequence opt11 from anti-HIV_Chain
caaguccaacucgucgaauccggccccggccucgucacccccuccgaaacccucucccucaccugcaccgucuccaacggcucagucuccggccgcuucugguccuggauccgccaaucccccggccgcggccucgaauggaucggcuacuucuccgacaccgaccgcuccgaauacucccccucccuccgcucccgccucacccucucccucgacgccucccgcaaccaacucucccucaaacucaaauccgucaccgccgccgacuccgccaccuacuacugcgcccgcgcccaacaaggcaaacgaaucuacggcaucgucuccuucggcgaauucuucuacuacuacuacauggacgccuggggcaaaggcaccgccgucaccguauccucc

SEQ ID NO: 57973 - RNA, 396 nt, Artificial Sequence
  derived and/or modified sequence opt11 from anti-HIV_Chain
caaguccaacuccaagaauccggccccggccucgucaaaccccccgaaacccucucccucaccugcuccgucuccggcgccuccaucaacgacgcauacugguccuggauccgccaaucccccggaaaacgccccgaaugggucggcuacguccaccacuccggcgacaccaacuacaaccccucccucaaacgccgagucaccuucucccucgacaccgccaaaaacgaagucucccuaaaacucgucgaccucaccgccgccgacuccgccguauacuucugcgcccgcgcccuccacggcaaacgcaucuacggcaucgucgcccucggagaacucuucaccuacuucuacauggacgucuggggcaaaggcaccaccgucaccgucuccuca

SEQ ID NO: 57974 - RNA, 396 nt, Artificial Sequence
  derived and/or modified sequence opt11 from anti-HIV_Chain
caaguccaacuccaagaauccggccccggccucgucaaaccccccgaaacccucucccucaccugcuccgucuccggcgccucaaucaacgacgccuacugguccuggauccgccaaucccccggcaaacgccccgaaugggucggcuacguccaccacuccggcgacaccaacuacaaccccucccucaaacgccgcgucuccuucucccucgacaccgccaaaaacgaagucucccucaaacucgucgaccucaccgccgccgacuccgccaucuacuucugcgcccgcgcacuccacggcaaacgcaucuacggcaucgucgcccucggcgaacucuucaccuacuucuacauggacgucuggggcaaaggcaccaccgucaccgucuccucc

SEQ ID NO: 57975 - RNA, 396 nt, Artificial Sequence
  derived and/or modified sequence opt11 from anti-HIV_Chain
caaguccaacuccaagaauccggccccggccucgucaaacccuccgaaacccucuccgucaccugcuccgucucaggcgacuccaugaacaacuccuacuggaccuggauccgccaaucccccggcaaaggccucgaauggaucggcuacaucuccaaaucagaauccgccaacuacaaccccucccucaacuccagagucgucaucucccgcgacaccuccaaaaaccaacucucccucaaacuaaacuccgucacccccgccgacacagccgucuacuacugcgccaccgcccgccacggccaacgcaucuacggcgucgucuccuucggcgaauucuucaccuacuacuccauggacgucuggggcaaaggcaccaccgucaccgucuccucc

SEQ ID NO: 57976 - RNA, 396 nt, Artificial Sequence
  derived and/or modified sequence opt11 from anti-HIV_Chain
caaguccaacuccaagaauccggccccggccucgucaaacccuccgaaacccucucccucaccugcuccgucuccaacggcuccgucuccggccgcuucugguccuggauccgccaaucccccggccgcggccucgaauggaucggcuacuucuccgacaccgaaaaauccaacuacaaccccucccuccgcucccgccucacccucuccgucgacgccuccaaaaaccaacucucccucaaacucaacuccgucaccgccgccgacuccgccaccuacuacugcgcccgcacccaacaaggcaaacgcaucuacggcgucgucuccuucggcgaauucuuccacuacuacuacauggacgccuggggcaaaggaaccgccgucaccgucuccucc

SEQ ID NO: 57977 - RNA, 396 nt, Artificial Sequence
  derived and/or modified sequence opt11 from anti-HIV_Chain
caaguccaacucguccaauccggcaccgcccucaaaucccccggcuccuccgccaaacucucaugcaccguccucggcgacgaauucggcaccuacuucaucuccuggauccgccaagcccccggccaaggccucgaaugggucggcggcaucgucccccacucccaacuccaauccuccgcccaaaaauuccacggccgcaucaucaucuccgccggcgccggcgucaccccccccgucgucucccuccaacuaaccaaccucaccuucgaagacaccggcaccuacuucugcgcccgcgaacgcggccgccaccgcgacccaaaaaccggcgacgcccuccgcggccgcuacuucgacuucuggggccgcggcaccggcgucuccgucuccgcc

SEQ ID NO: 57978 - RNA, 396 nt, Artificial Sequence
  derived and/or modified sequence opt11 from anti-HIV_Chain
caaguacaauugguccagagcgggaccgcgcucaagagcccgggcucgagcgcgaaauuaagcuguaccguacucggagacgaguucgggaccuauuucauaagcuggaucaggcaagcgcccggacaagggcucgagugggugggcgggaucguaccccauagccagcuccagagcucggcccagaaauuucacgggcgcauaaucauaagcgcaggcgcaggcgugaccccgcccguggucucacuccagcuaacgaacuugaccuuugaagauaccgggaccuacuucugugccagggaaaggggcaggcacagggacccgaaaacgggcaaggccccgcgcgggcgcuauuucgauuucuggggcaggggcacgggcgugacagugagcgcg

SEQ ID NO: 57979 - RNA, 396 nt, Artificial Sequence
  derived and/or modified sequence opt11 from anti-HIV_Chain
caagugcaacugguccagagcgggacagcgcucaagagcccaggcucgagcgcgaaauugagcuguaccguacucggggacgaguucgggaccuauuucauaagcuggaucagacaagcgcccgggcaagggcucgagugggugggcgggaucgugccccauagccagcuccagagcucggcccagaaauuucacgggcgaauaaccauaagcgcaggcgcgggcgugaccccgcccguggucucgcuccagcucacgaacuugaccuucgaagauaccgggaccuauuucugugccagggaaaggggcaggcacagggacccgaaaacgggcgacgccuugcgcgggcgcuauuucgauuucuggggcagaggcacgggcgugcgcgugagcacg

SEQ ID NO: 57980 - RNA, 396 nt, Artificial Sequence
  derived and/or modified sequence opt11 from anti-HIV_Chain
caagugcaacugguccagagcggggccgcgguaaagagcccgggcucgagcgcgaaauugagcuguaccgugcucggggacgaguucgggaccuauuucauaagcuggaucaggcaagcgcccgggcaagggcucgagugggugggcgggaucgugccccauagccagcuacagagcucggcccagcgcuuucacgggcgcauaaccauaagugcgggcgcgggcgugacaccgccaguggucucgcuccagcucacgaaccugaccuuugacgaugccgggaccuauuucugugccagggaaaggggcaggcacagagacccaaaaacgggcgaugcccugcgcgggcgcuauuucgauuucuggggcaggggcacgggcauaagcgugagcccg

SEQ ID NO: 57981 - RNA, 396 nt, Artificial Sequence
  derived and/or modified sequence opt11 from anti-HIV_Chain
gaagugcaauugguccagagcggggccgaggucaagaaaccgggcgcgagcgugaaagugagcuguaaagugagcggguacacgcucacggaauugagcauacacugggucaggcaagcgcccgggaaagggcucgaguggaugggcggguucgaccccgaggacgaugaagcgaucuaugaaccgaaauuucaagggcgacugaccaugaccgaggacacgagcacggacacagccuauauggagcucucgagcuugcgcucggaagauaccgcggucuauuacugugccacggccgaucccuuuaaaguggcccaggacgagggcuuguacgugaucuuugacuauugggggcaagggaccuuggucacggucucgagcgcgagcacgaaaggg

SEQ ID NO: 57982 - RNA, 396 nt, Artificial Sequence
  derived and/or modified sequence opt11 from anti-HIV_Chain
gagguccagcucguggaaucgggcgggggccugcuccagcccgggggcucgcucaggcucucgugcgcggcaucgggcuuuagcuuuaacgauuucgagaugaauugggugcgacaggccccgggcaagggcuuggaaugggucucguacauaagcaaugacgggaccaugauccauuacgcggacucggucaagggcagguucacgaucucgcgcgauaacgcgaaaaagagcuuguucuugcaaaugaacucgcucagggccgaggacacggccguguacuauugcgcgcgcuuggccgaggucccgcccgcgaucaggggcucguacuauuacgggauggaugucuggggacagggcacgaccgugaccguggccucggcaucgaccaagggc

SEQ ID NO: 57983 - RNA, 396 nt, Artificial Sequence
  derived and/or modified sequence opt11 from anti-HIV_Chain
caagugcaauugaugcagagcggggccgaggucaagcgcccgggcgcgagcgugaaagugagcuguaaagcguucaggcacucgcucaauaacuugggcauaagcuggaucaggcgcgcgcccgggcgcgggcucgagugguuaggcuggaucaaugucuaugaagggaacacgaaauauggcaggcgcuuucaagggcgcgugaccaugaccacggacaggagcacgaacacggucucgauggagcucaggagcuugaccucggacgauaccgcggucuauuacugugccagggacaaucauuuuuggucgggcucgagcagguacuauuacuuuggcauggacgugugggggcaagggaccacggucauagucucgagcgcgagcacgaaaggg

SEQ ID NO: 57984 - RNA, 396 nt, Artificial Sequence
  derived and/or modified sequence opt11 from anti-HIV_Chain
caagugcaauugguccaguggggcgccgggcucuugaaaccgcucgagaccuugagcuugaccugugccguguacggcgggucguucaauggguauuucuggagcuggaucaggcaaacgcccgggaaagggcucgaguggauaggcgagaucaaucacgggggcucggcaaauuucaaucccucgcucaagagcagggucacgaugucagucgauaccucgaaaaaucaauuuagcuugaaauuggccucggucacggccgcggacacggccauauacuauugcgcgcgcgggcgaauaaccauggucaggggcgauccccagcgcgggggcgugcgcauggacgugugggggcaagggaccucggucacggucucgagcgcgagcacgaaaggg

SEQ ID NO: 57985 - RNA, 396 nt, Artificial Sequence
  derived and/or modified sequence opt11 from anti-HIV_Chain
cuagugcaacugguccagagcggggccgaggucaagaaaccgggcgcgagcgugaaagugagcuguaaagugagcgggcacacgcucucggaauugagcauaaacugggucaggcacgugcccgggaaagggcuagaguggaugggcgggcucgauccagaggacggggaagcgauccaugaaccgaaauuucaagggcgcuugaccaugaccgaggacacgagcacggacacggccuauagcacgcucucggucugggccccggucgcggccgcgauguauuacugugccacggccgaucccuuuaaaguggcccaggacgagggcuuguacgugaucuuugacuauugggggcaagggacccuggucacggucucgagcgcgagcacgaaaggg

SEQ ID NO: 57986 - RNA, 396 nt, Artificial Sequence
  derived and/or modified sequence opt11 from anti-HIV_Chain
caagugcaacugcuccagagcgggggcgaggucaagaaaccgggcgcgagcgugaaagugagcuguaaagugagcggguacacgcucacggaauugagcauacacugggucaggcaagcgcccgggaaagggcucgaguggaugggcggguucgaucccgaggacgaugaagcgaucuaugaaccgaaauuucaagggcgcuugaccaugaccgaggacacgagcacggacacggccuauauggagcucucgagcuugcgcucggaagauaccgcgguauauuacugugccacggccgaucccuuuaaaguggcccaggacgagggcuuguacgugaucuuugacuauugggggcaagggaccuuggucacggucucgagcgcgagcacgaaaggg

SEQ ID NO: 57987 - RNA, 396 nt, Artificial Sequence
  derived and/or modified sequence opt11 from anti-HIV_Chain
caagugcaauugguccagagcggggccgaggucaagaaaccgggcgcgagcgugaaagugagcuguaaagugagcggguacacgcucacggaauugagcauacacuggguaaggcaagcgcccgggaaagggcucgaguggaugggcggguucgauagcgaggacggggaagcguucuauaaacagaacuuucaagggcgcgugaccaugaccgaggacacgagcacggacacggccuauauggagcucaggcgcuugcgcucggaagauaccgcggucuauuacugugccacggccgaucgcuuuaaaguggcccaggacgagggcuuguucgugaucuuugacuacugggggcaagggaccuuggucacggucucgagcgcgagcacgaaaggg

SEQ ID NO: 57988 - RNA, 396 nt, Artificial Sequence
  derived and/or modified sequence opt11 from anti-HIV_Chain
caaguccaccucguccaauccggcgccgaagucaaaaaacccggcgccuccguccgcguauccugcaaagccuccggcuacaccuucaccaccuacggcaucucauggguccgccaagcccccggccaaggccucgaauggaugggcuggaucuccgcccacucaggcgacaccaacuacgcccaaaaacuccaagcccgcgucaccaugaccaccgacaccuccaccaacaccgccuacauggaacuccgcucccucacauccgacgacaccgccgucuacuacugcgcccgcgaccgcccccgccacuacuacgaccgaggcggcuacuacucccccuucgacuacuggggccaaggcacccucgucaccgucuccuccgccucaaccaaaggc

SEQ ID NO: 57989 - RNA, 396 nt, Artificial Sequence
  derived and/or modified sequence opt11 from anti-HIV_Chain
cucguccaacuccuccaaucaggcgccgaagucaaaaaacccggcgccuccgucaaagucuccugcaaagucuccggcuacacccucaccgaacucuccauccacuggguccgccaagcccccggcaaaggccucgaauggaugggcggcuucgaccccgaagacgacgaagccaucuacgaacccaaauuccaaggccgccucaccaugaccgaagacaccuccaccgacaccgccuacauggaacucuccucccuccgauccgaagacaccgccgucuacuacugcgccaccgccgaccccuucaaagucgcccaagacgaaggccucuacgucaucuucgacuacuggggccaaggcacccucgucaccgucuccuccgccuccaccaaaggc

SEQ ID NO: 57990 - RNA, 396 nt, Artificial Sequence
  derived and/or modified sequence opt11 from anti-HIV_Chain
caagugcaauugguccagagcggggccgaggucaagaaaccgggcgcgagcgugaaagugagcuguaaagugagcgggcacacgcucucggaauugagcauaaacugggucaggcacgugcccgggaaagggcucgaguggaugggcgggcuagaucccgaggacggggaagcgauccaugaaccgaaauuucaagggcgcuugaccaugaccgaggacacgagcacggacacggccuaugucgagcucucgagcuugcgcucagaagauaccgcgauguauuacugugccacggccgaucccuuuaaaguggcccaggacgagggcuuguacgugaucuuugacuauugggggcaagggaccuuggucacggucucaagcgcgaguacgaaaggg

SEQ ID NO: 57991 - RNA, 396 nt, Artificial Sequence
  derived and/or modified sequence opt11 from anti-HIV_Chain
caagugcaacugcuccagagcggggccgaggucaagaaaccgggcgcgagcgugaaagugagcuguaaagugagcggguacacgcuaacggaauugagcauaaacugggucaggcaagcgcccgggaaagggcucgaguggaugggcggguucgaucccgaggacgaugaagcgaucuaugaaccgaaauuucaagggcgcuugaccaugaccgaggacacgagcacggacacggccuauauggagcucucgagcuugcgcucggaagauaccgcggucuauuacugugccacggccgaucccuuuaaaguggcccaggacgagggcuuguacgugaucuucgacuauugggggcaagggaccuuggucacggucucgagcgcgagcacgaaaggg

SEQ ID NO: 57992 - RNA, 396 nt, Artificial Sequence
  derived and/or modified sequence opt11 from anti-HIV_Chain
caaccccaacuaguacaauccggcuccggcgccgaagucaaaaaacccggcgccuccguccgcaucuccugcgaagccuccgaauacaacgucuucgaccacuucaugcaauggguccgccaagcccccggccaaggccucgaauggaugggcuggaucaacccccgcggcggcuaccccuccuacucccccaccuuccaaggccgccuaaccuucacccgccaacccucaugggacgacuccaccaucaccuuccacauggaacuccgcggacucggccacgacgacaccgccgucuacuacugcgcccgcccccacucccccgacgacgccuggucccucgacgucuggggccgcggcacccucgucaccgucuccuccgccuccaccaaaggc

SEQ ID NO: 57993 - RNA, 396 nt, Artificial Sequence
  derived and/or modified sequence opt11 from anti-HIV_Chain
caaccccaacucguacaauccggcuccggcgccgaagucaaaaaacccggcgccuccguccgaaucuccugcgaagccuccgaauacaacgucuucgaccacuucaugcaauggguccgccaagcccccggccaaggccucgaauggaugggcuggaucaacccccgcggcggcuaccccuccuacuccccccgcuuccaaggccgccucaccuucacccgccaacccuccugggacgacuccuccgucaccuuccacauggaacuccgcggacuccgacacgacgacaccgccgucuacuacugcgcccgcccccacucacccgacgacgccuggucccucgacgucuggggccgcggcacccucgucaccgucuccuccgcaucaaccaaaggc

SEQ ID NO: 57994 - RNA, 396 nt, Artificial Sequence
  derived and/or modified sequence opt11 from anti-HIV_Chain
gaagugcaauuggucgagagcgggggcggggucguggaaccgggcgagagcuugcgcuugagcugugccgcgagcggguucacguucaggagcuaugacauguucugggucaggcaagcgaccgggaaaucgcucgagugggugagcgcgaucgggaucgcgggcgauaccuauuacucgggcucggucaagggaagguucacgaucucgcgcgagaacgcgcgcacgagcuuguacuugcaauugagcgggcucagggucgaggacucggccguguacuuuugcgugcgcgggagcccgcccaggaucgcggccacggaauauaacuauuacuauggccuggacgugugggggcaagggaccacggucucgguauuuagcgcgaguacgaaaggg

SEQ ID NO: 57995 - RNA, 396 nt, Artificial Sequence
  derived and/or modified sequence opt11 from anti-HIV_Chain
cagguccagcucgugcaaucgggcgcggaagugaaaaagcccgggagcucggucaaggucucgugcaaggccucgggcgggaccuuuaccacguacgauaucucgugggugcgccaggccccgggccagggccuggaauggaugggcgggauacucccggacuuuggcgcgcccucguacgcgcaaaaguuccaggacagagucacgaucacgaccgaugaaucgagcucgaccgcguacauggaauugaacucgcucaggagcgaggacacggccauauacuauugcgcgcgcgggcgcggggacgauuucuggagcggggaaucacccucgugguauuucgauuacuggggccagggcacgcucgugaccgugagcucggcaucgaccaagggc

SEQ ID NO: 57996 - RNA, 396 nt, Artificial Sequence
  derived and/or modified sequence opt11 from anti-HIV_Chain
cagccccagcucgugcaaucgggcucgggcgcggaagugaaaaagcccggagccucggucaggaucucgugcgaggccucagaauauaacguguucgaucacuuuaugcagugggugcgccaggccccgauggagggccuggaauggaugggguggauaaacccgcgcgggggcuaccccucguacucgcccacguuccagggcaggcucacguucacacgccagcccucgugggaugacucgaccauaaccuuucacauggaauugcgcggacucaggcacgaugacacggccguguacuauugcgcgcgcccgcacucgcccgaugacgcguggucgcucgaugucuggggcaggggcacgcucgugaccgugagcucggccucgaccaagggc

SEQ ID NO: 57997 - RNA, 396 nt, Artificial Sequence
  derived and/or modified sequence opt11 from anti-HIV_Chain
gaagugcgccugcuagagagcgggggcgggcucgugcaaccgggcgggagcuugcgauugagcuguagcgcgagcggguucacguucucgaacucggcccugagcugggucaggcaagcgcccgggaaagggcucgagugggugagcucggucgugagcucgggaggggacacguucuaugccgauagcgugaaagggcgcuuuaccauaagcagggacaauagcaggaacacgcuauaucuucagaugaaaagccugcgcgcggaagauaccgcgcucuauuacugugccaagguccagauccagcaauugaacuuuggcgugaucacggacgcgggcauggacgugugggggaaggggaccacggucauagucucgagcgcgagcacgaaaggg

SEQ ID NO: 57998 - RNA, 396 nt, Artificial Sequence
  derived and/or modified sequence opt11 from anti-HIV_Chain
cagguccagcucguggaaucgggcgggggcgugguccagcccgggcgcucgcucaggcuaucgugcgugggcucgggcuuuaccuuuagcucgagcgggaugcauugggugcgccaggccccgggcaagggcuuggaaugggucgcggucauaagcucggacgggagcgaugaauauuacggggacucagucgagggcagguucacgaucucgcgcgauaacucgaaaaauaccuuguuccugcaacuggacucgcucgaggccgaggacucggccguguacuauugcgcgaaaacgcccccgcacuaugacgcgcucacgggcuaucccucgagcgugcucgaguucuggggcuugggcacgcucgugaccgugagcucagccucgaccaagggc

SEQ ID NO: 57999 - RNA, 396 nt, Artificial Sequence
  derived and/or modified sequence opt11 from anti-HIV_Chain
gagguccagcucgugcaaucgggcgcggaagugaaaaagcccgggagcucggucaaggucucgugcaaggccucgggcgggaccuuuaccacguacgauaucucgugggugcgccaggccccgggccagggcuuggaauggaucgggggcauacucccggacuuuggcgcgcccucguacgcgcaaaaguuccaggacagggucacgaucacgaccgaugaaucgagcaggaccgcauacauggaacugaacucgcucaggagcgaggacacggccauauacuauugcgcgcgagggcgcggggacgauuucuggagcggggaaucgcccucgugguauuucgauuacuggggccagggcacgcaagugaccgugagcucggccucgaccaagggc

SEQ ID NO: 58000 - RNA, 396 nt, Artificial Sequence
  derived and/or modified sequence opt11 from anti-HIV_Chain
caagugcaacugcuccagagcgggaccgaggucaagaaaccggggucgagcgugaaagugagcugucgcgcgagcggguggacgcuagggaacucgcccaauagcgcgaucgggugggugcgccaggccccgggccagggcuuggaauggaucgggcgcauaaucccgauccuggacgugaccaauuacgcgcaaaaguuccagggcagggucacgaucucggccgauaaaucgaccaauaucgcguacauggaaauaagcucgcucgggagcgaggacacggccuuuuacuauugcgcgcgcgugaucacgggcaugaccucgcccugguacuuuuacauggacguguggggcgaagggaccacggucauagucucgagcgcgagcacgaaaggg

SEQ ID NO: 58001 - RNA, 396 nt, Artificial Sequence
  derived and/or modified sequence opt11 from anti-HIV_Chain
caagugcacuugguccagagcggggccgaggucaagaaaccgggcucgagcgugcgcgugagcuguaaagcgagcggguggacguucggggacucggucaauagcgcgaucacgugggugcgccaggccccgggccagggcuuggaauggauggggcgcuuuaucccgaucuugggcuugagcaauuacgcgcaaaaguuccaggacagggucacgaucaaugucgaucgcucgaccaauaccgcguacauggaauugagcgggcucaggagcgaggacacggccguguacuauugcgcgcgcuugaucacgggcaugaacgcgcccugguucuauuacauggacgugugggggaaagggaccacgaucacggucucgagcgcgagcacgaaaggg

SEQ ID NO: 58002 - RNA, 396 nt, Artificial Sequence
  derived and/or modified sequence opt11 from anti-HIV_Chain
caagugcacuugguccagagcggggccgaggccaagcgcccgggcucgagcguacgcgugagcugucgcgcgagcgggggcgauuucucgagcuauaccuugagcugggucaggcaagcgcccgggcaagggcucgagcgcaugggcggggucgugcccaugcuagauaccgugcacuaugcccagaaauuucaagggcgccugaccuugagcguggacgagggcacgagcacggccuauauggagcucucgaguuugcgcucggaagacaccgcgauguauuacuguaccaggggcaggcaaacguucagggccauauggucgggcccgcccguggucuuugacauaugggggcaagggaccuuggucucggucucgagcgcgagcacgaaaggg

SEQ ID NO: 58003 - RNA, 396 nt, Artificial Sequence
  derived and/or modified sequence opt11 from anti-HIV_Chain
caagugcacuugguccagagcggggccgaggccaagcgcccgggcucgagcgugcgcgugagcugucgcgcgagcgggggcgauuucucgagcuauaccuugagcugggucaggcaagcgcccgggcaagggaucgaguggaugggcggggucgugcccaugcucgauaccgugcacuaugcccagaaauuucaagggcgcuugaccuugagcguggacgagggcacgagcacggccuauauggagcucucgagcuugcgcucggaagauaccgcgauguauuacuguaccaggggcaggcaaacguucagggccauauggucgggcccgcccgcggucuuugacauaugggggcaagggaccuuggucauagucucgagcgcgagcacgaaaggg

SEQ ID NO: 58004 - RNA, 396 nt, Artificial Sequence
  derived and/or modified sequence opt11 from anti-HIV_Chain
caaguccaacucguccaauccggcgccgaacucaaaaaacccggcuccuccgucaaagucuccugcaaagccuccggcggcaccuucaacaaccacaccuucaacuggguccgccaagcccccggccaaggccucgaauggaugggccgcaccauccccauccucggcucacgagacuacgccaaaaccuuccaagaccgcgucaccaucaucgcagacaaaucaaccuccaccgucuaccucgaacuccgccgccucaaauccgaagacaccggcgucuacuacugcgccaccuccauguacuacuucgacuccggcggcuacuaccgaaacaccgaccucgacaaauggggccaaggcucccucgucaccgucuccuccgccuccaccaaaggc

SEQ ID NO: 58005 - RNA, 396 nt, Artificial Sequence
  derived and/or modified sequence opt11 from anti-HIV_Chain
caaguguacuugguccagagcgggcccgagcucaagaaaccgggcgcgagcgugaaaauaagcuguaaagcgagcggguacaauuucccgaaauaugccauacacugggucaggcaagcgcccgggcaagggcuccaguggaugggcuggaucaauggcgauaacggggacgcgcgcuauagccagaaauugcaagggcgcgugaccccgagcacggacacgagcgcgagcguggucuauauggagcuaaagcgccugcgcucggaagauaccgcggucuauuacugugccagagccuuguacccgugggagaucgggggcgugcccucgaccaugggcgaugacuauugggggcaagggaccuugaucacgguaucgagcgcgagcacgaaaggg

SEQ ID NO: 58006 - RNA, 396 nt, Artificial Sequence
  derived and/or modified sequence opt11 from anti-HIV_Chain
caaguacaacucguacaaucaggccccgaacucaugaaacccggcuccuccgucaaagucuccugccgcgccuccggcgacaacuuccucaccuccaccuucaacuggcuccgccaagcccccggccaacgccucgaauggaugggccgcuucauccccucccucggacucaucaccuccgcccccaaauucuccgaccgccucaccaucaccgccgaccaagccacccucaccgccuacauggaacucaccggccuaacauccgaagacaccgcccucuacuacugcgcccgcggccucugccgcggcggcaacugccgccucggccccuccggcuggcucgaccccuggggccgcggcacccaagucaccgucuccuccgccuccaccaaaggc

SEQ ID NO: 58007 - RNA, 396 nt, Artificial Sequence
  derived and/or modified sequence opt11 from anti-HIV_Chain
ggcgugcacuuucaagggcacuugguccagagcgggggcggggucaagaaaccgggcucgagcgugaccauaagcugucucgcgagcgaguacacguucacggaauuuaccauacacuggaucaggcaagcgcccgggcaagggcccuugugguugggcuugaucaagcgcucgggcaggcucaugaccucauacagguuccaggacaggcucucgcucaggcgcgaucgcucgaccgggaccguguucauggaacugcgcgggcucaggaucgaugacacggccguguacuauugcgcgcgagauggcuugggcgaggucgcgcccgcguacuuguacgggaucgaugucuggggccagggcucgaccgugaucgugaccucggccucgaccucg

SEQ ID NO: 58008 - RNA, 396 nt, Artificial Sequence
  derived and/or modified sequence opt11 from anti-HIV_Chain
caagugcaauugcuccagagcggggccgaggucaagaaaccgggcgcgagcgugaaagugagcuguaaagugagcggguacacgcucacggaacugagcauacacugggucaggcaagcgcccgggaaagggcucgaguggaugggcggguucgaucccgaggacgaugaagcgaucuaugaaccgaaauuucaagggcgccugaccaugaccgaggacacgagcacagacacggccuauauggagcucucgagccugcgcucggaagauaccgcggucuauuacugugccacggccgaucccuuuaaaguggcccaggacgagggcuuguacgugaucuuugacuauugggggcaagggaccuuggucacagucucgagcgcgagcacgaaaggg

SEQ ID NO: 58009 - RNA, 396 nt, Artificial Sequence
  derived and/or modified sequence opt11 from anti-HIV_Chain
caagugcaauugguccagagcggggccgaggucaagaaaccgggcgcgagcgugaaagugagcuguaaagugagcggguacacgcucacggaauugagcauacacugggucaggcaagcgcccgggaaagggcucgaguggaugggcggguucgaucccgaggacggggaagcgagcuuugaaccgaaauuucaagggcgcuugaccaugaccgaggacacgagcacggacacggccuauauggagcucucgagcuugcgcucggaagauaccgcggucuauuacugugccacggccgaucccuuuaaaguagcccaggacgagggcuuguacgugaucuuugacuauugggggcaagggacccuggucacggucucgagcgcgagcacgaaaggg

SEQ ID NO: 58010 - RNA, 396 nt, Artificial Sequence
  derived and/or modified sequence opt11 from anti-HIV_Chain
ggcgugcacuuucaagggcacuugguccagagcgggggcggggucaagaaaccgggcucaagcgugaccauaagcugucucgcgagcgaguacacguucacggaauuuaccauacacuggaucaggcaagcgcccgggcaagggcccuugugguugggcuugaucaagcgcucgggcaggcucaugaccucguacagguuccaggacaggcucucgcucaggcgcgaucgaucgaccggaaccguguucauggaauugcgcgggcucaggaucgaugacacggccguguacuauugcgcgcgcgauggcuugggcgaggucgcgcccgcguacuuguacgggaucgaugucuggggccagggcacgaccgugaucgugaccucggccucgacaucg

SEQ ID NO: 58011 - RNA, 396 nt, Artificial Sequence
  derived and/or modified sequence opt11 from anti-HIV_Chain
caagugcaauugggcgagagcgggggcgggcucguggaaccgggcgggagcuugcgcuugaguugugccgcgagcggguucuuguucucggacuaucaaaugagcuggaucaggcucgcgcccgggaaagggcucgaguggaucagcuuuauaucgggcuuuggcucggucuauuacgcggacucggucgagggcagguucacgaucucgcgcgauaacgcgcgcaauagcuuguacuugcaaaugaacaaucucagggccgaggacacggccguguacuauugcgcgcgcgcguacgggaccgggaacuggcgcgggcucuauuacuauuacuauggcauggacgugugggggcacgggaccacggucacggucucgagcgcgagcacgaaaggg

SEQ ID NO: 58012 - RNA, 399 nt, Artificial Sequence
  derived and/or modified sequence opt11 from anti-HIV_Chain
caaguccaacucguccaauccggcaccgcccucaaaucccccggcuccuccgccaaacuauccugcaccguccuaggcgacgaauucggcaccuacuucaucuccuggauccgccaagcccccggccaaggccucgaaugggucggcggcaucgucccccacucccaacuccaauccuccgcccaaaaauuccacggccgcaucaucaucuccgccggagccggcgucaccccccccgucgucucccuccaacucaccaaccucaccuucgaagacacaggcaccuacuucugcgcccgagaacgcggccgccaccgcgaccccaaaaccggcgacgcccuccgcggccgcuacuucgacuucuggggacgcggcaccggccuccgcgucuccaccucc

SEQ ID NO: 58013 - RNA, 399 nt, Artificial Sequence
  derived and/or modified sequence opt11 from anti-HIV_Chain
gaagugcaauugguccagagcgggggcgggcucgugaaaccgggcgggagcuugcgcuugagcugugccgcgagcggguucacguucaagaacgcauggaugagcuggguaaggcaagcgcccgggaaagggcucgagugggugggccauaucaagagcaagaccgauggcgggaccauagacuaugccgcgcccgugaaagggcgcuuuaccauaagcagggacgauagcaagaacacgcucuaucuccagaugaauagcuugaaaauagaagauaccgcggucuauuacuguacaacggacauaggcucgggcaggggcugggacuuucacuauuacgauagcaacgacuggggccagggcacgcucgugaccgugagcucagccucgaccaagggc

SEQ ID NO: 58014 - RNA, 399 nt, Artificial Sequence
  derived and/or modified sequence opt11 from anti-HIV_Chain
cagguccagcucguggaaucgggcgggggcgugguccagccagggcgcucgcucaggcucuuuugcgcggccucgggcuuugccuuuaacacguacgggaugcauugggugcgccaggccccgggcaagggcuuggaaugggucgcggucacguggcaugacgggagccagaaauauuacgcggacucggucaagggcagguucacgaucucgcgcgauaacucgaaaaauacccuguacuugcaaaugaacucgcucagggccgaggacacggccauauacuauugcgcgagcgaucaagggggcuuugacgauagcucgggauauuucgcgcccgggggcauggacgugugggggcgcgggaccacggucauagucucgagcgcgcccacgaaaggg

SEQ ID NO: 58015 - RNA, 399 nt, Artificial Sequence
  derived and/or modified sequence opt11 from anti-HIV_Chain
ggcuauagcgagguccagcucgugcaaucgggcccgggcuuggucaagcccucgcaaacgcucucgcucacaugcacggucucgggcgggagcauaagcaauggcgggcacuauuggaauuggauacgccagcacccgggcaagggccuggaauggaucgggcacauauacaauaucgcgaccacguacuauaacccgagcuugaaaucgcgcguaagcauaagcguggacacgagcaagaaccaguucucgcucaagcuaucgagcgugaccgcggccgauaccgcggucuauuacugugccaggggcucgggaagguggacgaucggcgccaggaucuauuucgauaacuggggccagggcgcgcucguggccgugagcucggccucgaccaagggc

SEQ ID NO: 58016 - RNA, 399 nt, Artificial Sequence
  derived and/or modified sequence opt11 from anti-HIV_Chain
caacuacaauugaaagagagcgggcccgggauggugaaaccgagcgagaccuugagcuugaccuguagcgugagcggagccucagucgugagcgcgaacgauuacuggggcuggaucaggcaagcgcccgggaaagggcucgagugcauaggcauaaucuuguacacgggcucgaccuuuuacaaucccucgcuccagagcagggucacgaucucgcgcgaucccucgaaaaaucacgugagcuugacauugaccucagucacggccgcggacucggccguguacuauugcgcgcgcauacccuaucacucggaaucauauuauaacguggucauaggcggguucgaugucuggggccagggaacgcgcgugaccgugagcucggccucgaccaagggc

SEQ ID NO: 58017 - RNA, 399 nt, Artificial Sequence
  derived and/or modified sequence opt11 from anti-HIV_Chain
ugucaagugcaauuggucgagagugggggcggggucgugcaaccaggcaggagcuugcgcuugagcugugucgggagcggguucacguucucgagcucgggcaugcacugggucaggcaagcgcccgggaaagggcuagaguggguggcagugauaucgagcgauggcucggacgaguacuauggcgauagcguggaagggcgcuuuaccauaagcagggacaauagcaagaacacgcucuuucuccagcucgauagccuggaagcggaagauagcgcggucuauuacugugccaagaccccgccccauuacgaugccuugaccggguacccgagcucggucuuggaauuuugggggcucgggaccuugguaacggucucgagcgcgagcacgaaaggg

SEQ ID NO: 58018 - RNA, 399 nt, Artificial Sequence
  derived and/or modified sequence opt11 from anti-HIV_Chain
caggugcagcuggugcagaguggggcggaugugaagaagccgggggcgagugugaaggugaguuguaaggugaguggguauacggugagugagcugagcauacauugggugaggcaggcgccggggaagggguuggaguggauggggggguuugauccggaggaugggaagacggugagugcgcagaauuuucaggggagggugacgaugacggaggauaagaguacggggacggcgaauauggaguugaggagucugaggagugaggauacggcgguguauuauugugcgacgacggugcaguugauaguggauuuuuguaauggggggccguguuauaauuuugaugauugggggcaggggacguuggugacggugaguagugcgaguacgaagggg

SEQ ID NO: 58019 - RNA, 399 nt, Artificial Sequence
  derived and/or modified sequence opt11 from anti-HIV_Chain
ggccucgaccucgaacacgacggccaccacaaagaagaaccccgagccuccgucaccgucuccugcgaagccuccggauacaacuucguaaacuacaucauccacuggguccgacucaccccaggccgcggcuucgaauggaugggcaugaucgacccccgccgcggccgccccuggucagcccaaaaauuccaaggccgccucacccucacccgcgacaucgacuccgaacgccucuacaugcaacucuccggccuccgcggcgacgacaccgccguauacuucugcgcccgccaagaacccgacuuccacgacggacacggacacacccuccgcggcauguucgacagcuggggccaaggcucccccgucucagucuccuccgccuccaccaaaggc

SEQ ID NO: 58020 - RNA, 399 nt, Artificial Sequence
  derived and/or modified sequence opt11 from anti-HIV_Chain
caagugcgacugguccagagcggggcccagcucaagaaaccgggcgcgagcgugaccguaagcugugaagcgagcggguacaauuucgugaacuacaucauaaacugggucaggcaaacacccgggcgcucguucgagugggugggcaugaucgaucccaggcgcgggcgcccguggucggcccagaaauuucaagggcgcuugacccugaccagggacauagacucggaaaagcucuauaugcaucucucgggccugcgcggggacgauaccgcggucuacuacugugccaggcaagacagcgauuuccaugacgggcacgggcacacgcucaggggcauguucgauagcuggggccagggcucgcccgugaccguaagcucggccucgaccaagggc

SEQ ID NO: 58021 - RNA, 399 nt, Artificial Sequence
  derived and/or modified sequence opt11 from anti-HIV_Chain
caagugcgccugagccagagcggggccgcggucgugaaaacgggcgcgagcgugaccauaagcugugaaacggaaggguacacguucguaaacuauaucauacacugggucaggcaaccgcccggacgcggguucgaguggcugggcaugaucgaucccaggaacgggcacccgugguuuggccagcgcuuucgcgggcgcuugagccugcgcagggacaggagcacagaaacggucuuuaugacgcuaucgggcuugacaucggacgauaacgggauauacuucugugccaggaacgagccccaguacuaugacgggagcgggcacucacuaccgggaauguucgauuacuggggccagggcacgcgcguggucgugagcucggccucgaccaagggc

SEQ ID NO: 58022 - RNA, 399 nt, Artificial Sequence
  derived and/or modified sequence opt11 from anti-HIV_Chain
caagugcgcuugagccagagcggggccgcggucaugaaaacgggcgcgagcgugaccauaagcugugaaacggaaggguacaauuucgugaacuauaucauacacugggucaggcgcccgcccgggcgcggauucgagugguugggcaugaucgaucccaagaacgggcacccgugguucgcccaggccgugcgcgggcgccugagccugcgcagggacacguucaaugaaguagucuauaugacgcucucgggcuugacaucggacgauaccgggcucuauuucugugccaggaacgagccccaguaccaugacggaaacgggcacucgcucccgggcauguucgauuucuggggccagggcacgcucgugaccgugagcucggccucgaccaagggc

SEQ ID NO: 58023 - RNA, 399 nt, Artificial Sequence
  derived and/or modified sequence opt11 from anti-HIV_Chain
caagugcgccugagccagagcggggcagcggucgugaaaacgggcgcgagcgugaccauaagcugugaaacggaaggguacacguucgugaacuauaucauacacugggucaggcaaccgcccgggcgcggguucgagugguugggcaugaucgaucccaggaacgggcacccgugguuuggccagcgcuugcaagggcgccugagccuacgcagggacaggagcacggaaacggucuuuaugacgcucucgggcuugaccucggacgauaccgggaucuauuucugugccaggaacgagccccaguacuacgacgggagcgggcacucgcucccgggcauguucgauuacuggggccagggcacgcgcguggucgugagcucggccucgaccaagggc

SEQ ID NO: 58024 - RNA, 399 nt, Artificial Sequence
  derived and/or modified sequence opt11 from anti-HIV_Chain
caagugcgcuugagccagagcggggccgcggucgugaaaacgggcgcgagcgugaccauaagcugugaaacggaaggguacacguucgugaaccauaucauacacugggucaggcaaccgcccgggcgcggguucgagugguugggcaugaucgaucccagaaacgggcacccgugguuuggccagcgcuugcgcgggcgcuugagcuugcgcagggacaggagcacggaaacggucuuuaugacgcucucgggccugaccucggacgauaucgggaucuauuucugugccaggaacgagccccaguacuuugacgggagcgggcacucgcucccgggcauguucgauuacuggggccagggaacgcgaguggucgugagcucagcaucgaccaagggc

SEQ ID NO: 58025 - RNA, 399 nt, Artificial Sequence
  derived and/or modified sequence opt11 from anti-HIV_Chain
caaguacaauucuuccaauccggcuccuccaugaaaaaauccggcgccuccgucaccaucucaugcgaagccaccggcuacaacaucaaaaaccacauccuccacuggguccgccaaaaacccggccgcggcuucgaaugggucggcaugaucgaccccaucaacggccgccccugguucggccaagccuuccgcggccgccucacccucacccgcgaccucuccaccgaaaccuucuacaugucccucucaggccucaccuccgacgacaccgccaccuacuucugcgcccgccgcgaagccgacuaccacgacggcaacggccacacccuccccggcauguucgacuucuggggccccggcacccucgucaccgucuccuccgccuccaccaaaggc

SEQ ID NO: 58026 - RNA, 399 nt, Artificial Sequence
  derived and/or modified sequence opt11 from anti-HIV_Chain
caagugcgcuugagccagagcggggccgcggucgugaaaacgggcgcgagcgugaccauaagcugugaaacggaaggguacacguucgugaacuauauaauacacugggucaggcaaucgcccggacgcggguucgagugguugggcaugaucgaucccaggaacgggcacccgugguuuggccagcgccugcgcgggcgccugagcuugcgaagggauaggagcacggaaacggucuuuaugacgcucucgggcuugaccucggacgauaccgcgaucuauuucugugccaggaacgagccccaguacuaugacgggagcgggcacucgcucccgggcauguucgauuacuggggccagggcacgcgcguggucgugagcucggccucgaccaagggc

SEQ ID NO: 58027 - RNA, 399 nt, Artificial Sequence
  derived and/or modified sequence opt11 from anti-HIV_Chain
caaguccgccucucccaauccggcgccgccaugaaaaaacccggcgcauccgucaccaucuccugcgaaaccgaaggcuacaccuucaucaacuacaucauccacuggguccgccaaccccccggccgaggcuucgaauggcucggcaugaucgacccccgcaacggccgccccugguucggccaauccguccaaggccgccucucccuccgccgagacacauacaccgaagucgucuacaugacccucuccggccucaccucagacgacgccggccucuacuucugcgcccgcaacgaaccccaauaccacgacggcaacggccacucccuccccggcauguucgacuacuggggccaaggcacccucgucgccgucuccuccgccuccaccaaaggc

SEQ ID NO: 58028 - RNA, 399 nt, Artificial Sequence
  derived and/or modified sequence opt11 from anti-HIV_Chain
caggucaggcucgugcaaucgggcgcgcaauugaaaaagcccggggccucggucacggucucgugcgaggccucgggcuauaacuuugucaauuacauaaucaauugggugcgccagaccccgggcaggggcuuugaaugggucgggaugauagacccgcgcaggggcaggcccuggagcgcgcaaaaguuccagggccggcucacgcuaacgcgcgauaucgauagcgagaaauuguacaugcacuugagcgggcucaggggcgaugacacggccguguacuauugcgcgcgacaggacucggacuuucacgauggccauggccauaccuugcgagggauguuugacucgugggggcaagggagcccggucacggucucgagcgcgagcacgaaaggg

SEQ ID NO: 58029 - RNA, 399 nt, Artificial Sequence
  derived and/or modified sequence opt11 from anti-HIV_Chain
caaguccacaccuuccaauccggcuccuccaugaaaaaauccggcgccuccgucaccaucuccugcgaagccaccggcuacaacaucaaaaacuacauccuccacuggguccgccaaaaacccggccgcggcuucgaaugggucggcaugaucgaccccaucaacggccgccccugguucggccaacccuucagaggccgccucacccucacccgcgaccucuccaccgaaaccuucuacaugucccucuccggccucaccucagacgacaccgccaccuacuucugcgcccgacgcgaagccgacuaccacgacggcaacggccacacccuccccggcauguucgacuucuggggccccggcacccucaucaccgucuccucagccuccaccaaaggc

SEQ ID NO: 58030 - RNA, 399 nt, Artificial Sequence
  derived and/or modified sequence opt11 from anti-HIV_Chain
caaguccgccucuuccaauccggcgccgccaugaaaaaacccggcgccuccgucacaaucuccugcgaagccuccggcuacaacuucaugaacuacuucguccacuggguccgccaacgccccggccgcggcuucgaauggcucggcaugaucaacccccgcggcggccgccccugguccgcccaauccguccaaggccgccucacccucacccgcgacaucuccaccgaaauguucuacaugcgccucgacggccuccgcucagacgacaccgccaccuacuucugcgcccgcaacgaagccgacuaccacgacggcaacggccacucccuccgaggcauguucgacuacuggggccaaggcucccucaucaccgucuccuccgccucaaccaaaggc

SEQ ID NO: 58031 - RNA, 399 nt, Artificial Sequence
  derived and/or modified sequence opt11 from anti-HIV_Chain
caaguccaacucuuccaauccggcgccgccaugcgcaaacccggcgccuccgucaccaucuccugcgaagccuccggcuacaacuucaugaacuacuucguacacuggguccgccaacgccccggccgcggcuucgaauggcucggcaugaucaacccccgcggcggccgcccaugguccgcccaauccguccaaggccgccucacccucacccgagacaccucaaccgaaauguucuacaugcgccucgacggccuccgcuccgacgacaccgccaccuacuucugcgcccgcaacgaagccgacuaccacgacggcaacggacacucccuccgcggcauguucgacuacuggggccaaggcucccucaucaccgucuccuccgccuccaccaaaggc

SEQ ID NO: 58032 - RNA, 399 nt, Artificial Sequence
  derived and/or modified sequence opt11 from anti-HIV_Chain
caagugcgcuugagccagagcggggcagcgaucaagaaaccgggcgcgagcgugaccauaagcugugaaacggaaggguacacguucauaaacuauaucauacacugggucaggcaaccgcccgggcgcggguucgaguggcugggcaugaucgaucccaggaacgggcgcccgugguucggccagagcgugcaagggcgcuugagcuugcgcagggacacguacacggaaguagucuauaugacgcucucgggcuugaccucggacgauaccgggcucuauuucugugccaggaacgagccacaguaccaugacgggaacgggcacucgcucccgggcauguucgacagcuggggccagggcacgcucguggccgugagcucggcaucgaccaaggga

SEQ ID NO: 58033 - RNA, 399 nt, Artificial Sequence
  derived and/or modified sequence opt11 from anti-HIV_Chain
caaguccgacuauuccaaagcggagccgccaugagaaaaccaggcgccagcguaaccaucagcugcgaagcaagcggauacaacuuccuaaacuacuucguacacugggucagacaacgccccggacgcggauucgaauggcuaggcaugaucaacccccgaggcggacgacccuggucagcccaaagcguacaaggccgccuaacccuaacccgcgacaccagcacagaaauguucuacaugagacucgacggccuacgcucagacgacaccgcaaccuacuucugcgccagaaacgaagccgacuaccacgacggaaacggacacucacucagaggcauguucgacuacuggggccaaggcucccucauaaccgucagcucagccucaaccaaaggc

SEQ ID NO: 58034 - RNA, 399 nt, Artificial Sequence
  derived and/or modified sequence opt11 from anti-HIV_Chain
caagugcgccugagccagagcggggccgcggucaagaaaccgggcgcgagcgugaccauagucugugaaacggaaggguacaauuucauagacuauaucauacacugggucaggcaaccgcccgggcgcggguucgagugguugggcaugaucgaucccaggaacgggcgcccguggucgggccagaaaguacacggacgcuugagccuguggagggacacgagcacggaaaaggucuauaugacgcucacgggcuugaccucggacgauaccgggcucuauuucuguggcaggaacgagccccaguaccaugacgauaacgggcacucacucccgggcaugaucgauuacuggggccagggcacgauggugaccgugagcucggccucgaccaagggc

SEQ ID NO: 58035 - RNA, 399 nt, Artificial Sequence
  derived and/or modified sequence opt11 from anti-HIV_Chain
caaguacgccugagccagagcggggccgcgaucaagaaaccgggcgcgagcgugaccauaagcugcgaaacggaaggguacacauucauaaacuauaucauacacugggucaggcaaccgcccgggcgcggauucgaguggcugggcaugaucgaucccaggaacgggcgcccgugguucggccagagcgugcaagggcgccugagcuugcgcagagacacguacacggaaguggucuacaugacgcucucgggccugaccucggacgaugccggacacuacuucugcgccagaaacgagccccaguaccacgacgggaacgggcacucgcucccgggcauguucgacuacuggggccagggcacgcucguggccguaagcucggccucaaccaagggc

SEQ ID NO: 58036 - RNA, 399 nt, Artificial Sequence
  derived and/or modified sequence opt11 from anti-HIV_Chain
caaguccgccucuuccaauccggcgccgccaugcgcaaacccggcgccuccgucaccaucucaugcgaagccuccggauacaacuucaugaacuacuucguccacuggguacgccaacgacccggccgcggcuucgaauggcucggcaugaucaacccccgcggcggccgcccauggucagcccaaucaguccaaggccgccucacccucacccgcgacaccuccaccgaaauguucuacaugcgccucgacggccuccgcucugacgacaccgccaccuacuucugcgcacgcaacgaagccgacuaccacgacggcaacggccacucccuccgcggcauguucgacuacuggggccaaggcucccucaucacagucuccuccgccucaacaaaaggc

SEQ ID NO: 58037 - RNA, 399 nt, Artificial Sequence
  derived and/or modified sequence opt11 from anti-HIV_LightChain
augaaacuccccguccgccuccucguccuuauguucuggauccccgccuccuccuccgacaucgucaugacacaauccccccucucccuccccgucacacccggcgaacccgccuccaucuccugccgcucaucccaacgccuccucuccuccuacggccacaccuaccuccacugguaccuccaaaaacccggccaauccccccaacuacucaucuacgaagucuccaaccgcuucuccggcguccccgaccgcuucuccggcuccggcuccggcaccgacuucacccucaaaaucucccgcgucgaagccgaagacgucggcgucuacuacugcucccaauccacccacgucccccuaaccuucggccaaggcaccaaagucgaaaucaaacgcaaa

SEQ ID NO: 58038 - RNA, 402 nt, Artificial Sequence
  derived and/or modified sequence opt11 from anti-HIV_Chain
cagcccuauaucgugcaaucgggcccggccguaaaaggggccgggagcucggucacggucacgugcaaggucgauggcgaugacgauggaauauucucguucgggaccuauuucaugguaugggucaggcaagcgcccgggcaagggcuccaguacaugggcgggcucgugcccucguacgcgcccacguacgcgcacaaguucgagggcaggaucacgaucucggccgcgggcacgcccccggucgugagcuugaccuugcucaaucucacgaacgacgacgcggccacguacuuuugcgcgcgcgagcgcgggcgccauuacgauagcaagaccagggaaaaucgcaggggcagguacuuugacaugugggggcgcgggaccaggaucacggucucgccc

SEQ ID NO: 58039 - RNA, 402 nt, Artificial Sequence
  derived and/or modified sequence opt11 from anti-HIV_Chain
cagcccuauaucgugcaaucgggcccggccgugaaaggggccgggagcucggucacgguaacgugcagggucgauggcgaugacgauggcauauucaauuucgggaccuauuucauggucugggucaggcaagcgcccgggcaagggcuccaguacaugggcgggcucgugccaucguacgcgccaacguacgcgcacaaguucgagggcaggaucacgaucucggccgcgggcacgcccccggucgugagcuugacccugaucaaccucacgaacgcggacgcggccacguacuuuugcgcgcgagagcgcgggcgccauuacgauagcaagaccagggaaaaucgcagaggcagguacuuugacaugugggggcgcgggaccaggaucacggucucgccc

SEQ ID NO: 58040 - RNA, 402 nt, Artificial Sequence
  derived and/or modified sequence opt11 from anti-HIV_Chain
cgcguccacucccaaguccaacucgucgaauccggccccggccucgucaaaccaucccaaacccucucccuaaccugcaccgucucaggcggcuccaucuccaacggcggccacuacuggaacuggauccgacaacaccccggcaaaggccucgaauggaucggccacaucuacaacaucgcaaccaccuacuacaaccccucccucaaaucccgcgucuccaucuccgucgacaccuccaaaaaccaauucucccucaaacucuccuccgucaccgccgccgacaccgccgucuacuacugcgcccgcggcuccggccgcuggaccaucggcgcccgcaucuacuucgacaacuggggccaaggcgcccucgucgccgucuccuccgccuccaccaaaggc

SEQ ID NO: 58041 - RNA, 402 nt, Artificial Sequence
  derived and/or modified sequence opt11 from anti-HIV_Chain
agcguggacgagcgauugcucgaguucgggggcaggcucgugcaaccgggcgggagcuugcgcuugagcuguagcgcgagcggguucacguucucgaacucggccaugagcugggucaggcaagcgcccgggaaagggcucgagugggugagcucgaucuugagcucgggagugggcacguucuaugccgauagcgugaaagggcgcuuuaccgugagcagggacaauagcaggaacacacucuaucuccagaugaagucguugcgcgcggaagauaccgcgcuauauuacugugccaagguccagauccagcaauugaacuuuggagugaucacggacgcgggccuggacgugugggggaaagggaccacgcucauagucagcagcgcgagcacaaaaggg

SEQ ID NO: 58042 - RNA, 402 nt, Artificial Sequence
  derived and/or modified sequence opt11 from anti-HIV_Chain
gugcaaucgcaaguguacuugguccagagcgggggcgaggucaagaaaccgggcucaagcgugaaagugagcuguaaagcgagcggggacucguucucgagcucagucauaaccugggucaggcaagcgcccgggcaagggcccgaguggaugggcaggaucauaccagugcucggggucgcggccuaugcccagaacuuuuacgggcgcgugaccauaagcgcggacacgagcucaaacacggccuauauggagcucagcucauugcgcuuugaagauaccgcgguauuuuacugugccagggaaacggguaggggcgggaacuuggccuugcgacaguacuuuuucgauagcuggggccagggcacgcucgugaccgugagcucgcccucgaccaagggc

SEQ ID NO: 58043 - RNA, 402 nt, Artificial Sequence
  derived and/or modified sequence opt11 from anti-HIV_Chain
caacuccaacuccaagaauccggccccggccucgucaaacccuccgaaacccuaucccuaaccugcuccgucuccgacggcuccaucaacuccaacuccuacuacugggccuggauccgccaaucccccggcaaaggccucgaauggaucggcuccgucuacuacuucgguggcacauacuacucccccucccucaaaucccgcgucaccauguccgucgaccgcuccaaaaaccaauucucccucaacgucucauccgucaccgccgccgacaccgccaucuacuacugcgcccgccacguccgccccuacgaccgcucaggcuaccccgaacgccccaacugguucgaccccuggggccgcggcacccucgucaccgucuccuccgccuccaccaaaggc

SEQ ID NO: 58044 - RNA, 402 nt, Artificial Sequence
  derived and/or modified sequence opt11 from anti-HIV_Chain
caaguccaacuccaccaauggggcgccggccuccucaaacccuccgacacccucucccucaccugcggcauccucggcgucucaccccccggcucccucaccggcuacuacuggacauggauccgccaaccccccggcaaaggccuagaauggaucggcgaagucuaccacuccggcuccaccaacuacaaccccucccucgccucccgcgucaccaucuccaugggcaccaccaaaacccaauucucccuucgccuaaccucagucaccgccgccgacucagccguauacuacugcgccuccggcaaagucuggggcaucaccgcccgcccccgcgacgccggccucgacgucuggggccaaggcaccaccgucaccgucaccuccgccuccaccaaaggc

SEQ ID NO: 58045 - RNA, 402 nt, Artificial Sequence
  derived and/or modified sequence opt11 from anti-HIV_Chain
caagugcaauugguccagagcggggccgaggucaagaaaccgggaucgagcgugaaagugagcugucgcgcgagcgggggcucguucgggaacuaugccauaaacugggucaggcaagcgcccaugcaagggcucgaguggaugggcgggaucauacccauauucgggaccacgaacuaugcccagaacuuucgcgggcgcgugaccauaaacgcggacacguucacgaacacggucaauauggaucucucgagcuugcgcucggaagauaccgcggucuauuacuguggcagaagcauaaacgcggccgugcccgggcucgagggcguguacuauuacuauggcauggccgugugggggcaagggaccacggucacggucucgagcgcgagcacgaaaggg

SEQ ID NO: 58046 - RNA, 402 nt, Artificial Sequence
  derived and/or modified sequence opt11 from anti-HIV_Chain
uucgugcaacuggucgagagcgggggcgggcuagugcaaccgggcgggagcuugcgcuugagcugugccgcgagcggguucaauuucaauacauauuggaugaacugggucaggcaagcgcccgggaaagggcuagaguggguggccaauaugaaggaagauggcucggaaaaguacuaugucgauagcgugaaagggcgcuuuaccauaagcagggacaaugccaagaacucacucuaucuacagaugaauagcuugcgagcggaagauaccgcagucuauuacugugccaggaacccggaaucgcgcuguaucgugggcaggaacaggggcuggugcagguacuuugaccugugggggcgcgggagcuuggucacggucucgcccgcgagcacgaaaggg

SEQ ID NO: 58047 - RNA, 405 nt, Artificial Sequence
  derived and/or modified sequence opt11 from anti-HIV_Chain
caacuccaacucgaccaacccggcgccgccaugaaaucccucggcuccucccucaccaucaccugccgcgucuccggcgacgaccucggcuccuuccacuucggcaccuacuucaugaucuggguccgccaaggccccggccaaggccucgaauacaugggcggcauccuccccuccaccaaaacccccaccuacgcccacaaauuccgcggccgcgucuccaucuccgcacccggcgucccccccguccuaucccucgcccucacaaaccucaccuacgacgacaccgccaccuacuucugcgcccgcgaacgcggccgccacuucgaacccaaaaaccgcgaccaccucgaaggcaaauuccucgaccucuggggccgcggcaccuucguccgcgucuccccc

SEQ ID NO: 58048 - RNA, 405 nt, Artificial Sequence
  derived and/or modified sequence opt11 from anti-HIV_Chain
caaguccaacucguccaacccggcacagcaaugaaaucccucggcuccucccucaccaucaccugccgcgucuccggcgacgaccucggcuccuuccacuucggcaccuacuucaugaucuggguccgccaagcccccggccaaggccucgaauacaugggaggcauccuccccuccaccaaaacccccaccuacgcccacaaauuccgcggccgcgucuccaucuccgcccccggcgucccccccguccucucccucgcacucaccaaccucaccuacgacgacaccgccaccuacuucugcgcccgcgaacgcggccgccacuucgaacccaaaaaccgagacaaccucgaaggcaaauucuucgaccucuggggccgcggcaccuucguccgcgucuccccc

SEQ ID NO: 58049 - RNA, 405 nt, Artificial Sequence
  derived and/or modified sequence opt11 from anti-HIV_Chain
caaguccaacucguccaacccggcaccgccaugaaaacacucggcuccucccucaccaucuccugccgcgucuccggcgacgacggcaacuuccacuucggcaccuacuucauggccuggguccgacaaguccccggccaaggccucgaauacaugggcggcauccuccccuccaccaaaucccccaccuacgcccacaaauuccgaggccgcgucuccaucuccaccgccggcgucccccccgucgucucccucgcccucaccaaccuaaccuacgacgacaccgccaccuacuucugcgcccgcgaacgcggccgccacuacgacuccaaaaaacaagaaaacuaccgcggcaaauucuucgaccucuggggccgcggcaccuggguccgcgucucccccacc

SEQ ID NO: 58050 - RNA, 405 nt, Artificial Sequence
  derived and/or modified sequence opt11 from anti-HIV_Chain
caccucguccaauccggcaccgaagucaaaaaacccggcucauccgucaccgucuccugcaaagccuacggcgucaacaccuucggccucuacgccgucaacuggguccgccaagcccccggccaaucccucgaauacaucggccaaaucuggcgcuggaaauccucagccucccaccacuuccgcggccgcguccucaucuccgccgucgaccucaccggcuccuccccccccaucuccucccucgaaaucaaaaaccucaccuccgacgacaccgccgucuacuucugcaccaccaccuccaccuacgaccaaugguccggccuccaccacgacggcgucauggccuucuccuccuggggccaaggcacccuaaucuccgucuccgccgccuccaccaaaggc

SEQ ID NO: 58051 - RNA, 405 nt, Artificial Sequence
  derived and/or modified sequence opt11 from anti-HIV_Chain
cagguccagcucgugcaaucgggcgcggaagugaaaaagcccgggagcucggucaaggucucgugcaaggccucgggcgggaccuuuagcacguacgcguucucgugggugcgccaggccccgaucgagggcuuggaauggaugggcgggauaaucccgaucuuuggcacggaaaauuacgcgcaaaaguuccagggcagggucacgaucacggccgauaaaucgaccucgaccgcguacauggaauugagcucucucagaagcgaggacacggccguauacuauugcgcgcgcgaucgcucgagcgcgaucggguacuguagcucgaucucgugcuauaaagggagcuuugacauaugggggcaagggacaauggucacagucucaagcgcgagcacgaaaggg

SEQ ID NO: 58052 - RNA, 405 nt, Artificial Sequence
  derived and/or modified sequence opt11 from anti-HIV_Chain
caagugcaacugguccagagcggggcagaagucaagaaaccgggcucgagcgugaaagugagcugcaaagcgagcgggggcacguucucgaccuaugccuucagcugggucaggcaagcgcccgggcaagggcucgaguggaugggcgggaucauaccaauauucgggaccgagaacuaugcccagaaauuucaagggcgcgugaccauaaccgcagacaagagcacgagcacggccuauauggagcucucgagccugcgcucggaagacaccgcagucuauuacugugccagagacaggagcucggccauaggcuauugcucgagcauaagcuguuacaaaggcucguucgauaucuggggccagggcacgauggugaccgugagcucggccucgaccaagggc

SEQ ID NO: 58053 - RNA, 405 nt, Artificial Sequence
  derived and/or modified sequence opt11 from anti-HIV_Chain
gaaguccaacucgucgaauccggcggcggccucguccaacccggcggcucccuccgccucuccugcgccgccuccggcuucaccuucuccuccuacuccaugaacuggguccgccaagcccccggcaaaggccucgaaugggucuccuacaucuccggcuccuccuacaccaucuacuacgccgacuccguccgcggccgcuucaccaucucccgcgacaacgccaaaaacucccucuaccuccaaaugaacucccuccgcgacgaagacaccgccgucuacuucugcgcccgagccaccccccccaacccccucaaccucuacaacuacgacuccuccggcuccuccuucgacuacuggggccaaggcacccuagucaccgucuccuccgccucaaccaaaggc

SEQ ID NO: 58054 - RNA, 405 nt, Artificial Sequence
  derived and/or modified sequence opt11 from anti-HIV_Chain
gagguccagcucgugcaaucgggcgcggaagugaaaaagcccgggagcucggucaaggucucgugcaaggccucgggcgggaccuuuagcacguacgcguucucgugggugcgccaggccccgggccagggcuuggaauggaugggcgggauaaucccgaucuuuggcacagaaaauuacgcgcaaaaguuccagggcagggucacgaucacggccgauaaaucgaccucgaccgcguacauggaacugagcucgcucaggagcgaggacacggccguguacuauugcgcgcgcgaucgcucgagcgcgaucggguacuguagcucgaucucaugcuauaaagggagcuuugacauaugggggcaagggaccauggucacggucucgagcgcgagcacgaaaggg

SEQ ID NO: 58055 - RNA, 405 nt, Artificial Sequence
  derived and/or modified sequence opt11 from anti-HIV_Chain
gagguccagcucguggaaucgggcgcggaagugaaaaagcccgggagcucggucaaggucucgugcaaggccucgggcgggaccuuuagcacguacgcguucucgugggugcgccaggccccgggccagggcuuggaauggaugggcgggauaaucccgaucuuuggcacggaaaauuacgcgcaaaaguuccagggcagggucacgaucacggccgauaaaucgaccucgaccgcguacauggaauugagcucgcucaggagcgaggacacggccguguacuacugcgcgcgcgaucgcucgagcgcgaucggauacuguagcucgaucucgugcuauaaagggagcuuugacauaugggggcaagggaccauggucacggucucgagcgcgagcacgaaaggg

SEQ ID NO: 58056 - RNA, 405 nt, Artificial Sequence
  derived and/or modified sequence opt11 from anti-HIV_Chain
cccuugguccagcucgagcccucgggcguggaagugaaaaagcgcggggccucggucaaggucucgugcaaggucucgggcuauagcuugaccgagcucucgaugcauugggugcgccaggccccgggcaagggccuggaauggauggggagcuuugacccgcucgauggcgauaccauauacgcgcaaaaguuccagggcagggucacgaugacggucgauaccucgaccgauaccgcguacauggacuugagcucgcucagguucgaggacacggccguguacuauugcgcgaccccgagcaaggccuauuacuaugacucgcccaauuacgagggcgauuucuauauggaugucuggggcaagggcacgaccgugaucgugagcucggccucgaccaagggc

SEQ ID NO: 58057 - RNA, 408 nt, Artificial Sequence
  derived and/or modified sequence opt11 from anti-HIV_HeavyChain
cagauccaucucgugcaaucgggcacggaagugaaaaagcccgggagcucggucacggucucgugcaaggccuauggcguaaacacguucgggcucuaugccgugaacugggucaggcaagcgcccgggcaaucgcucgaguacauuggccagaucuggcgauggaaaucgagcgcgagccaucacuuucgcgggcgcgugcucauaagcgcggucgaucucacgggcucgagcccgcccauaagcucgcucgagaucaagcucacgagcgaugacacagccguguacuuuugcacgaccacgagcacguacgauaaauggagcgggcuccaucacgauggcgugauggcguucucgagcaggggccagggcacgcucauaagcgugagcgcggccucgaccaagggc

SEQ ID NO: 58058 - RNA, 408 nt, Artificial Sequence
  derived and/or modified sequence opt11 from anti-HIV_HeavyChain
cagauccaucucgugcaaucgggcacggaagugaaaaagccagggagcucggucacggucucgugcaaggccuauggcgugaacacguucgggcucuaugccgugaacugggucaggcaagcgcccgggcaagggcucgaguacauaggccagaucuggcgcuggaaaucgagcgcgagccaucacuuuagagggcgcgugcucauaagcgcggucgaucucacgggcucgagcccgcccauaagcucgcucgagaucaaggucacgagcgaugacacggccguguacuuuugcacgaccacgagcacguacgaugaauggagcgaucuccaucacgauggcgugauggcguucucgagcuggggccagggcacgcucauaagcgugagcgcggccucgaccaagggc

SEQ ID NO: 58059 - RNA, 408 nt, Artificial Sequence
  derived and/or modified sequence opt11 from anti-HIV_HeavyChain
cagauccaucucgugcaaucgggcacggaagugaaaaagcccgggagcucggucacggucucgugcaaggccuauggcgugaacacguucgggcucuaugccgugaacugggucaggcaagcgcccgggcaaucgcucgaguacauaggccagaucuggcgcuggaaaucgagcgcgagccaucacuuucgcgggcgcgugcucauaagcgcggucgaucucacgggaucgagcccgcccauaagcucgcucgagaucaagcucacgagcgaugacacggccguguacuuuugcacgaccacgagcacguacgaucgcuggagcgggcuccaucacgauggcgugauggcguucucgagcuggggccagggcacgcuaauaagcgugagcgcggccucgaccaagggc

SEQ ID NO: 58060 - RNA, 408 nt, Artificial Sequence
  derived and/or modified sequence opt11 from anti-HIV_Chain
uguaauccgagggugcauagugaggugcagcugguggagaguggggcggaggugaagaagccgggggcgagcgugaagguggcguguaaggugagugggaagaaguugagugauuugaguauacauugggugaggcaggcgccggggaaggggcuggaguggauggggggguuugaugaggaggaugggaagauaagcuaugagaggaaguuucaggggagggugaguaugacggaggauacggcgagggauacggcguuuauggagaugagcagcuugaggagugaugauacggcgguauauuuuugugcggcggcaccgaggcuggauuugggggaguugagcaguggguuucauuuuuggggguuggggacguuggugacggugaguagugcgaguacgaagggg

SEQ ID NO: 58061 - RNA, 408 nt, Artificial Sequence
  derived and/or modified sequence opt11 from anti-HIV_Chain
aucugggccccacucaucgccgucaccuuccuaguccuccacugcgaaucccucggaaccugcugcugcugccaagccuccggcggcaccuucaacaccuucgccaucaacuggguccgccaagcccccggccaaggccuagaaugggucggcggcauaauccccgucuucggcaccgccuccuacgcccaaaaauuccaaggccgcgucaccgucaccaccgacgaaucacgcggcaccgccuacauggaacuaaacucacuccgcuccgaagacaccgccgucuacuacugcgcccgcggccaaaccgaccucaacgacgaccucugguccgacuacuccacccccggcuucgacuacuggggccaaggcacccucgucaccgucuccuccgccuccaccaaaggc

SEQ ID NO: 58062 - RNA, 408 nt, Artificial Sequence
  derived and/or modified sequence opt11 from anti-HIV_Chain
cugcagccgagggugcauagugaggugcaguugguggagaguggggcggaggugaagaagccgggggcgagugugaaggugaguuguaaggugaguggguauacguugagugauuugaguaugcauugggugaggcaggcgccggggaagggguuggaguggauggggggguuugaugaggaggauggggagauaacguaugcgcagaaguuucaggggagggugaguaugacggaggauacgaguagggauacggcguauauggaguugaguaguuugaggagugaggauacggcgguguauuauugugcgacggcgccgaggcuggagcugggggaguugaguaguggguuucauuauuggggguuggggacguuggugacggugaguagugcgaguacgaagggg

SEQ ID NO: 58063 - RNA, 408 nt, Artificial Sequence
  derived and/or modified sequence opt11 from anti-HIV_Chain
cagagccagguccaucuagugcaaucgggcgcggaagugaaaaagcccgggagcucggucaaggucucgugccaggccucgggcgggaccuuuaacacguucgcgaucaauugggugcgccaggccccgggacagggccuggaaugggucgggggcauaaucccggucuuuggcacggccucguacgcgcaaaaguuccagggcagggucacggucacgaccgaugaaucgcgcgggaccgcguacauggaauugaacucgcucaggagcgaggacacggccguguacuauugcgcgcgcgggcaaacggacuugaacgaugacuuguggucggacuauagcacgcccggguucgauuacuggggacagggcacgcucgugaccgugagcucggccucgaccaagggc

SEQ ID NO: 58064 - RNA, 408 nt, Artificial Sequence
  derived and/or modified sequence opt11 from anti-HIV_Chain
ggcuccgaaguccaacucgucgaauccggcgccgaagucaaaaaacgaggcgccuccgucaaagucuccugcaaagucuccggcuacucccucaccgaacucuccaugcacuggguccgccaagcccccggcaaaggccucgaauggaugggcuccuucgacccccucgacggcgacaccaucuacgcccaaaaauuccaaggccgcgucaccaugaccgucgacaccuccaccgacaccgccuacauggaccucuccucccuccgcuucgaagacaccgccgucuacuacugcgccacccccuccaaagccuacuacuacgacucccccaacuacgaaggcgacuucuacauggacgucuggggaaaaggcaccaccgucaucgucuccuccgccuccaccaaaggc

SEQ ID NO: 58065 - RNA, 408 nt, Artificial Sequence
  derived and/or modified sequence opt11 from anti-HIV_Chain
caagugcaauugguacagagcgggggcgaggucaagaaaccgggcgcgagcgugaaagugagcuguaaagugagcggguacucgcucacggaauugagcaugcacugggucagacaagcgcccgggaaagggcucgaguggaugggcguguucgaucccuuggaaggggacggggucuauguccagaaauuucgcgggagagugaucaugaccgaggacacgagcacggacacggccuauauggagcucacgagcuugcgaucggaagauaccgcgaucuauuacugugccacgaaagcgaaagauuacuauuacgagagcucggacuauagcccguacuauuacuauuacauggacgugugggggaaagggaccacggucacggucucgagcgcgagcacgaaaggg

SEQ ID NO: 58066 - RNA, 408 nt, Artificial Sequence
  derived and/or modified sequence opt11 from anti-HIV_Chain
gaagugcaauugguacagagcggggccgaggucaagaaaccgggcgcgagcgugaaagugagcuguaaagugagcggguacacgcucacggaauugagcaugcacugggucaggcaagcgcccgggaaagggcucgaguggaugggcguguucgaccccuuggaaggggacggggucuaugccgagaaauuucgcgggcgcgugaucaugaccgaggacacgagcacggacacgggcuauauggagcuaacgagcuugcgcucggaagauaccgcgaucuauuacugugccacgaaagcgaaagauuacuauuacgagagcucggacuauagcccguacuauuacuauuacauggacgugugggggaaagggaccacggucacggucucgagcgcgagcacgaaaggg

SEQ ID NO: 58067 - RNA, 408 nt, Artificial Sequence
  derived and/or modified sequence opt11 from anti-HIV_Chain
caagugcaauugguccagagcggggccgaggucaagaaaccgggcgcgagcgugaaagugagcuguaaagcgagcggguacacguucacgcgauaucacauacacugggucaggcacgcgcccgggcaagggcuagaguggaugggcaagaucaaucccucgcgcgcgagcacgaaauaugcaaagaaauuucaagaucgcgugaccaugaccagggacacgagcacgagcacggucuauauggagcuaucgagcuugcgcggggacgauaccgcggucuauuacuguggcagggaaaugggaacguucacgcuccugggcguggucauagaccauuacgauuucuaucccauggacgugugggggcaagggaccccggucacggucucgagcgcgagcacgaaaggg

SEQ ID NO: 58068 - RNA, 408 nt, Artificial Sequence
  derived and/or modified sequence opt11 from anti-HIV_Chain
ucccgcccccccuccugccuccucggcugcuggugcugcuccggcuuccuacuccccgccgucauccuccccaaccuccacucccccugccucucccuccucgaaucccaaccccccucacucgccgaccucgucuccgccuucgccgucauggacauccccaucuacaucggcaccuaccgaucccaagccucccuccacuccuccuccaccaaauuccccaccgacuuccucggcucccaaaccggcuccgucgccgucggccaaggccaaaucucccaccuccgcuccgucgaauggcgccuccgcaugugggaauucaucaccgcccuaaaaguccacauguuccucucccgcuccgaccgcggcccccgcuggaaaaacgucuccucccuccucaacucccgc

SEQ ID NO: 58069 - RNA, 411 nt, Artificial Sequence
  derived and/or modified sequence opt11 from anti-HIV_HeavyChain
caaauccaccucguccaauccggcaccgaagucaaaaaacccggcuccuccgucaccgucuccugcaaagccuacggcgucaacaccuucggccucuacgccgucaacuggguccgccaagcccccggccaaucccucgaauacaucggccaaaucuggcgcuggaaauccuccgccucccaccacuuccgcggccgcgucaucaucuccgccgucgaccucaccggcuccuccccccccaucucaccccucgaaaucaaaaaccucacauccgacgacaccgccgucuacuucugcacaaccaccuccaccuccgaccgaugguccggccuccaccacgacggcgucauggccuucucauccuggggccaaggcacccuaaucuccgucucugccgccuccaccaaaggc

SEQ ID NO: 58070 - RNA, 411 nt, Artificial Sequence
  derived and/or modified sequence opt11 from anti-HIV_HeavyChain
caaauccaccucguccaauccggcaccgaagucaaaaaacccggcuccuccgucaccgucuccugcaaagccuacggcgucaacaccuucggccucuacgccgucaacuggguccgccaagcccccggccaaucccucgaauacaucggccaaaucuggcgcuggaaauccuccgccucccaccacuuccgcggccgcgucaucaucuccgccgucgaccucaccggcucauccccccccaucuccucccucgaaaucaaaaaccucaccucagacgacaccgccgucuacuucugcaccaccgccucuaccuacgacaaaugguccggccuacaccacgacggcgucauggccuucuccuccuggggccaaggcacccucaucuccgucuccgccgccucaaccaaaggc

SEQ ID NO: 58071 - RNA, 411 nt, Artificial Sequence
  derived and/or modified sequence opt11 from anti-HIV_HeavyChain
caaauccaccucguccaauccggcaccgaagucaaaaaacccggcuccuccgucaccgucuccugcaaagccuacggcgucaacaccuucggccucuacgccgucaacuggguccgccaagcacccggccaaucccucgaauacaucggacaaauauggcgcuggaaauccuccgccucccaccacuuccgcggccgcguccucaucucagccgucgaccucaccggccccuccccccccaucuccucccucgaaaucaaaaaccucaccuccgacgacaccgccgucuacuucugcaccacaaccuccaccuacgacaaaugguccggccuccaccacgacggcgucauggccuucuccuccuggggccaaggcacccucaucucagucuccgcagccuccaccaaaggc

SEQ ID NO: 58072 - RNA, 411 nt, Artificial Sequence
  derived and/or modified sequence opt11 from anti-HIV_HeavyChain
caaauccaccucguccaauccggcaccgaagucaaaaaacccggauccuccgucgccgucuccugcaaagccuacggcgucaacaccuucggccucuacgccgucaacuggguccgccaagcccccggccaaucccuagaauacaucggccaaaucuggcgcuggaaauccuccgccucccacgacuuccgcggccgcgucaucaucuccgcagucgaccuaaccggcuccucaccccccaucuccucccucgaaaucaaaaaccucaccuccgacgacaccgccgucuacuucugcaccgccaccuccacccccgacuacugguccggccuacaccacgacggcgucauggccuucuccuccuggggccaaggcacccuaaucuccgucuccgccgccuccaccaaaggc

SEQ ID NO: 58073 - RNA, 411 nt, Artificial Sequence
  derived and/or modified sequence opt11 from anti-HIV_HeavyChain
caaauccaccucguccaaucaggcaccggcgucaaaaaacccggcuccuccgucaccgucuccugcaaggccuacggcgucaacaccuucggccuauacgccgucaacuggguccgccaagcccccggccaaggccucgaauacaucggccaaaucuggcgcuggaaauccuccgccucccaccacuuccgcggccgcguccucaucuccgccgucgaccucaccggcuccuccccccccaucaccucccucgaaaucaaaaacgucaccucagacgacaccgccgucuacuucugcaccaccaccuccaccuacgacaaaugguccggccucuaccacgacggcgucauggccuucuccuccuggggccaaggcacccucaucucaguauccgccgccuccaccaaaggc

SEQ ID NO: 58074 - RNA, 411 nt, Artificial Sequence
  derived and/or modified sequence opt11 from anti-HIV_HeavyChain
caaauccaccucguccaauccggcaccgaagucaaaaaacccggcuccuccgucaccgucuccugcaaagccuacggcgucaacaccuucggccucuacgccgucaacuggguccgccaagccccaggccaaucccucgaauacaucggccaaaucuggcgcuggaaauccuccgccucccaccacuuccgcggccgcgucaucaucuccgccgucgaccucaccggcuccuccccccccaucuccucccucgaaaucaaaaaccucaccuccgacgacaccgccgucuacuucugcaccaccaccuccaccuccgacuacugguccggacuccaccacgacggcgucauggccuucuccuccuggggccaaggcacccucaucuccgucuccgccgccuccaccaaaggc

SEQ ID NO: 58075 - RNA, 411 nt, Artificial Sequence
  derived and/or modified sequence opt11 from anti-HIV_HeavyChain
caaauccaccucguccaauccggcaccgaagucaaaaaacccggcuccuccguaaccgucuccugcaaagcauacggcgucaacaccuucggccucuacgccguaaacuggguccgccaagcccccggccaaucccuagaauacaucggccaaaucuggcgcuggaaauccuccgccucucaccacuuccgcggccgcguccucaucuccgccgucgaccucaccggcuccuccccccccaucuccucccucgaaaucaaaaaccucaccuccgacgacaccgccgucuacuucugcaccaccaccuccaccuacgaccgcugguccggccuacaccacgacggcgucauggccuucucauccuggggccaaggcacccucaucuccgucuccgccgccuccaccaaaggc

SEQ ID NO: 58076 - RNA, 411 nt, Artificial Sequence
  derived and/or modified sequence opt11 from anti-HIV_HeavyChain
caaauccaccucguccaauccggaaccgaaguccgaaaacccggcucaucagucaccgucuccugcaaagccuacggcgucaacaccuucggccucuacgccgucaacuggguccgccaagcccccggccaaucccucgaauacaucggccaaaucuggcgcuggaaauccuccgccucccaccacuuccgcggacgcguccucaucuccgccgucgaccucaccggcuccuccccccccaucuccucccucgaaaucaaaaaccucaccuccgacgacaccgccgucuacuucugcaccaccacauccaccuacgacaaaugguccggccuccaccacgacggcgucauggccuucuccuccuggggccaaggcacccuaaucuccgucuccgccgccuccaccaaaggc

SEQ ID NO: 58077 - RNA, 411 nt, Artificial Sequence
  derived and/or modified sequence opt11 from anti-HIV_HeavyChain
caaauccaccucguccaauccggcaccgaagucaaaaaacccggcuccuccgucaccgucuccugcaaagccuacggcgucaacaccuucggccucuacgccgucaacuggguccgccaagcccccggccaaucccucgaauacaucggccaaaucuggcgauggaaauccuccgcaucccaccacuuccgcggccgcguccucaucuccgccgucgaccucaccggcuccuccccccccaucuccucccuugaaaucaaaaaccucaccuccgacgacaccgccgucuacuucugcaccaccaccuccaccuacgaccaaugguccggccuccaccacgacggcgucauggccuucuccuccuggggccaaggcacccucaucuccgucuccgccgccuccacaaaaggc

SEQ ID NO: 58078 - RNA, 411 nt, Artificial Sequence
  derived and/or modified sequence opt11 from anti-HIV_HeavyChain
caaauccaccucguccaauccggcaccgaagucaaaaaacccggcuccuccguaaccgucuccugcaaagccuacggcgucaacaccuucggacucuacgccgucuccuggguccgccaagcccccggccaacgccucgaauacaucggccaaauccgccgauggaaauccuccgccucccaccacuuccgcggacgcgucaccgucuccgccgucgaccccaccggcuccuccccccccaucuccucccucgaaauccgcgaccucaccaccgacgacaccgccgucuacuucugcaccaccaccuccaccucagacuacugguccggccuccacaacgaacgcggcaccgccuucuccuccuggggccaaggcacccucaucuccgucuccgccgccuccaccaaaggc

SEQ ID NO: 58079 - RNA, 411 nt, Artificial Sequence
  derived and/or modified sequence opt11 from anti-HIV_HeavyChain
caaauccaccucguccaaucaggcaccgaagucaaaaaacccggcuccuccgucaccgucuccugcaaagccuacggcgucaacaccuucggccucuacgccgucaacuggguccgccaagcccccggccaaggccucgaauacaucggccaaaucuggcgcuggaaauccuccgccucccaccacuuccgcggccgcguccuaaucuccgccaucgaccucaccggcuccuccccccccaucuccucccucgaaaucaaaaacgucaccuccgacgacaccgccgucuacuucugcaccaccauguccaccuacgacaaaugguccggccuccaccacgacggcgucauggccuucuccuccuggggccaaggcacccuaaucuccgucuccgccgccuccaccaaaggc

SEQ ID NO: 58080 - RNA, 411 nt, Artificial Sequence
  derived and/or modified sequence opt11 from anti-HIV_HeavyChain
caaauccaccucguccaauccggcaccgaagucaaaaaacccggcuccuccgucaccgucuccugcaaagccuacgaagucaacaccuucggccucuacgccgucaacuggguccgccaagcccccggccaaucccucgaauacaucggccaaaucuggcgcuggaaaucauccgccucccaccacuuccgaggccgcguccucaucuccgccgucgaccucaccggcuccuccccccccaucuccucccuagaaaucaaaaacgucaccucagacgacaccgccgucuacuucugcaccaccaccuccacccacgacaaaugguccggccuccaccacgacggcgucauggccuucuccuccuggggccaaggcacccucaucuccgucuccgccgccuccaccaaaggc

SEQ ID NO: 58081 - RNA, 411 nt, Artificial Sequence
  derived and/or modified sequence opt11 from anti-HIV_HeavyChain
cagauccaucucgugcaaucgggcacggaagugaaaaagcccgggagcucggucacagucucgugcaaggccuauggcgugaacacguucgggcucuaugccgugaacugggucaggcaagcgcccgggcaagggcucgaguacauaggccagaucuggcgcuggaaaucgagcgcgagccaucacuuucgcgggcgcgugcucauaagcgcggucgaucucacgggcucgagcccgcccauaagcucgcucgagaucaagaacgugaccucggacgauaccgcggucuauuucuguaccacgaccucgaccuaugacaaguggucgggcuugcaccaugacggggucguggccuuuagcucgugggggcaagggaccuugaucucggucucggccgcgagcacgaaaggg

SEQ ID NO: 58082 - RNA, 411 nt, Artificial Sequence
  derived and/or modified sequence opt11 from anti-HIV_Chain
caagucacccucguccaauccggcgccgaagucaaaaaacccggcgccuccguccgcaucuccugccgagcauccggcuucaccuucgacgacuacuccgacuacuccuucauacccaccaccuaccucauccacugguuccgccaagcccccggccaaggccucgaauggauggccuggaucaacuccgucaacggcggccgcaacaucgcccgccaauuccaaggccgcgucaccgucgcccgcgaccgcuccaacuccaucgccuuccucgaauucuccggccuccgccacgacgacaccgccgucuacuucugcgcccgcgaccgccgagacgacgaccgcgccuggcuccucgaccccuggggccaaggcacccgcgucaccgucuccuccgccuccaccaaaggc

SEQ ID NO: 58083 - RNA, 411 nt, Artificial Sequence
  derived and/or modified sequence opt11 from anti-HIV_Chain
caaauccaccucguccaauccggcaccgaagucaaaaaacccggcuccuccgucaccgucuccugcaaagccuacggcgucaacaccuucggccucuacgccgucaacuggguccgccaagcccccggccaaucccucgaauacaucggccaaaucuggcgcuggaaauccuccgccucccaccacuuccgcggccgcguccucaucuccgccgucgaccucaccggcuccuccccccccaucuccucccuagaaaucaaaaaccucaccuccgacgacaccgccgucuacuucugcaccaccaccuccaccuacgacaaaugguccggccuccaccacgacggcgucauggccuucuccuccuggggccaaggcacccucaucuccgucuccgccgccuccaccaaaggc

SEQ ID NO: 58084 - RNA, 414 nt, Artificial Sequence
  derived and/or modified sequence opt11 from anti-HIV_Chain
gugguccagcucgugcaaucgggcgcggaagugcgcaagcccgggagcucgcuaaaggucucgugcaagagcucgggcgggaccuuuagcagguucguggucaauugggugcgccaggccccgggccagggcuuggaauggaugggcgggaugaucccgaucuuuggcauagccaaguacgcgcaaaaguuccaggacaggguaacgaugacggccgaugaaucgaaaaauaccguguacuuggacuuuagcucgcuaaggagcgaugacacggccguguacuauugcgcgcgcgaucgcggggacacgcgcuugcuagauuacggggacuaugaagaugaaagguacuauuacgggauggaugucuggggccagggcacgaccgugaucguaagcucggcaucgaccaagggc

SEQ ID NO: 58085 - RNA, 414 nt, Artificial Sequence
  derived and/or modified sequence opt11 from anti-HIV_Chain
caagugcagcuggugcagagcggggcagaggugaggaaaccggggaguagcuugaaagugagcuguaaaucgagcgggggaacguucaguagguuuguggugaacugggugaggcaggcgccggggcaggggcuagaguggaugggagggaugauaccaauauucgggauagcgaaauaugcacagaaauuucaagacagggugacaaugacggcggacgagagcaagaacacgguguaucuggauuucucgagcuugagaagugacgauacagcgguguauuacugugcaagggacaggggagauacaaggcuauuggacuauggggauuacgaggacgagagguauuacuauggaauggacgugugggggcaagggacaacggugauaguaagcagcgcgagcacgaaaggg

SEQ ID NO: 58086 - RNA, 414 nt, Artificial Sequence
  derived and/or modified sequence opt11 from anti-HIV_Chain
gaggugcaguugguggagaguggggcggaggugaggaagccggggucgagucugaaggugaguuguaagaguagcggggggacguuuaguagguuuguggugaauugggugaggcaggcgccggggcagggguuggaguggaugggggggaugauaccgauauuugggauagcgaaguaugcgcagaaguuucaggauagggugacgaugacggcggaugagaguaagaauacgguguauuuggauuuuaguagccugaggagugaugauacggcgguguauuauugugcgagggauaggggggauacgagguuguuggauuauggggauuaugaggaugagagguauuauuaugggauggaugugugggggcaggggacgacggugauagugagcagugcgaguacgaagggg

SEQ ID NO: 58087 - RNA, 414 nt, Artificial Sequence
  derived and/or modified sequence opt11 from anti-HIV_Chain
caagugcaacuggucgagagcggggccgaggucaggaaaccgggcucgagccugaaagugagcuguaaaucgagcgggggcacguucucgcgauaugucgugaacugggucaggcaagcgcccgggcaagggcucgaguggaugggcgggaucauacccauauucgggaucgcgaaauaugcccagaaauuucaagaucgagugaccaugaccgcggacgagcccaagaacacggucuaucucgauuucaauagcuugcgcucggacgauacagcggucuauuacugugccagggacaggggcgauaccaggcucuuggacuauggcgauuacgaggacgagcgcuauuacuacggcauggacgugugggggcaagggaccacgguaauagucucgagcgcgagcacgaaaggg

SEQ ID NO: 58088 - RNA, 414 nt, Artificial Sequence
  derived and/or modified sequence opt11 from anti-HIV_Chain
caagugcaauugguccagagcggggccgaggucaggaaaccgggcucgagcuugaaagugagcuguaaaucgagcgggggcacguucucgcgauaugucgugaacugggucaggcaagcgcccgggcaagggcuagaguggaugggcgggaugauacccauauucgggaucgcgaaauaugcccagaaauuucaagauagagugaccaugaccgcggacgagagcaagaacacggucuaucucgauuucucgagcuugcgaucggacgauacagcggucuauuacugugccagggacaggggcgauaccaggcuacuggacuauggcgauuacgaggacgagcgcuauuacuauggcauggacgugugggggcaagggaccacggucauagucucgagcgcgagcacgaaaggg

SEQ ID NO: 58089 - RNA, 414 nt, Artificial Sequence
  derived and/or modified sequence opt11 from anti-HIV_Chain
caggugcaguuggugcagagcggggcggagguaaggaagccggggaguagcuugaaggugagcuguaagaguagcggggggacguucaguagauauguagugaacugggugaggcaggcgccggggcaggggcuggaguggaugggggggauaauaccgauauucgggauagcgaaguaugcacagaaguuucaggauagggugacgaugacggcggaugagagcaagaacacgguguaucuggauuucaguagcuugaggagugacgauacggcgguguauuacugugcgagggacaggggggauacgaggcuacuggacuauggggauuacgaggacgagagguauuacuaugggauggacgugugggggcaggggacgacggugauagugaguagcgcgagcacgaagggg

SEQ ID NO: 58090 - RNA, 414 nt, Artificial Sequence
  derived and/or modified sequence opt11 from anti-HIV_Chain
caagugcaauuggucgagagcggggccgaggucaggaaaccgggcucgagccugaaagugagcuguaaaucgagcgggggaacguucucgcgcuauguagugaacugggucaggcaagcgcccgggcaagggcucgaguggaugggcgggaucauacccauauucgggaucgcgaaauaugcccagaaauuucaagaucgcgugaccaugaccgcggacgaaagcaagaacacgguauaucucgauuucucgagcuugcgcucggacgauaccgcggucuauuacugugccagggacaggggcgauaccagacucuuggacuauggcgauuacgaggacgagcgcuauuacuauggcauggacgugugggggcaagggaccacgguaauagucucgagcgcgagcacgaaaggg

SEQ ID NO: 58091 - RNA, 414 nt, Artificial Sequence
  derived and/or modified sequence opt11 from anti-HIV_Chain
caagugcaauugguccagagcggggccgaggucaggaaaccgggaucgagcuugaaagugagcuguaaaucgagcgggggcacguucucgcgauaugucgugaacugggucaggcaagcgcccgggcaagggcucgaguggaugggagggaucauaccaauauucgggaucgcgaaauaugcccagaaauuucaagaucgagugaccaugaccgcggacgagccaaagaacacggucuaucucgauuucaauagcuugcgcucggacgauaccgcggucuauuacugugccagggacagaggcgauaccaggcucuuggacuauggagauuacgaggacgagcgcuauuacuauggcauggacgugugggggcaagggaccacggucauaguaucgagcgcgagcacgaaaggg

SEQ ID NO: 58092 - RNA, 414 nt, Artificial Sequence
  derived and/or modified sequence opt11 from anti-HIV_Chain
guggugcagcuggugcagagcggggcagaggugaggaagccggggaguagccugaaggugagcuguaagaguagcggggggacguucaguagguauguagugaacugggugaggcaggcgccggggcaggggcuggaguggaugggggggaugauaccgauauucgggauagcgaaguaugcacagaaguuucaggauagggugacgaugacggcggacgagagcaagaacacgguauauuuggauuuuaguagcuugaggagugacgauacggcgguguauuacugugcgagggacaggggggauacgaggcuguuggacuauggggauuacgaggacgagagguauuauuaugggauggacgugugggggcaggggacgacggugauagugaguagcgcgagcacgaagggg

SEQ ID NO: 58093 - RNA, 414 nt, Artificial Sequence
  derived and/or modified sequence opt11 from anti-HIV_Chain
uucauaugcuuuagcguggucgugcgcuugcucgaguucgggggcaggcucgugcaaccgggcgggagcuugcgauugagcuguagcgcgagcggguucacguucucgaacucggccaugagcugggucaggcaagcgcccgggaaagggcucgagugggugagcucgaucuugagcucgggcgugggcacguucuaugccgauagcgugaaagggcgauuuaccgugagcagggacaauagcagaaacacgcucuaucuccagaugaagucguugcgcgcggaagauaccgcgcuauauuacugugccaagguccagauccagcaacugaacuuuggcgugaucacggacgcgggccuggacgugugggggaaagggaccacgcucauagucagcagcgcgagcacgaaaggg

SEQ ID NO: 58094 - RNA, 414 nt, Artificial Sequence
  derived and/or modified sequence opt11 from anti-HIV_Chain
caagugcaauugguccagagcggggccgaggucaggaaaccaggcucgagcuugaaagugagcuguaaaucgagcgggggcacguucucgcgcuaugucgugaacugggucaggcaagcgcccgggcaagggcuagaguggaugggcgggaucauaccaauauucggaaucgcgaaauaugcacagaaauuucaagaucgagugaccaugaccgcggacgagagcaagaacacggucuaucuagauuucucgagcuugcgaucgggcgauaccgcggucuauuacugugccagggacagaggcgauaccaggcucuuggacuauggcgauuacgaggacgagcgcuauuacuauggcauggacgugugggggcaagggaccacggucacggucucgagcgcgagcacgaaaggg

SEQ ID NO: 58095 - RNA, 417 nt, Artificial Sequence
  derived and/or modified sequence opt11 from anti-HIV_Chain
caaguacaacuggucgagagcggggccgaggucaagaaaccgggcucgagcgugaaagugagcuguaaagcgagcgggggcacguucaauaucuuugccuuuagcugggucaggcaagcgcccgggcaagggcucgaguggaugggcgggaucauacccauauucgcaagcccgaacuaugcccagcgcuuucaagggcgcgugaccauaaccgcggacgagagcacgagcacgguccauauggagcucucgagcuugcgcucggaagauaccgcaaucuacuacugugccaaggacgcgcacaugcacauagaggaacccagggacuaugacuauaucuggggcacaagcccguacuauuucgauuacuggggccagggaacgcucgugaccgugagcucggccucgaccaagggc

SEQ ID NO: 58096 - RNA, 417 nt, Artificial Sequence
  derived and/or modified sequence opt11 from anti-HIV_Chain
cagguccagcucguggaaucgggcgcggaagugaaaaagcccggggccucggucaaggucucgugcaaggccucgggcuauaccuuuaccucgcacgauaucaauugggugcgccaggccacgggccagggcuuggaauggaugggguggaugaacccgaacucgggcgauaccggguacgcgcacaaguuccagggcagggucacgaugacgcgaaauaccccgaucucaaccgcguacauggaacugagcucgcucaggagcgaggacacggccguguacuauugcgcgcgagggcgcgcgaccucgcgcaauaccccgugggcgcacuauuacgauagcucgggcuauuacggggccggggacuauugggggcaagggaccuuggucacagucucgagcgcgagcacgaaaggg

SEQ ID NO: 58097 - RNA, 417 nt, Artificial Sequence
  derived and/or modified sequence opt11 from anti-HIV_Chain
caaguccaaauccgacaauccggccccggccucgucaaaccccucgaaacccucucccucuccugcaucgucuucggcggcuccuucaucgccuaccacuggaccuggauccgccaagccccccucaaaggccucgaauggaucggcgacaucgaccaaggcggcgacaucaccuacucccccucccucaaaucccgcgucaccauguccgucgaccgcuccaaaucccaauucucccucaaacucuccuccgucaccgccgccgacgccgccgucuacuacugcguacgcggcccccccaaccgauacgccgucaccucauucaccuccggcacccaccgcgaacgcuccuccuacuacuucgacuacuggggccccggcacccucgucaccgucuccuccgccuccaccaaaggc

SEQ ID NO: 58098 - RNA, 423 nt, Artificial Sequence
  derived and/or modified sequence opt11 from anti-HIV_Chain
aauggcgggagccugcgauugagcugucgcgugagcggauucggguuccaucucuaugaaaugaacugggucaggcaagcgcccgggaaagggcuagaguggauaagcucgaucucgggcucgggcgagagcacgcacuauagcgauagcauaaccgggcgauuuagcaugagcagggacgaggccaaggacucgcucuaucuccagaugaauaacuugcgcguggaagauaccgcggucuauuacuguacaaggggcuuuagcaugggcgauggcacgggcuuuagcuuugacacgugggggcgagggaccauggucacggucucaagcgggcucgauaccgugagcuuggcaucgaccaagggcccgagcguguucccgcuagcgcccuguagcaggagcacgagcgaugccaggcucuca

SEQ ID NO: 58099 - RNA, 423 nt, Artificial Sequence
  derived and/or modified sequence opt11 from anti-HIV_Chain
cagguccagcucgugcaaucgggcgcggaagugaaaaagcccgggaguucggucaaggucucgugcaaggccucgggcgggaccuuuagcacguacgcgaucucgugggugcgccaggccccgggccagggcuuggaauggaugggcgggauaaucccgagcuuuagcaugagcaauuacgcgcaagauuuccagggcaggcuaacgaucacggccgaugaaucgaccucgagcguguacauggaacugaacucgcucaggagcgaggacacggccguguacuauugcgcgcgagauuucccgcgcuuucacaggcucgugggcaauuacgauuucuggcgcgggaccuuggacagguucucauacauggacuugugggggcgcgggaccgcggucacggucucgagcgcaagcacgaaaggg

SEQ ID NO: 58100 - RNA, 423 nt, Artificial Sequence
  derived and/or modified sequence opt11 from anti-HIV_Chain
cuaguccaacucgucgaauccggcggcggcgucguccaacccggccgcucccuccgccucucaugcgccgccuccggcuucaccuucuccaccuacgccaugcacuggguccgccaagcccccggcaaaggccucgaaugggucgccgucaucuccuacgacggcuccaacaaauucuacgccgacuccgucaaaggccgauucaccaucucccgcgacaacuccaaaaacacccucuaccuccaaaugaacucccuccgcgcagaagacaccgccgucuacuacugcgcccgccccaaauuccuccccggcgccgacaucgucgucgucgucgccgccacccccuucgacuacuggggccaaggcaaccccggccaccgccuacucucauuccaccaaggccccaucggccucccccccggc

SEQ ID NO: 58101 - RNA, 423 nt, Artificial Sequence
  derived and/or modified sequence opt11 from anti-HIV_HeavyChain
auggaauggagcggggucuuuaucuuucucuugagcgugaccgcgggcgugcacucggaagugcaauuggucgagagcgggggcgggcucgugaaaccgggcgggagcuugcgcuugagcugugcagcgagcggguacacguucucgaacuauuggauaggcugggucaggcaagcgcccgggaaagggcuagaguggauaggcgauaucuaucccgggggcaauuacauacgcaauaacgagaaauuuaaagauaaaacgaccuugagcgcggacacgagcaagaacacggccuaucuccagaugaauagccugaaaacggaagauaccgcggucuauuacuguggcucgagcuuuggcucgaacuaugucuuugccugguucacguacuggggccagggcacacucgugaccgugagcucg

SEQ ID NO: 58102 - RNA, 423 nt, Artificial Sequence
  derived and/or modified sequence opt11 from anti-HIV_HeavyChain
auggaaugguccggcgucuucaucuuccuccucuccgucaccgccggcguccacucccaaguccaacucguccaauccggccccgacgucaaaaaaccaggcaccuccaugaaaauguccugcaaaacauccggcuacaccuucuccaacuacuggaucggcuggguccgccaagcccccggccaaggacucgaauggaucggcgacaucuaccccggcggcaacuacauccgcaacaacgaaaaauucaaagacaaaaccacccucaccgccgacaccuccaccuccaccgccuacaugcaacucggcucccuccgcuccgaagacaccgccgucuacuacugcggauccuccuucggcuccaacuacgucuucgccugguucaccuacuggggccaaggcacccucgucaccgucuccuca

SEQ ID NO: 58103 - RNA, 429 nt, Artificial Sequence
  derived and/or modified sequence opt11 from anti-HIV_Chain
caagucuucguccaacuaguccaauccggcggcggccucguccaacccggcggcuccguccgccucuccugcaccgccuccggcuuccucuucuccaccuacuccaugaacuggguccgccaagcccccggcaaaggacucgaaugggucuccuccaucuccaccaccuccaacuacaucuacuacgccgacuccguaaaaggccgcuucaccaucucccgaucaaacggccaaggcucccuauaccuccaacucaacucccuccgcgucgaagacaccgccgucuacuacugcgcccgcgacaccaaaguaggagccccccgccaagacugcuacgccauggaccucuggggccaacgcgaccacggccaccgccuccucuccuuccaccaaggccccaucggccucccccccggcgcccuccuccaa

SEQ ID NO: 58104 - RNA, 432 nt, Artificial Sequence
  derived and/or modified sequence opt11 from anti-HIV_Chain
aucauccucuuccucgucgccaccgccaccggcguccacuccgacauccaaaugacccaaucccccuccucacucuccgcauccgucggcgaccgcgucaccaucaccugccgcgccucccaauccaucgaccgcuaccucaacugguaccaacacaaacccggcaaagcacccaaacuccucaucuacgccgccuccaaccuccacaccgacgucccaucccgcuucucaggcuccggcgccggaaccuacuucacccucaccaucaccucacuccaacccgaagacuucgccaccuacuacugccaacaaucccacucccccuccuucggccaagaauccuacuccaucgccuucggccaaggcacccgccucgaaaucaaacgcaccgucgccgcccccuccgucuucaucuucccccccuccgacgaa

SEQ ID NO: 58105 - RNA, 432 nt, Artificial Sequence
  derived and/or modified sequence opt11 from anti-HIV_Chain
cuccaacaacuccaagucccccgccucuccauguggcgcgucuucaaagucgccgccgccaccggcgcccaaacccucaccgucgaagaacccggcuccucagucaaagucuccugcaaagccucaggcggcuccuccaccgccuacggcuacuccuggguccgccaagcccccggccaaggcuucgaauggaugggccgcaucauccccuucuacggcaucaucaccuacgcccccaaauuccaaggccgcgucaccaucaccgccgaccgauccaccucaaccgucuacauggaacucacaucccucaccuucgccgacaccgcccucuucuucugcgcccgcgacuucggcgacccccgcaacggcuacuacuucgacuccugggaccaaggccucuggcucaccgucuccucugccuccaccaaaggc

SEQ ID NO: 58106 - RNA, 432 nt, Artificial Sequence
  derived and/or modified sequence opt11 from anti-HIV_Chain
caggucaggcucgagcaaucgggcguggccaugcgcaagcccggggccucggucacgcucucgugccaggccucgggcuauaacuucgucaaguacauaauccauugggugcgccagaaaccgggcuugggcuucgaaugggucgggaugauagacccguacaggggcaggcccuggagcgcgcacaaguuccagggccgacucucgcucucgcgcgauaccucgauggagauccuguacaugacccugaccucgcucaagagcgaugacacggccacguacuucugcgcgcgcgcggaagcggccucggacauacacucccgcccgaucauacuaacgggcccgggcgaguacgggcucgaccucgagcacauggacuggaccuggcgcauacucugccuccuggccguggcaccaggcugccacucgcaa

SEQ ID NO: 58107 - RNA, 435 nt, Artificial Sequence
  derived and/or modified sequence opt11 from anti-HIV_Chain
auguucuuguucuuggucgcgggcgcgaccgggguccagagccaggucuaucuagugcccuuuggcccggaagugaaaaagcccgggagcucggucaaggucucgugcaaggccucaggcgauagcuuuaccucgagcgugaucacgugggugcgccaggccccgggccagggcccggaauggauggggcgcgugaucccgguauugggcguggccgcguacgcgcaaaaauucuauggcagggucacgaucacggccgauaccucgagcaauaccgcguacauggaagugaacucgcucagguucgaggacacggccguguacuauugcgcgcgagagaccgggcgcgggggcaaucucgcgcucaggcaauauuucuuugacucgugggggcaagggaccuuggucacggucucgagcccgagcacgaaaggg

SEQ ID NO: 58108 - RNA, 438 nt, Artificial Sequence
  derived and/or modified sequence opt11 from anti-HIV_Chain
caaguccaacuccaagaauccggccccggacucgucaaacccuccggcacccucucacucaccugcgccgucuccggcgccuccaucuccucucgcaacugguggaccuggguccgccaaccccccggcaaaggccucgaauggaucggagaaaucuacgaauccggcgccaccaacuacaaccccucccucaaaucccgcgucaccaucuccguagacaaauccaaaaaccaauucucccuccgacucaccuccgucaccgccgccgacaccgccgucuacuucugcgcacgccucaugaccuucggcggccucaucggcacccucgacuacuggggccaaggcacccucgucaccguccuccaaccccccccccgcgcccaccgcuaccacccccgcaaucuccuucaagaacaccucugcgcccgcguaaugcca

SEQ ID NO: 58109 - RNA, 444 nt, Artificial Sequence
  derived and/or modified sequence opt11 from anti-HIV_HeavyChain
auggaguggucgggaguguucauauucuugcucucagucacggccgggguccauagcgagguccagcucguggaaucgggcgggggcuuggucaagcccgggggcucgcucaggcucucgugcgcggccucgggcuauaccuuuagcaauuacuggaucgggugggugcgccaggccccgggcaagggccuggaauggaucggggacauauacccgggcgggaacuauaucaggaacaaugaaaaguucaaggacaagaccacgcuaucggccgauaccucgaaaaauaccgcguacuugcaaaugaacucgcuaaagaccgaggacacggccguguacuauugcgggagcucguucgggagcaauuacguguucgcgugguuuaccuauugggggcaagggacauuggucacggucucgagcggggaaucgcucaagcccuug

SEQ ID NO: 58110 - RNA, 444 nt, Artificial Sequence
  derived and/or modified sequence opt11 from anti-HIV_HeavyChain
auggaaugguccggcgucuucaucuuccuccucuccgucaccgcaggcguccacucccaaguccaacuaguccaauccggacccgacgucaaaaaacccggcaccuccaugaaaauguccugcaaaaccuccggcuacaccuucucaaacuacuggaucggcuggguccgccaagcccccggccaaggccucgaauggaucggcgacaucuaccccggcggcaacuacauccgaaacaacgaaaaauucaaagacaaaaccacccucaccgccgacaccuccaccuccacagccuacaugcaacucggcucccuccgcuccgaagacaccgccgucuacuacugcggcuccuccuucggcuccaacuacgucuucgccugguucaccuacuggggccaaggcacccucgucaccgucuccucaggagaaucccucaaaccccuc

SEQ ID NO: 58111 - RNA, 447 nt, Artificial Sequence
  derived and/or modified sequence opt11 from anti-HIV_Chain
caagcccgccucgaccaauggggcaccggccuccucaaacccucagaaacccucucacucaaaugcgccgucuucggcguacucuucaccgacuacaacuggaccuggguccgccaaucccccggcaaaggccucgaauggaucggccaccucgaccaccgcggcggcggcaacuacaaccccucccucgaaucccgagucaccaucucccucgacuacuccaaagcccaauucucccuccaccucaaauccgucaccgucgccgacaccgcccucuacuacugcgccggcgccgucaaaggcuucugguucgacgaagucuacaacugguucggccccggcguccgcgaacccuggcuccccuccccccaaccccccccccgagcccaccgcuccucccccuggcacccccccccacgcgccccccuagucacagccaccgucccc

SEQ ID NO: 58112 - RNA, 447 nt, Artificial Sequence
  derived and/or modified sequence opt11 from anti-HIV_Chain
caagcccgccucgaccaauggggcaccggccuccucaaacccuccgaaacacuuucccuaaaaugcgccgucuucggcguccucuucaccgacuacaacuggaccuggguccgccaaucccccggcaaaggccucgaauggaucggccaccucgaccacagaggcggcggcaacuacaaccccucccucgaaucccgcgucaccaucucccucgacuacuccaaagcccaauucucccuccaccucaaauccgucaccgucgccgacaccgcccucuacuacugcgccggcgccgucaaaggccucugguucgacgaaaccuacaccugguucggccccuggucccaaggcacccgcgucaccgucgccuccgccucaaccaaaggccccuccgucuucccccucgcccccucauccaaauccaccuccggcacccgcgaccucucc

SEQ ID NO: 58113 - RNA, 447 nt, Artificial Sequence
  derived and/or modified sequence opt11 from anti-HIV_Chain
gccgcccgccuagaccaauggggcaccggccucgucaaacccuccgaaacccuaucccuaaaaugcgccgucuucggcgucgacuuccccgacuacaccuggaccugggcccgacaagcccccggcaaaggccucgaauggaucggccaccgcgaccaccgcggcggcuccuccuacaaccccucccucuccggccgcgccaccaucucccucgacaccuccaaagcccaauucucccuccacaucaaauccgucacagucgcagacaccgcaaccuacuacugcgccggcgccgucgccggccucugguucgaagacgccuacaacugguucggccccuggucccaaggcacccucgucaccgucgccgccgccuccacaaaaggccccuccgucuucccacucgccccaucauccaaauccaccuccggccacgccuccguccuc

SEQ ID NO: 58114 - RNA, 450 nt, Artificial Sequence
  derived and/or modified sequence opt11 from anti-HIV_Chain
cucgcgcaauuggaacagagcgggggcggggucgugaaaccgggcgggagcuugcgcuugcccugcgccgcgagcggguucacguucauagacuauuacauggccuggaucaggcucgcgcccgggaaagggcucgagugguugagcuauaucucgaaaaauggcgauuacacgaaauauagcgagagcuuaaaagggcgcuuuaccauaagcagggacaaugccaagaacuuggucauacuccagcucaaucgcuugagagcggacgacaccgcgaucuauuucugugccagggccgacggcuuaaccuauuucggggaauugcuccaguacauauucgaucucuggggccagggcgcgcgcgugaucgugagcucggccucgaccaagggcccgagcguguucccgcucgcacccucgagcaagagcacaagugggcacgcgagcgug

SEQ ID NO: 58115 - RNA, 459 nt, Artificial Sequence
  derived and/or modified sequence opt11 from anti-HIV_Chain
caagugcaauugguccagagcggggccgaggucaagaaaccgggcgcgagcgugaaagugagcugcaaaguaagcggguacacgcucacggaacugagcauacacugggucaggcaagcacccgggaaagggcucgaguggaugggcggguucgacagcgaggacggagaagcaaucuauaaacagaacuuucaagggcgcgugaccaugaccgaggacacgagcacggacacggccuauauggagcucucgcgcuugcgaucggaagauaccgcggucuauuacugcgccacggccgaucgcuuuaaaguggcccaggacgagggcuuguucgugaucuuugacuauugggggcaagggaacccgggacaucgcuugcuaucgcuccaccaagggcccauaggccugccaccgggcacgcucccgcccaaggccacaagcgggcacgcggccagacgc

SEQ ID NO: 58116 - RNA, 462 nt, Artificial Sequence
  derived and/or modified sequence opt11 from anti-HIV_Chain
cucguccaacucguacaauccggcgccgaagucaaaaaacccggcgccuccgucaaagucuccugcaaagucuccggcuacucacucaccgaacucuccauccacuggguccgccaagcccccggcaaaggccucgaauggaugggcggauucgacuccgaagacggcgaagccaucuacaaacaaaacuuccaaggccgcgucaccaugacagaagacaccucaaccgacaccgccuacauggaacucucacgccuccgcuccgaagacaccgccgucuacuacugcgccaccgccgacccauucaaagucgcccaagacgaaggccucuucgucaucuucgacuacuggggccaaggcaccaccggccaccgccuccucucacuccaccaaggcccccaccgccucuacucccuaggcacccuccucucccgcgcccccaucguccaaacccacauggcc

SEQ ID NO: 58117 - RNA, 471 nt, Artificial Sequence
  derived and/or modified sequence opt11 from anti-HIV_Chain
caaauccaccucguacaauccggcaccgacgucaaaaaacccggcuccuccgucacagucuccugcaaagccuacggcgucaacaccuucggccucuacgccgucaacuggguccgccaagccccaggccaaucccucgaauacaucggccaaaucuggcgcuggaaaucaucagccucccaccacuuccgcggccgcguccuaaucuccgccgucgaccucaccggcuccucaccccccaucuccucccuagaaaucaaaaaccucaccucagacgacaccgcagucuacuucugcaccacaaccuccaccuacgaccaaugguccggccuccaccacgacggcgucauggccuucuccucccgcggccaaggcacccucaucuccgucuccgccgccuccaccaaaggccccuccgucuucccccucgcccccuccuccaaauccaccuacggccucgcccacguccuc

SEQ ID NO: 58118 - RNA, 477 nt, Artificial Sequence
  derived and/or modified sequence opt11 from anti-HIV_Chain
caacaccaacucguccccugcgucgccgaaguccgcaaacccggcgccuccgucaaagucuccugcaaaguauccggauacacccucaccgaaaucuccaugcacuggguccgccaagcccccggcaaaggccucgaauggaugggcggcuucgaccgcgaagacggcgaaaccaucuacgcccaaaaauuccaaggccgcgucaccaugaccgaagacacauccaccgacaccgccuacauggaacucuccucccuccgcuccgaagacaccgccgucuacuacugcgccaccaccuaccucgccgucguccccgacggcuucgacgguuacucauccucaugguacugguucgaccccuggggccaaggcacccucgucaccgucucauccgccuccaugcaaggccccaugcuccucucccccacaggcacccuccucccccgcgcaccccucguccaaacccgcccaggcccc

SEQ ID NO: 58119 - RNA, 642 nt, Artificial Sequence
  derived and/or modified sequence opt11 from anti-HIV_LightChain
gacauaguaauaacccaauccaccaaauucaugucaaccuccgucggcgaccgcgucuccaucacaugcaaagccucccaggacgucuccaccgccgucgccugguaccaacaaaaacccggccaaucccccaaacuccuaauauacugggccuccacccgccacaccggcguccccgaccgcuucaccggcucaggcuccggcaccgacuacacccucaccaucucccgcguacaagccgaagaccucgcccucuacuacugccaacaacacuacaccacccccuggaccuucggcggcggcaccaaacucgaaaucaaacgcaccgucgccgcccccuccuucgucaucuucccacccuccgacgaacaacucaaaucaggcaccgcauccgucgucugccuacucaacaacuucuacccccgcgaagccaaaguccaauggaaagucgacaacgcccuccaauccggcaauucccaagaauccgucaccgaacaagacucaaaagacuccaccuacucccucuccuccacccucacccucuccaaagccgacuacgaaaaacacaaagucuacgcaugcgaagucacccaccaaggccucuccucacccgucaccaaauccuucaaccgcggcgaaugc

SEQ ID NO: 58120 - RNA, 651 nt, Artificial Sequence
  derived and/or modified sequence opt11 from anti-HIV_Chain
caauccguccucacccaaccacccuccgucuccgccgccccaggacaaaaagucaccaucucuugcuccggauccuccucaaacaucggaaacaacuacguccuaugguaccaacaauuccccggcaccgcacccaaacuacuaaucuacggcaacaacaaacgccccucaggcaucccagaccgauucuccggcuccaaauccggaaccucagccacccucggaaucaccggccuacaaaccggcgacgaagccgacuacuucugcgcaaccugggacuccggccuauccgccgacugggucuucggcggaggcaccaaacucaccguccucucccaacccaaagccgcccccucaguaacccucuucccccccuccuccgaagaacuccaagccaacaaagccacccucgucugccucaucuccgacuuuuaccccggcgccgucaccgucgccuggaaagccgacuccucccccgucaaagccggagucgaaaccaccacacccuccaaacaauccaacaacaaauacgcagccuccucauaccucucccucacacccgaacaauggaaaucacaccgcuccuacucuugccaagucacccacgaaggcuccacagucgaaaaaaccgucgcccccaccgaaugcuca

SEQ ID NO: 58121 - RNA, 657 nt, Artificial Sequence
  derived and/or modified sequence opt11 from anti-HIV_Chain
gacaucgucaugacccaaucaccagacucccucgccgucucccucggcgaacgcgucaccaugaacugcaaauccucccaaucccuccucuacucaaccaaccaaaaaaacuaccucgccugguaccaacaaaaaccaggccaauccccaaaacuccucauauacugggcaaacuccaccgaauccggcguccccgaccgcuucuccggcuccggcuccggcaccgacuucacccucaccaucucauccguccaagccgaagacguagccgucuacuacugccaacaauacuacuccuaccgcacauucggaggcggcaccaaacucgaaaucaaacgcaccgucgccgccccaagcgucuucauauucccccccucugacgaacaacucaaauccggcaccgccuccgucgucugccuccucaacaacuucuacccccgcgaagccaaaguacaauggaaagucgacaacgcacuccaauccggcaacucccaagaaucagucaccgaacaagacucaaaagacuccaccuacagccucuccuccacccuaacccucagcaaagccgacuacgaaaaacacaaagucuacgccugcgaagucacccaccaaggccucuccucccccgucaccaaauccuucaaccgcggcgaaugc

SEQ ID NO: 58122 - RNA, 753 nt, Artificial Sequence
  derived and/or modified sequence opt11 from anti-HIV_SingleChain
augcaaguacaacuggaacagagcggggccgaagucaagaaaccgggcgcgagcgugaaagugagcugucaagcgagcggauacagguucucaaacuuuaccguacacuggguaaggcaagcgccagggcaaagauucgaguggaugggcuggaucaaccccuauaacgggaacaaggaguucagcgcgaaauuccaagaucgcgugaccuuuaccgcggacacaagcgcgaacacggccuauauggaacucagaagccugcgcagugcagacacagcgguauacuacugcgccaggguaggggaauggggcugggacgauaguccgcaagauaacuauuacauggacgugugggggaaaggaaccacgguaauagucucgagcgggggagggggaucgggcgggggcgggagcgggggcggcgggucggacauagaauugacccagagcccggggacgcuaucgcuaucacccggggaaagggccacguucucgugcaggagcucgcacucgauaaggagcaggagaguggccugguaccagcacaagccagggcaagcgcccaggcucgugauacauggaguaagcaauagagcaagcgggauaucggacagguucucgggaucaggcucgggcacggacuucacccuaaccauaacaagagucgagccagaggacuuugccuuguacuacugccagguauauggcgcgagcagcuacacguucgggcaagggaccaagcucgagcgcaag

SEQ ID NO: 58123 - RNA, 1338 nt, Artificial Sequence
  derived and/or modified sequence opt11 from anti-HIV_LightChain
gaagucaaacucgaagaauccggcggaggccugguccaaccaggcggcucccgcaaacucucaugcgccgccucaggcuucacauucuccucauucggcaugcacuggguacgacaagcccccgaaaaaggacucgaaugggucgccuacauauccucaggcuccucaacccuccacuacgccgacaccguaaaaggccguuucaccauaagucgcgauaaccccaaaaacacccucuuccuccaaaugaaacuccccucccuaugcuacggacuccucggaucacgcaaucucagccaccgacuccucucacaaaaugacacccccaucugccucaccgucucuagcgcauccacgaaaggacccuccgucuucccacucgccccuuccuccaaauccaccucuggcggaaccgcagcacuaggcugccucguaaaagacuacuucccugaacccgucacaguaagcuggaacucaggggcccucacauccggcguccacaccuuccccgccguccuucaauccuccggccucuacucccucuccagcgucgucaccgucccguccucaucccuuggcacucagaccuacaucuguaacgucaaccacaaacccuccaacaccaaagucgauaagaaagucgaaccaaaauccugcgacaaaacccacacuugucccccgugccccgcacccgaacuacuaggcggacccuccgucuuccucuucccaccuaaacccaaagacacucucaugaucucccgcacccccgaagucacaugcgucgucgucgacgucucccacgaggacccagaagucaaauucaacugguacgucgacggcgucgaaguccacaacgccaaaaccaaaccccgcgaagaacaauauaacuccacauaccgcgucgucuccguccucacaguacuacaccaagacuggcugaauggaaaagaauacaaaugcaaagucagcaacaaagcccuacccgcccccaucgagaaaacuaucuccaaagcaaaaggccaaccccgagaaccacaaguuuacacccuacccccgucccgagaagaaaugaccaaaaaccaagucagccucacaugccugguuaaaggcuucuaccccuccgacaucgccgucgaaugggaaucaaauggacaacccgaaaacaacuauaaaaccaccccacccguccuagacuccgacggcucuuucuuccucuacuccaaauuaacagucgacaaaucucgcuggcaacaaggcaacgucuucucuugcagcguaaugcacgaagcccuccacaaccacuacacccagaaaucccucucccucucccccgguaaa

SEQ ID NO: 58124 - RNA, 1380 nt, Artificial Sequence
  derived and/or modified sequence opt11 from anti-HIV_Chain
gaaguacaacuggucgaauccggaggaggccuagucaaacccggcgguucacuccgccucacaugcgucgcauccggauucaccuucucugacgucuggcucaacuggguccgccaggcccccggaaagggccucgaaugggucggccgcauaaaaagccgcacagacggcggcacaaccgacuacgcugcauccgucaaaggccgcuucaccaucucccgcgacgacagcaaaaacacucuuuaccuccaaaugaacucccucaaaacagaagauaccgcugucuacuccuguaccaccgacggauucaucaugauccguggcguguccgaagacuacuacuacuacuacauggacgucuggggaaaaggaaccacuguaaccguauccuccgccuccaccaaaggaccaagcgucuucccccucgccccauccagcaaauccaccuccggaggcaccgcagcccucggcugccuugucaaagacuacuuccccgaacccgucaccgucuccuggaacuccggcgcccucaccuccgggguccacacauucccagccguucuccaaucaagcggccuauacucacucuccuccgucgucaccguccccagcagcucccucggcacacaaacauacaucuguaacguaaaccauaaaccuuccaacaccaaaguugacaagaaaguagaaccaaaauccugcgacaaaacacauaccugucccccaugccccgcccccgaacuccucggaggcccuuccguauucuuauucccucccaaacccaaagacacccucaugauaucccgcacccccgaaguaaccugcgucgucgucgaugucucccacgaagaccccgaagucaaauucaacugguacgucgacggcgucgaaguccacaacgcaaaaaccaaaccacgcgaagaacaauacaacuccacauacagaguaguauccguccucaccguccuccaccaagacuggcuaaacgguaaagaauauaaaugcaaagucucaaacaaagcccucccagcccccaucgagaaaaccaucucaaaagcaaaaggccaaccccgugaaccccaagucuacacccuacccccaucaagagacgaacucaccaaaaaccaagucucacuaaccugccucgugaaaggcuucuaccccucagacaucgccgucgaaugggaaagcaacggccaaccugaaaacaacuacaagaccaccccaccaguccuagacuccgacggcucuuucuuccuauacucaaaacucacugucgacaaaucccgcuggcaacaaggcaacgucuucuccugcucagucaugcacgaagcccuacacaaccacuauacccaaaaaucacucucccucucaccuggc

SEQ ID NO: 58125 - RNA, 1413 nt, Artificial Sequence
  derived and/or modified sequence opt11 from anti-HIV_Chain
auggaauggagcggaguauucauguuccuccucuccgucacagccggcguacacucccaaguccaacuccaacaauccggcccagaagucguaaaacccggagccuccguaaaaaugagcugcaaagccuccggcuacaccuucaccuccuacguaauccacuggguccgacaaaagcccggacaaggccucgacuggaucggcuacauuaacccuuacaacgacggcaccgacuacgaugaaaaauucaaaggcaaagccacccucaccuccgacaccuccaccuccaccgcuuacauggaacucucaucccuacgaucagaagacacugccguuuacuacugcgccagagaaaaagacaacuacgcaaccggcgccugguucgccuacuggggccaagguacccucgucaccgucucauccgccuccaccaaaggacccucaguauucccccucgcacccagcuccaaguccaccagcgguggaaccgcagcccuaggcugccuagucaaagacuacuuccccgaaccagucaccguauccuggaacuccggagcacucaccucaggcguacacacuuuccccgccguccuacagucauccggccuauacucccucuccuccguaguaacgguccccuccuccagccucggcacccaaaccuacaucugcaacgucaaccacaaacccucaaacaccaaagucgacaagaaagucgaacccaaauccugcgacaaaacucacacaugcccaccgugccccgcccccgaguucgaaggcgguccaucaguauuucucuucccacccaaacccaaagacacccuaaugauaucccgaacacccgaaguaaccugugucgucguagacguaucacacgaagaccccgaagucaaauucaacugguacguugacggcguagaaguccacaacgccaaaacaaagccccgcgaagaacaauacaauuccacauacagaguaguauccguacuuaccguccuccaccaagacuggcugaacggcaaagaauacaaaugcaaaguauccaacaaagcacuccccgccucuauagagaaaaccaucuccaaagccaaaggccaaccccgcgaaccacaagucuacacacucccacccuccagagacgaacucaccaaaaaccaagucucacuuacaugccucgucaaaggcuucuacccaucagacauagccgucgaaugggaauccaacgggcaacccgaaaacaacuacaaaacaaccccucccguacucgacuccgacggcuccuucuuccucuacuccaaacucaccguagacaaaucccgcuggcaacaaggcaacguuuucucaugcagcgucaugcacgaagcccuccacaaccacuauacccaaaagucacucucccugucccccggaaaa

SEQ ID NO: 58126 - RNA, 645 nt, Artificial Sequence
  derived and/or modified sequence opt11 from anti-influenza_Fab
aucguacucacacaaagccccgccacacuauccgucucccccggagaacgcgccacccuauccugccgcgccucacaagucaucucccacaaccucgcaugguaccaacaaaaacccggccaagcaccccgccuccucaucuacggcgccuccacccgcgccuccggcauacccgcccgauucucaggcucaggcuccggcaccgacuacacccuaaccaucaccucccuccaacccgaagacuucgccgucuacuacugccaacacuacuccaacuggcccccacgacucaccuucggcggcggcaccaaagucgaaaucaaacgcaccgucgccgcccccagcguauucauauucccacccuccgacgaacaacuaaaaagcggcaccgccucugucgucugccuccuaaacaacuucuacccccgcgaagccaaaguccaauggaaagucgacaacgcacuccaauccggcaacucccaagaaagcgucaccgaacaagacuccaaagacuccaccuacucccuauccuccacccucacccucuccaaagccgacuacgaaaaacacaaagucuacgcgugcgaagucacccaccaaggccucuccucccccguaaccaaauccuucaaccgcggcgaaugc

SEQ ID NO: 58127 - RNA, 681 nt, Artificial Sequence
  derived and/or modified sequence opt11 from anti-influenza_Fab
guccaacuagucgaauccggcggcggcgucguccaacccggcaaauccccccgccucuccugcgccgccuccggccccaccuucucauccuacgccguccacuggguccgccaagccccaggcaaaggccuugaaugggucacccucaucuccuacgacggcgccaaccaauacuaugccgacuccgucaaaggccgcuucaccaucucccgcgacaacuccaaaaacaccguauaccuccaaaugaacucccuccgcccugaagacaccgccgucuacuacugcgccguccccggccccgucuucggaaucuucccccccuggucauacuucgacaacuggggccaaggcauccucgucacagucucaucagccuccaccaaaggccccuccgucuucccccuagcccccucaucuaaauccaccuccggcggaaccgccgcucucggcugccucgucaaagacuacuuccccgaacccguaaccgucuccuggaacucaggcgcccucacauccggcguccacaccuuccccgccguccuccaauccuccggccucuacucccucucauccgucgucacagucccuuccuccucccucggcacccaaaccuacaucugcaacgucaaucacaaacccuccaacaccaaagucgacaaaaaagucgaaccaaaauccugc

SEQ ID NO: 58128 - RNA, 1515 nt, Artificial Sequence
  derived and/or modified sequence opt11 from anti-influenza_Fab
gccggaucaaccgccacccucugccucggccaccacgccguucccaacggaaccaucgucaaaacaaucacuaacgaucaaaucgaagucaccaacgcaacagaacucguccaauccucaagcaccggcgaaaucugcgacucaccacaccaaauccucgacggcaaaaacugcacccucaucgacgcccuccuaggcgacccccaaugcgacggcuuccaaaacaaaaaaugggaccuguucgucgaacgcuccaaagccuauagcaacugcuaccccuacgacgucccugauuacgcaagccuccgcucacucguagcauccucaggcacccucgaauucaacaacgagucuuucaacuggaccggcguaacacaaaacggcaccuccuccgcgugcauccgccgauccaaaaacucauucuucagccgacuaaacuggcuaacacaccuuaacuucaaauaccccgcccuaaacgucaccaugcccaacaacgaacaauucgacaaacucuacaucuggggcguccaccacccaggaacagacaaagaccagaucuuccucuacgcccaagcaagcggaagaaucacagugucaacgaaacgcagucaacaaaccgucucaccaaacaucggaucaaggccccgaguccgcaacauacccucacggaucuccaucuacuggaccaucguaaaaccaggcgacauccuacuaaucaacuccaccggcaaccucaucgcuccgcgcggcuacuucaaaauacgcuccggaaaaagcuccauaaugcgguccgacgcacccauaggaaaaugcaacuccgagugcaucaccccaaauggcagcauccccaaugacaaaccuuuccaaaacgucaaccgcaucaccuacggcgccugcccccgcuacguaaaacaaaacacccucaaacucgccaccgguaugagaaacguaccagaaaaacaaacccgcggcauauucggcgccaucgccgguuucaucgaaaacggcugggaaggcauggucgacggaugguacggcuuucgacaccaaaauagcgaaggacgcgggcaagccgccgaccucaaauccacacaagcagccauagaucaaauaaacggcaaacuaaaccggcugaucggaaaaaccaacgaaaaauuucaccaaauagaaaaagaauucagcgaggucgaaggccgcauacaggaccuagaaaaauacgucgaggacacaaaaauagaccucuggagcuacaacgcggaacuccugguagcacuugaaaaccagcacaccauagaccuaaccgacucagaaaugaacaaacucuucgaaaaaaccaaaaaacaacuuagagaaaacgccgaagacaugggcaacggcugcuucaaaauauaccacaaaugcgacaacgcaugcaucgguucaauuagaaacggaaccuacgaccaugacgucuaccgcgacgaagcccucaacaaccgcuuccaaaucaaaggaucuggcagacucguaccucgc

SEQ ID NO: 58129 - RNA, 657 nt, Artificial Sequence
  derived and/or modified sequence opt11 from anti-influenza_Fab
caaguccaacucguacaauccggcggaggcgucguccaacccggccgcucccuccgacucuccugcgccgccuccgaauucaccuuccgcauguacgccacccacuggguccgccaagcccccggcaaaggccucgaaugggucgcccucaucuccuacgacggcuccaacaaauacuacgccgacucagucaaaggccgcuucaccaucucccgcgacaacuccaugaauaccgucuaccuacaaaugaacacccuccgccccgaagacaccgccgucuacuacugcgcccgcgaccucggcggcuacuucauccgaggaaucauggacgucuggggacaaggcacccuagucaccgucucauccgccucaacaaaaggccccuccgucuucccacucgcccccucauccggcggcaccgcagcccucggcugccucgucaaagacuacuucccagaacccgucaccguauccuggaacuccggcgcccucaccuccggcguccacaccuuccccgccguacuccaauccuccggccuauacucacuuuccucaguagucaccgucccauccuccucccucggcacccagacauacaucugcaacgucaaccacaaacccuccaacaccaaaguagacaaacgagucgaacccaaa

SEQ ID NO: 58130 - RNA, 642 nt, Artificial Sequence
  derived and/or modified sequence opt11 from anti-influenza_Fab
gaacuccaaaugacccaaucccccuccuccgucuccgccucagucggcgaccgcgucaccaucacuugccgcgccucccaaggcaucuccuccuggcuagccugguaccaacaaaaacccggcaaagcccccaaacuccucaucuacgccgcauccucccuucaauccggcguccccuccagauucuccggcuccggcuccggcaccgacuucacccucaccaucuccucacuccaacccgaagacuucgccaccuacuacugccaacaagccaacuccuucccccucaccuucggcggcggcaccaaagucgaaaucaaacgcacaguagccgcccccuccgucuucaucuucccacccuccgacgaacaacuaaaaucaggcaccgccuccgucgucugccuccucaacaacuucuacccccgcgaggccaaaguccaauggaaaguagacaacgcccuacaauccggaaacucccaagaaucagucaccgaacaagacucaaaagacuccaccuacucacucuccucaacccuaacacucuccaaagccgacuacgaaaaacacaaagucuacgccugcgaagucacccaccaaggccuauccucccccgucaccaaauccuucaaccgaggcgaaugc

SEQ ID NO: 58131 - RNA, 993 nt, Artificial Sequence
  derived and/or modified sequence opt11 from anti-influenza_Fab
gcugaccccggcgacaccaucugcaucggauaccacgccaacaacuccaccgacacagucgacaccguccucgaaaaaaacguaacagucacccacuccguaaaccuacucgaagacagccacaacggcaaacucugcaaacucaaagguaucgccccacuccaacuaggcaaaugcaacaucgcaggcuggcuccuuggcaaccccgaaugcgaccuacuccucaccgccuccuccugguccuacaucgucgagaccuccaacuccgaaaacggaaccugcuacccaggcgacuucaucgacuacgaagaacuccgcgaacaacucucuuccguauccuccuucgagaaauucgaaaucuucccaaaaacauccuccuggcccaaccacgaaaccaccaaaggcgucacagcagccugcuccuacgccggcgccuccucauucuaccgcaaucuccucuggcucaccaaaaaaggcucaucauaccccaaacucuccaaauccuacgugaacaacaaaggaaaagaaguccuaguccucuggggcguacaccacccccccacugguaccgaucaacaaucccucuaccaaaacgccgacgccuacgucuccgucggaucauccaaauacaaccgacgauucacaccagaaauagccgcccgccccaaaguccgcgaccaagcaggcagaaugaacuacuacuggacccuccucgaaccuggcgacaccaucaccuucgaagccacaggaaaccuaauagcccccugguacgccuucgcccuaaaccgaggauccggcuccggcaucaucacauccgacgcacccguccacgacugcaacacaaaaugccaaacaccacacggcgcgaucaacuccucccuccccuuccaaaacauccacccaguaaccaucggagaaugccccaaauacguccgcuccaccaaacuccgcauggccaccggccuccguaacauccccagcauccaaucccgc

SEQ ID NO: 58132 - RNA, 537 nt, Artificial Sequence
  derived and/or modified sequence opt11 from anti-influenza_Fab
ggccucuucggggcgaucgcgggcuucaucgagggcggauggacgggcaugaucgacggcugguacggguaccaccaccagaacgagcaagggagcggguacgcggccgaccaaaagagcacgcaaaacgccauagacgggaucacgaacaaggucaacagcgugaucgagaaaaugaacacgcaauucaccgcggucgggaaagaguucaacaaccuggaaaggcgaauagaaaaccucaacaaaaaggucgacgacggguuccuggacauauggacauacaacgccgagcucuugguacugcucgagaacgagcgcacgcucgacuuccacgacucgaacgugcgcaaccucuacgaaaaggucaagagccagcucaagaacaacgccaaggaaauaggcaacggaugcuucgaguucuaccacaagugcgaugacgcgugcauggaaucggucaggaacgggaccuacgacuaccccaaguacucggaagagagcaagcucaaccgcgaagaaauagacggggucucgggcagg

SEQ ID NO: 58133 - RNA, 642 nt, Artificial Sequence
  derived and/or modified sequence opt11 from anti-influenza_Apo
caaucaguccucacacaaccccccuccgucuccguagcccccggccaaacagcccgcaucaccugcggcggcaacgacaucggccgaaaauccguccacuggaaccaacaaaaacccggccaagcccccguccucgucgucugcuacgacuccgaccgccccuccgguauccccgaacgcuucucaggcuccaacuccggcaacaccgcaacccucacaaucucacgcgucgaagccggcgacgaagccgacuacuacugccaagucugggacucauccuccgaccacguaaucuucggaggcggaaccaaacucaccguccuaggccaacccaaagcagccccauccgucacccucuucccccccuccuccgaagaacuccaagccaacaaagccacccucgucugccuaaucuccgacuucuaccccggcgcagucacagucgcauggaaagcugacucaucccccgucaaagccggcgucgaaaccaccacccccuccaaacaauccaacaacaaauacgccgccuccuccuaccucucacucacccccgaacaauggaaaucccaccgcucauacuccugccaagucacccacgaaggcucaaccgucgaaaaaaccguagcccccaccgaaugcucc

SEQ ID NO: 58134 - RNA, 687 nt, Artificial Sequence
  derived and/or modified sequence opt11 from anti-influenza_Apo
gaaguccaacucguacaauccggcgccgaagucaaaaaacccggcgccuccgucaaagucucaugcaaagcauccggcuacacauucacagacuaccacaucaacugggucagacaagcccccggacaaggacucgaauggaugggcuggauccaccccaacuccggcgacaccaacuacgcccaaaaauuucaaggcugggucaccaugacacgcgacaccgccaucuccaccgccuacauggaagucaacggacuaaaauccgacgacaccgccgucuacuacugcgcccgcggcggccucgaaccccgcucagucgacuacuacuacuacggcauggacgucuggggccaaggcaccaccgucaccgucuccuccgccuccaccaaaggccccuccgucuucccccucgcccccuccucaaaauccaccuccggaggcaccgcagcccuaggaugccucgucaaagacuacuuccccgaacccguaaccgucuccuggaacucaggcgcccucaccuccggcguacacaccuucccagccguccuccaauccuccggccucuacucccucuccuccgucgucaccguccccucauccucccucggcacccaaacauacaucugcaacgucaaccacaaacccuccaacaccaaagucgacaaacgcguagaacccaaauccugc

SEQ ID NO: 58135 - RNA, 333 nt, Artificial Sequence
  derived and/or modified sequence opt11 from anti-influenza-A_kappa_LightChain_V-Region
gacaucgucaugacccaaucccccgacucccucgccgucucccucggcgcccgcgccaccaucaacugcaaauccucccaauccgucaccuucaacuacaaaaacuaccucgccugguaccaacaaaaacccggccaaccccccaaaguccucaucuacugggccuccgcccgcgaauccggcguccccgaccgcuucuccggcuccggcuccggcaccgacuucacccucaccaucuccucccuccaagccgaagacgucgccgucuacuacugccaacaacacuaccgcaccccccccaccuucggccaaggcaccaaagucgaaaucaaa

SEQ ID NO: 58136 - RNA, 333 nt, Artificial Sequence
  derived and/or modified sequence opt11 from anti-influenza-A_kappa_LightChain_V-Region
gacaucgucaugacccaaucccccgacucccucgccgucucccucggcgaacgagcaaccaucaacugcaaauccucccaauccgucuccuccaacaacaaaaacuaccucgccugguaccaacaaaaacccggccaaccccccaaaguccucaucuacugggccuccgcccgcgaauccggcguccccgaccgcuucuccggcuccggcuccggcaccgacuucacccucaccaucuccucccuccaagccgaagacgucgccgucuacuacugccaacaacacuaccgcaccccccccaccuucggccaaggcaccaaagucgaaaucaaa

SEQ ID NO: 58137 - RNA, 333 nt, Artificial Sequence
  derived and/or modified sequence opt11 from anti-influenza-A_kappa_LightChain_V-Region
gacaucguaaugacccaaucccccgacucccucgccgucucccucggcgaacgcgccaccaucaacugccgcucaucccaauccgucuccuccaacaacaaaaacuuccucgccugguaccaagaaaaacccggccaaccccccaaaguccucaucuacugggccuccgcccgcgaauccggcguccccgaccgcuucuccggcuccggcuccggcaccgacuucacccucaccaucuccggccuccaagccgaagacgucgccgucuacuacugccaacaacacuaccgcaccccccccaccuucggccaaggcaccaaagucgaaaucaaa

SEQ ID NO: 58138 - RNA, 333 nt, Artificial Sequence
  derived and/or modified sequence opt11 from anti-influenza-A_kappa_LightChain_V-Region
gacaucgucaugacccaaucccccgacucccucgccgucucccucggcgaacgcgccaccaucaacugcaaauccucccaauccgucaccuucaacuacaaaaacuaccucgccugguaccaacaaaaacccggccaaccccccaaacuccucaucuacugggccuccacccgcgaauccggcgucccagaccgcuucuccggcuccggcuccggcaccgacuucacccucaccaucucaucccuccaagccgaagacgucgccgucuacuacugccaacaacacuaccgcaccccccccaccuucggccaaggcaccaaagucgaaaucaaa

SEQ ID NO: 58139 - RNA, 339 nt, Artificial Sequence
  derived and/or modified sequence opt11 from anti-influenza-A_kappa_LightChain_V-Region
gacaucgucaugacccaaucccccgacucccucgccgucucccucggcgaacgcgccaccaucaacugcaaauccucccaauccguccucuacuccuccaacaacaaaaacuaccucgccugguaccaacaaaaacccggccaaccccccaaacuccucaucuacugggccuccacccgcgaauccggcguccccgaccgcuucuccggcuccggcuccggcaccgacuucacccucaccaucuccucccuccaagccgaagacgucgccgucuacuacugccaacaauacuacuccaccccccccaccuucggccaaggcaccaaagucgaaaucaaa

SEQ ID NO: 58140 - RNA, 333 nt, Artificial Sequence
  derived and/or modified sequence opt11 from anti-influenza-A_kappa_LightChain_V-Region
gacauccaaaugacccaaucccccgacucccucgcagucucccucggcgcccgcgccaccaucaacugcaaauccucccaauccgucaccuucaacuacaaaaacuaccucgccugguaccaacaaaaacccggccaaccccccaaaguccucaucuacugggccuccgcccgcgaauccggcguccccgaccgcuucucaggcuccggcuccggcaccgacuucacccucaccaucuccucccuccaagccgaagacgucgccgucuacuacugccaacaacacuaccgcaccccccccaccuucggccaaggcaccaaagucgaaaucaaa

SEQ ID NO: 58141 - RNA, 387 nt, Artificial Sequence
  derived and/or modified sequence opt11 from anti-influenza-A_HeavyChain_V-Region
caaguccaacucgucgaaucaggcggcggcguaguccaacccggacgcucccuccgccucucaugcgccgccuccggcuucaccuucuccuccuacggcaugcacuggguccgccaagcccccggcaaaggccucgaaugggucgccgucaucucauacgacggcuccaacaaauacuacgccgacuccgucaaaggccgcuucaccaucucccgcgacaacuccaaaaacacccucuaccuccaaaugaacucccuccgcgccgaagacaccgccgucuacuacugcgccaaagacucacaacuccgcucacuccucuacuucgacuggcucucccaaggcuacuucgacuacuggggccaaggcacccucgucaccgucuccucc

SEQ ID NO: 58142 - RNA, 387 nt, Artificial Sequence
  derived and/or modified sequence opt11 from anti-influenza-A_HeavyChain_V-Region
caaguacaacucguccaauccggcggcggcgucguccaacccggccgcucccuccgccucuccugcgucgccuccggcuucaccuucuccaccuacgccaugcacuggguccgccaagcccccggccgcggccucgaaugggucgccgucaucuccuacgacggcaacuacaaauacuacgccgacuccgucaaaggccgcuucuccaucucccgcgacaacuccaacaacacccuccaccucgaaaugaacacccuccgcaccgaagacaccgcccucuacuacugcgccaaagacucccaacuacgaucccuccucuacuucgaauggcucucacaaggcuacuucgaccccuggggccaaggaacccucgucaccgucuccucc

SEQ ID NO: 58143 - RNA, 387 nt, Artificial Sequence
  derived and/or modified sequence opt11 from anti-influenza-A_HeavyChain_V-Region
caaguccaacucguccaauccggcggcggcgucguacaacccggccgcucacuccgccucucaugcgcagccuccggcuucaccuucuccaccuacggcaugcacuggguccgccaagcccccggcaaaggccuagaaugggucgccgucaucuccuacgacggcaacuacaaauacuacgccgacuccgucaaaggccgcuucacaaucucccgcgacaacuccaaaaacacccucuaccucgaaaugaacucacuccgcaccgaagacaccgcccucuacuacugcgccaaagacucccaacuccgcucccuccucuacuucgacuggcucucccaaggcuacuucgaccacuggggccaaggcacccucgucaccgucuccucc

SEQ ID NO: 58144 - RNA, 387 nt, Artificial Sequence
  derived and/or modified sequence opt11 from anti-influenza-A_HeavyChain_V-Region
caaguccaacucguccaauccggcggcggcgucgucccccccggccgcucccuccgacuauccugcgccgcauccggcuucacauucuccaccuacggcaugcacuggguccgccaagcccccggcaaaggccucgaaugggucgccgucaucuccuacgacggcaacuacaaauacuacgccgacuccguccgcggccgcuucaccaucucccgcgacaacuccaaaaacacccucaaccucgacaugaacucccuccgaaccgaagacaccgcccucuacuacugcgccaaagacucacaacuccgcucccuccucuacuucgacuggcucucccaaggcuacuucgaccacuggggccaaggcacccucgucaccgucuccucc

SEQ ID NO: 58145 - RNA, 387 nt, Artificial Sequence
  derived and/or modified sequence opt11 from anti-influenza-A_HeavyChain_V-Region
caaguccaacucgucgaauccggcggcggcgucguccaacccggccgcucccuccgccucucaugcgccgccuccggcuucaccuucuccaccuacgccaugcacuggguccgccaagcccccggcaaaggccucgaaugggucgccgucaucuccuacgacgccaacuacaaauacuacgccgacucagucaaaggccgcuucaccaucucccgcgacaacuccaaaaacacccucuaccuacaaaugaacucccuccgcgccgaagacaccgccgucuacuacugcgcaaaagacucccaacuccgcucccuccucuacuucgaauggcucucccaaggcuacuucgacuacuggggccaaggcacccucgucaccgucuccuca

SEQ ID NO: 58146 - RNA, 387 nt, Artificial Sequence
  derived and/or modified sequence opt11 from anti-influenza-A_HeavyChain_V-Region
caaguccaacucgucgaaucaggcggcggcgucguccaacccggccgaucccuccgccucuccugcgccgccuccggcuucaccuucuccaccuacgccaugcacuggguccgccaagcccccggcaaaggccucgaaugggucgccgucaucuccuacgacggcaacuacaaauacuacgccgacuccgucaaaggccgcuucaccaucucccgcgacaacuccaaaaacacccucuaccuccaaaugaacucccuacgcgccgaagacaccgccguauacuacugcgccaaagacucccaacuccgcucccuccucuacuucgaauggcucucccaaggcuacuucgaccccuggggccaaggcacccucgucaccguauccucc

SEQ ID NO: 58147 - RNA, 387 nt, Artificial Sequence
  derived and/or modified sequence opt11 from anti-influenza-A_HeavyChain_V-Region
caaguccaacucguccaaucaggcggcggcgucguccaacccggccgcucccuccgccuauccugcgucgccuccggcuucaccuucuccaccuacgccaugcacuggguccgccaagcccccggccgcggccucgaaugggucgcagucaucuccuacgacggcaacuacaaauacuacgccgacuccgucaaaggccgcuucuccaucucccgcgacaacuccaacaacacccuccaccucgaaaugaacacacuccgcaccgaagacaccgcccucuacuacugcgcaaaagacucccaacuccgcucccuccucuacuucgaauggcucucccaaggcuacuucgaccccuggggccaaggcacccucgucaccgucaccucc

SEQ ID NO: 58148 - RNA, 330 nt, Artificial Sequence
  derived and/or modified sequence opt11 from anti-influenza-A_LightChain_V-Region
aacuucaugcucacccaaccccccuccgccuccggcacccccggccaacgcgucaccaucuccugcuccggcuccuccuccaacaucggcggcaacaccguccacugguuccaacaacuccccggcaccgcccccaaacuccucaucuacaccaacucccuccgccccuccggcguacccgaccgcuucuccggcuccaaauccggcaccuccgccucccucgccaucuccggccuccaauccgaagacgaagccgacuacuacugcgccgccugggacgacucccucaacggccaagucuucggaggcggcaccaaacucaccguccua

SEQ ID NO: 58149 - RNA, 390 nt, Artificial Sequence
  derived and/or modified sequence opt11 from anti-influenza-A_HeavyChain_V-Region
caagugcaauugcuagagagcggaggcggggucgugcaaccgggcaggagccugcgcuugagcugugccgcaagcggguucacguucucgaacuauggcaugcacugggucaggcaagcgcccgggaaagggcucgaguggguggccauaaucucguucgauggcucgaaaaaguacuaugccaauagcgugaaagggcgcucgaccauaagcagggacaauagcaagaacacgcucucgcuacagaugaauagcuugggcccggaagauaccgcgcucuauuacugugccaagcucccgagcccguacuauuucgauagcagguucguguggguggccgcgagcgcguuccauuucuggggccagggcauacucgugaccgugagcuca

SEQ ID NO: 58150 - RNA, 132 nt, Artificial Sequence
  derived and/or modified sequence opt11 from anti-influenza_Chain
aacguccccgaaugguccuacaucgucgaaaaagccaaccccgccaacgaccucugcuaccccggcaacuucaacgacuacgaagaacucaaacaccuccucucccgcaucaaccacuucgaaaaaauccaa

SEQ ID NO: 58151 - RNA, 162 nt, Artificial Sequence
  derived and/or modified sequence opt11 from anti-influenza_Chain
uccggccgccucgucccccgcggcucccccggcuccggcuacauccccgaagccccccgcgacggccaagccuacguccgcaaagacggcgaauggguccuccucuccaccuuccucggcaaacccauccccaacccccuccucggccucgacuccaccggc

SEQ ID NO: 58152 - RNA, 291 nt, Artificial Sequence
  derived and/or modified sequence opt11 from anti-influenza_Chain
augucgcucuugaccgaggucgagaccccgaucaggaacgaguggggguguaggugcaauggcucgagcgaucccuuggccauagccgcgaacauaaucgggaucuugcacuugauccuguggauacucgaucgcuuguucuuuaaaugcaucuaucgcagguucaaguacgggcucaagggcgggcccucaaccgagggcgugccaaagagcaugcgcgaggaauaucgcaaggaacagcaaucggccguggacgcggacgauggccauuucgugagcauagaauuggaa

SEQ ID NO: 58153 - RNA, 300 nt, Artificial Sequence
  derived and/or modified sequence opt11 from anti-influenza_Chain
augaacaacgccaccuucaacugcaccaacaucaaccccaucacccacauccgcggcuccaucaucaucaccaucugcgucucccucaucgucauccucaucgucuucggcugcaucgccaaaaucuucaucaacaaaaacaacugcaccaacaacgucauccgcguccacaaacgcaucaaaugccccgacugcgaacccuucugcaacaaacgagacgacaucuccaccccccgcgccggcguagacauccccuccuucauccuccccggccucaaccucuccgaaggcacccccaac

SEQ ID NO: 58154 - RNA, 300 nt, Artificial Sequence
  derived and/or modified sequence opt11 from anti-influenza_Chain
gaacucacacaaucccccuccucccucuccgccuccgucggcgacuccgucaccaucaccugccgcaccuccgaacgcaucuccaccuaccucaacugguaccaacaaaaacccggcaaagccccccgccuacucgucuccggcgccuccacccuccaaggcggcguccccucccgcuucuccggcuccggcuccggcaccgccuucacccucaccaucaacucccuccaacccgaagacuucgccaccuacuacugccaacaauccuacuccaccccccucaccuucggcggcggcacc

SEQ ID NO: 58155 - RNA, 300 nt, Artificial Sequence
  derived and/or modified sequence opt11 from anti-influenza_Chain
augacccaaucccccuccuccauguccgucucccucggcgacaccgucuccaucaccugccacgccucccaagacaucuccggccacaucggcuggcuccaacaaaaacccggcaaauccuucaaaggccucaucuaccacggcaccaaccucgaagacggcguccccucccgcuucuccggcuccggcuccggcgccgacuucucccucaccaucuccucacucgaauccgaagacuucgccgacuacuacugcguccaauacguccaauuccccuggaccuucggcggcggcaccaaa

SEQ ID NO: 58156 - RNA, 306 nt, Artificial Sequence
  derived and/or modified sequence opt11 from anti-influenza_Chain
gacauccaagucacccaaucccccuccucccucucagccuccgucggcgaccgcgucaccaucuccugccgcgcccaaucccucuccuccuaccuccacugguaccaacaaaaacccggccaaccccccaaacuccucaucuacgccgccaccacccuccaauccggcguccccucccgcuucuccggcuccggcuccggcaccgacuucacccucaccaucuccaccuuccaagccgaagacgucgccaccuacuacugccaacaaucccgcaccuucggccaaggcaccaaagucgaaaucaaa

SEQ ID NO: 58157 - RNA, 306 nt, Artificial Sequence
  derived and/or modified sequence opt11 from anti-influenza_Chain
gacauccaaaugacccaaucccccuccucccucuccgccuccgucggcgaccgcgucaccaucuccugccgcgcccaaucccucucauccuaccuccacugguaccaacaaaaacccggccaaccccccaaacuccucaucuacgccgccaccacccuccaauccggcguccccucccgcuucuccggcuccggcuccggcaccgacuucacccucaccaucuccaccuuccaagcagaagacgucgccaccuacuacugccaacaaucccgcaccuucggccaaggcaccaaagucgaaaucaaa

SEQ ID NO: 58158 - RNA, 309 nt, Artificial Sequence
  derived and/or modified sequence opt11 from anti-influenza_Chain
gacauccaaaucacccaaucccccuccucccucuccgccuccgucggcgaccgcgucaccaucaccugccgcaccucccaaucccucuccuccuaccuccacugguaccaacaaaaacccggcaaagcccccaaacuccucaucuacgccgccuccucccuccaauccggcguccccucccgcuucuccggcuccggcuccggcaccgacuucacccucaccaucuccucccuccaacccgaagacuucgccaccuacuacugccaacaaucccgcaccuucggccaaggcaccaaagucgaaaucaaa

SEQ ID NO: 58159 - RNA, 309 nt, Artificial Sequence
  derived and/or modified sequence opt11 from anti-influenza_Chain
gacauccaaaugacccaaucccccuccucacucuccgccuccgucggcgaccgcgucaccaucaccugccgcaccucccaaucccucuccuccuaccuccacugguaccaacaaaaacccggcaaagcccccaaacuccucaucuacgccgccuccucccuccaauccggcguccccucccgcuucuccggcuccggcucaggcaccgacuucacccucaccaucuccucccuccaacccgaagacuucgccaccuacuacugccaacaaucccgcaccuucggccaaggcaccaaagucgaaaucaaa

SEQ ID NO: 58160 - RNA, 309 nt, Artificial Sequence
  derived and/or modified sequence opt11 from anti-influenza_Chain
gacauccaagucacccaaucccccuccucccucuccgccuccgucggcgaccgcgucaccaucuccugccgcgccucccaacgccucaacuccuaccuccacugguaccaacaaacccccggccaagcccccaaacuccuaaucuacgccaccucaacccuccaauccggcgucucaccccgcuucuccggcuccggcuccggcaccgacuucacccucaccaucuccucccuccaacccgaagacgucgccaccuacuacugccaacucucccgcaccuucggccacggcaccaaagucgaaaucaaa

SEQ ID NO: 58161 - RNA, 309 nt, Artificial Sequence
  derived and/or modified sequence opt11 from anti-influenza_Chain
gacauccaaaugacccaaucccccuccucccucuccgccuccgucggcgaccgcgucaccaucuccugccgcgccucccaacgccucaacuccuaccuccacugguaccaacaaacccccggccaagcccccaaacuccucaucuacgccaccuccacccuccaauccggcgucucaccccgcuucuccggcuccggcuccggcaccgacuucacccucaccaucuccucccuccaacccgaagacgucgccaccuacuacugccaacucucccgcaccuucggccacggcaccaaagucgaaaucaaa

SEQ ID NO: 58162 - RNA, 309 nt, Artificial Sequence
  derived and/or modified sequence opt11 from anti-influenza_Chain
gacauccaagucacccaaucccccuccucccucuccgccuccgucggcgaccgcaucaccaucuccugccgcaccucccaaucccuccgcuccuaccuccacugguaccaacaaaaacccggcaaagcccccaaacuccucaucuacgccuccuccacccuccaauccggcguccccucccgcuucuccggcuccggcuccggcaccgacuucacccucaccaucuccaaccuccaacccgaagacuucgccaccuacuacugccaacucucccgcaccuucggccaaggcaccaaagucgaaaucaaa

SEQ ID NO: 58163 - RNA, 309 nt, Artificial Sequence
  derived and/or modified sequence opt11 from anti-influenza_Chain
gacauccaaaugacccaaucccccuccucccucuccgccuccgucggcgaccgcaucaccaucuccugccgcaccucccaaucccuccgcuccuaccuccacugguaccaacaaaaacccggcaaagcccccaaacuccucaucuacgccuccuccacccuccaauccggcguccccucccgcuucuccggcuccggcuccggcaccgacuucacccucaccaucuccaaccuccaacccgaagacuucgccaccuacuacugccaacucucccgcaccuucggccaaggcaccaaagucgaaaucaaa

SEQ ID NO: 58164 - RNA, 309 nt, Artificial Sequence
  derived and/or modified sequence opt11 from anti-influenza_Chain
gacauccaaaugacccaaucccccuccucccucuccgccuccguaggcgaccgcgucaccaucaccugccgcaccucccaaucccucuccuccuacacccacugguaccaacaaaaacccggcaaagcccccaaacuccuaaucuacgccgccuccucccgccucuccggcguccccucccgcuucuccggcuccggcuccggcaccgacuucacccucaccaucuccucccuccaacccgaagacuucgccaccuacuacugccaacaaucccgcaccuucggccaaggcaccaaagucgaaaucaaa

SEQ ID NO: 58165 - RNA, 309 nt, Artificial Sequence
  derived and/or modified sequence opt11 from anti-influenza_Chain
gacauccaaaugacccaaucccccuccucccucuccgccuccgucggcgaccgcgucaccaucaccugccgcaccucccaaucccucuccuccuacacccacugguaccaacaaaaacccggcaaagcccccaaacuccucaucuacgccgccuccucccgcggcuccggcguccccucccgcuucuccggcuccggcuccggcaccgacuucacccucaccaucuccucccuccaacccgaagacuucgccaccuacuacugccaacaaucccgcaccuucggccaaggcaccaaagucgaaaucaaa

SEQ ID NO: 58166 - RNA, 309 nt, Artificial Sequence
  derived and/or modified sequence opt11 from anti-influenza_Chain
gacauccaaaugacccaaucccccuccucccucuccgccuccgucggcgaccgcgucaccaucaccugccgcaccucccaaucccucuccucauacgaccacugguaccaacaaaaacccggcaaagcccccaaacuccucaucuacgccgccuccucccgccucuccggcguccccucccgcuucuccggcuccggcuccggcaccgacuucacccucaccaucuccucccuccaacccgaagacuucgccaccuacuacugccaacaaucccgcaccuucggccaaggcaccaaagucgaaaucaaa

SEQ ID NO: 58167 - RNA, 318 nt, Artificial Sequence
  derived and/or modified sequence opt11 from anti-influenza_Chain
gaaaucgucaugacccaaucccccgacacccucuccgucucccccggcgaacgcgccacccucuccugccgcgccucccaauccgucaaccgccgccucgccugguaccaacaaaaacccggccaagccccccgccuccucauccacgacgccuccacccgcgccaccggcauccccgcccgauucuccggcuccggcuccggcaccgaauucacccucaccaucuccucccuccaauccgaagacuucgccgucuacuacugccaacaauacgacaacuggcucuccuucggccaaggcacccgccucgaaaucaaa

SEQ ID NO: 58168 - RNA, 318 nt, Artificial Sequence
  derived and/or modified sequence opt11 from anti-influenza_Chain
gacauccaacucacccaaucccccuccucccuauccgccuccgucggcgaccgcgucaccaucaccugccgcgccucccaaggcauccucaacugccucgccugguaccaacaaaaacccggcaaaguccccaaccuccucauguacgccgccuccacccuccaauccggcguccccucccgcuucuccggcuccggcuucggcaccgacuucacccucaccaucuccucccuccaacccgaagacgucgccaccuacuacugccaaaccuacggcggcgucuccaccuucggcggcggcaccaaagucgaaauccgc

SEQ ID NO: 58169 - RNA, 318 nt, Artificial Sequence
  derived and/or modified sequence opt11 from anti-influenza_Chain
uccuacguccucacccaaccccccuccgucuccgucgcccccggccaaaccgcccgcaucuccugcggcggcuccaacaucggcggcaaauccguccacugguaccaacaaaaacccggccaagcccccguccucgucgucuacgacgacuccggccgccccuccggcauccccgaacgauucuccggcuccaacuccggcgacaccgccacccucaccaucucccgcgucgaagccggcgacgaagccgacuacuucugccaagucugggacaacuucggcggcgucuucggcaccggaaccaaagucaccguccuc

SEQ ID NO: 58170 - RNA, 318 nt, Artificial Sequence
  derived and/or modified sequence opt11 from anti-influenza_Chain
gacauccaaaugacccaaucccccuccucccucuccgccuccgucggcgaccgcgucaccaucaccugccgcaccucccaauccaucuccuccuaccucaacugguaccaacaaaaacccggcaaagcccccaaacuccucaucuacgccgccuccucccuccaauccggcguccccucccgcuucuccggcuccggcuccggcaccgacuucacccucaccaucuccggccuccaacccgaagacuucgcaaccuacuacugccaacaauccuacuccaugcccgccuucggccaaggaaccaaacucgaaaucaaa

SEQ ID NO: 58171 - RNA, 318 nt, Artificial Sequence
  derived and/or modified sequence opt11 from anti-influenza_Chain
gacauccaaaugacccaaucaccccucuccgucuccgucuccgucggcgaccgcgucaccaucgccugccgcgccucccaauccaucgacaaauuccucaacugguaccaacaaaaacccggcaaagcccccaaacuccucaucuacggcgccuccaaccuccacuccggcgcccccucccgcuucuccgccuccggcuccggcaccgacuucacccucaccaucaccaacauacaaaccgaagacuucgcaaccuaccucugccaacaauccuucuccguccccgccuucggcggcggcaccaaagucgaaaucaaa

SEQ ID NO: 58172 - RNA, 318 nt, Artificial Sequence
  derived and/or modified sequence opt11 from anti-influenza_Chain
gacauccaaaugacccaaucccccuccucccucuccgccuccgucggcgaccgcgucaccaucaccugccgcgccucccaauccaucuccaccuaccucaacugguaccaaaaacgccccggcaaagcccccaaacuccucgucuacggcgccuccacccuccaauccggcguccccucccgcuucuccggcuccggcuccggcaccgacuucacccucaccaucgccucccuccaacccgaagacuccgccaccuacuacugccaacaaaccuacuccaucccccucuucggccaaggcacccgccucgaaaucaaa

SEQ ID NO: 58173 - RNA, 318 nt, Artificial Sequence
  derived and/or modified sequence opt11 from anti-influenza_Chain
gacauccaaaugacccaaucacccuccucccucuccgccuccgucggcgaccgcgucaccaucaccugccgcgccucccaauccaucuccaccuaccucaacugguaccaaaaacgccccggcaaagcccccaaacuccucgucuacggcgccuccucccuccaauccggcguccccucccgcuucuccggcuccggcuccggcaccgacuucacccucaccaucgccucccuccaacccgaagacuccgccgucuacuacugccaacaaaccuacuccaucccccucuucggccaaggcacccgccucgaaaucaaa

SEQ ID NO: 58174 - RNA, 318 nt, Artificial Sequence
  derived and/or modified sequence opt11 from anti-influenza_Chain
gacauccaaaugacccaaucacccuccucccucuccgccuccgucggcgaccgcgucaccaucaccugccgcgccucccaauccaucucccgcuaccucaacugguaccaacaaaaacccggcaaagcccccaaacuccucaucuacggcgccuccacccuccaaaacggcgcccccucccgcuucuccggcuccggauccggcaccgacuucacccucaccaucuccucacuccaacccgaagacuccgccaccuaccucugccaacaauccuacuccguccccgccuucggcggcggcaccaaagucgaagucaaa

SEQ ID NO: 58175 - RNA, 318 nt, Artificial Sequence
  derived and/or modified sequence opt11 from anti-influenza_Chain
ggcauccaaaugacccaaucccccuccucccucuccgccuccgucggcgaccgcgucaccaucaccugccgcgccucccaauccaucucccgcuaccucaacugguaccuccaaaaacccggcaaagcccccaaacuccucaucuccggcgccuccucccuccaauccggcguccccucccgcuucuccggcaccggcuccggcaccgaauucacccucaccaucuccucccuccaacccgaagacuucgccaccuacuacugccaacaaaccuucuccaucccccucuucggccaaggcaccaaagucgaaaucaaa

SEQ ID NO: 58176 - RNA, 321 nt, Artificial Sequence
  derived and/or modified sequence opt11 from anti-influenza_Chain
gacauccaaaugacccaaucccccuccucccucuccgccuccgucggcgaccgcgucuccaucaccugccaagccucccaagacaucucccgcuaccucaacugguaccaacaaaaacccggcgaagcccccaaacuccucaucuacgacgccuccaaccucgaaaccggcguccccucccgcuucuccggcuccggcuccggcaccgacuucaccuucaccaucuccucccuccaacccgaagacaucgccaccuacuucugccaacaauacggcuaccucccccucaccuucggccccggcaccaaagucgacuccaaa

SEQ ID NO: 58177 - RNA, 321 nt, Artificial Sequence
  derived and/or modified sequence opt11 from anti-influenza_Chain
gacauccaaaugacccaaucccccuccuccuucuccgucucccucggcgaccgcgucaccaucaccugcaaagccuccgaagacaucuacaaccgccucgccugguaccaacaaaaacccggcaacgccccccgccuccucaucuccgacaccaccaaccucuggaucggcguccccucccgcuucuccggcuccggcuccggcaaagacuacacccucuccaucaccucccuccaauccgaagacgucgccaccuacuacugccaacaauacugguccucacgcaccuucggcggcggcaccaaacucgaaaucaaacga

SEQ ID NO: 58178 - RNA, 321 nt, Artificial Sequence
  derived and/or modified sequence opt11 from anti-influenza_Chain
gacauccaaaugacccaaucccccuccuccuucuccgucucccucggcgaccgcgucaccaucaccugcaaagccuccgaagacaucuacaaccgcgucgccugguaccaacaaaaacccggcaacgccccccgccuccucauguccgacgccaccucccucggcgccggcguccccucccgcuucuccggcuccggcucaggcaaagaccacacccucuccaucaccucacuccaaaccgaagacgucgccacauacuacugccaacaauacuggaacacccgcaccuucggcggcggcaccaaacucgaaauaaaacgc

SEQ ID NO: 58179 - RNA, 321 nt, Artificial Sequence
  derived and/or modified sequence opt11 from anti-influenza_Chain
gacauccaaaugacccaaucccccuccucccucuccgccuccgucggcgaccgcgucaccaucaccugccgcgccucccaauccaucuccaccuaccucaacugguaccaacaaaaacccggcaucccccccaaacuccucaucaacgucgccuccucacuccaauccggcguccccucccgcuucuccggcuccggcuccggcaccgacuucacccucaccaucuccucccuccaacccgaagacuucgccuccuacuacugccaacaaaccuacuccuccccccccaccuucggccaaggcaccaaagucgaaaucaaa

SEQ ID NO: 58180 - RNA, 321 nt, Artificial Sequence
  derived and/or modified sequence opt11 from anti-influenza_Chain
gacauccaaaugacccaaucccccucaacccucuccggcuccgucggcgaccgcgucaccaucaccugccgcgccucccaaaacaucggccccuggcucgccugguaccaacaagaauccggcaaagcccccaaacuccucaucucccgcgccucaauccucgaauccggcguccccucccgcuucuccggcaccggcaccggcaccgaauucacccucaccaucuccucccuccaacccgacgacuucgccaccuacuacugccaacacuacaacgccuacuggggcaccuucggccaaggcaccaaagucgaaaucaac

SEQ ID NO: 58181 - RNA, 321 nt, Artificial Sequence
  derived and/or modified sequence opt11 from anti-influenza_Chain
gucaucuggaugacacaaucccccucucuccucuccgccuccaccggcgaccgcgucaccaucuccugccgcaugucccaaggcaucuccuccuaccuagccugguaccaacaaaaacccggcaaagcccccgaacuccucauccacaccgccuacacccucaaauccggcguccccucccgcuucuccggcuccggcucaggaaaagacuucacccucaccauauccggccuccaauccgaagacuucgccaccuacuacugccaacaauacuacuccuuccccuacaccuucggccaaggcaccaaagucgaaaucaaa

SEQ ID NO: 58182 - RNA, 321 nt, Artificial Sequence
  derived and/or modified sequence opt11 from anti-influenza_Chain
gacauccaaaugacccaaucccccuccuccgucuccgccuccgucggcgaccgcgucaccaucaccugccgcgccucccaagacgucuccaccuggcucgccugguaccaacucaaacccggcaaagcccccaaacuccucaucuacgccgccuccucccuccaauccggcguccccucccgcuucuccggcuccggcuccggcaccgacuucacccucaccgucuccucccuccaacccgaagacuucgccaccuacuacugccaacaagccaacuccuuccccuucaccuucggccccggcaccaaagucgacaucaaa

SEQ ID NO: 58183 - RNA, 321 nt, Artificial Sequence
  derived and/or modified sequence opt11 from anti-influenza_Chain
gacauccaacucacccaaucccccuccuuccucuccgccuccgucggcgacggcgucaccaucaccugccgcgccucccaagacaucuacaucuaccuagccugguaccaacaaaaacccggcaaagcccccaaacuccucaucuacgccgccuccacccuccaaggcggcguccccucccgcuucuccggcuccggcuccggcaccgaauucacccucaccaucaacaaccuccaacccgaagacuucgccaccuacuucugccaacaacucaacggcuacccccucaccuucggcggcggcaccaaagucgaaaucaaa

SEQ ID NO: 58184 - RNA, 321 nt, Artificial Sequence
  derived and/or modified sequence opt11 from anti-influenza_Chain
gauauccagcucacgcaaucgcccucgagcuugagcgcgagcgugggcgaucgcgugaccuugaccugucaagcgagccaggacauacgcaaguucuugaacugguaccagcaaaagcccgggaaagggcccaagcucuugaucuaugacgcgagcaaucuccagcgcggggucccgagcagguucucgggcgggggcucgggcacggacuuuaccuugaucauaagcucgcuccagcccgaggacgugggcacguacuauugccagcaauaugacgggcucccguucacguucgggggcgggaccaagcucgagaucaag

SEQ ID NO: 58185 - RNA, 321 nt, Artificial Sequence
  derived and/or modified sequence opt11 from anti-influenza_Chain
gacauccaacuaacccaaucucccuccucccucuccgccuccaucggcgaccgcgucaccaucaccugccaagccucccaagacauccgcaacucccucaacugguacgaacacaaacccggcaaagcccccaaacuccucauccacgacgccuccaaccucgaaaccggcguccccucccgcuucuccggcggcggcuccggcaccgacuucacccucaccaucuccucccuccaacccgaagacuucgccaccuacuacugccaacaagccaacuccuucccccucaccuucggcggcggcaccaaagucgaaaucaaa

SEQ ID NO: 58186 - RNA, 321 nt, Artificial Sequence
  derived and/or modified sequence opt11 from anti-influenza_Chain
gacauccaacucacccaaucccccuccucccucuccgccuccgucggcgaccgcgucaccaucaccugccgcgccucccaaggcauccgcaacgaccucggcugguaccaacaaaaacccggcaacgcccccaaacgccucaucuucggcgccuccucccuccaauccggcguccccucccgcuucucaggcuccggcuccggcaccgaauucacccucaccaucuccucccuccaacccgaagacuucgccaccuacuacugccuccaacacaacuccuaccccuacaccuucggccaaggcaccaaacucgaaaucaaa

SEQ ID NO: 58187 - RNA, 321 nt, Artificial Sequence
  derived and/or modified sequence opt11 from anti-influenza_Chain
gacauccaacucacccaaucccccuccucccucuccgcauccgucggcgaccgcgucaccaucaccugccgcgccucacaauccaucucccgcuaccucaacugguaccaacaaaaacccggcaaagcccccaaacuccuccucuucgccgccuccacccuccucgacggcguccccucccgcuucuccggcuccggcuccggcaccgacuucacccucaccaucuccucccuccaacccgaagacuucgccaccuacuacugccaacgcaaccacucccccuccuggaccuucggccaaggcacccgcgucgaaaucaaa

SEQ ID NO: 58188 - RNA, 321 nt, Artificial Sequence
  derived and/or modified sequence opt11 from anti-influenza_Chain
gacauccaaaugacccaaucccccuccucccucuccgccuccgucggcgaccgcgucaccaugacaugccgcgccucccaaaacauccgcuccuaccucaacugguaccaacaacgccccggcaccgcccccaaacuccucaucuacgccgccuccacccuccacuccggcguccccucccgcuucuccggcggcggcuccggcaccgacuucacccucaccaucaacaaccuccaacccgaagacuucgccuccuacuacugccaacaauccuacgacaacccccaaaccuucggccaaggcaccaaagucgaaaucaaa

SEQ ID NO: 58189 - RNA, 321 nt, Artificial Sequence
  derived and/or modified sequence opt11 from anti-influenza_Chain
gacauccaaaugacccaaucccccuccucccucuccgccuccgucggcgaccgagucaccaucacaugccgcgccaaccaagacaucggcaucuaccucaacugguaccaacaaaaccccggcaaaguccccaaacuccuccuccacggcgccuccucccuccaaggcggcguccccucccgauucucagccuccggcuccggcaccgacuucacccucaccauccacucccuccaacccgaagaccucgccaccuacuacugccaacaaucccgccgccuccccuacaccuucggccaaggcacccgcgucgaacucaaa

SEQ ID NO: 58190 - RNA, 321 nt, Artificial Sequence
  derived and/or modified sequence opt11 from anti-influenza_Chain
gacauccaaaugacccaaucccccuccacccucuccgccuccaucggcgaccgcgucaccaucaccugccgcgccucccaauccaucgccuccuggcucgccugguaccaacaaaaacccggcaaagcccccaaacuccucaucuacgaagccgucaaccucgaauccggcguccccucccgcuucuccggcucaggcuccggcaccgacuucacccucaccaucuccucccuccaacccgacgacuucgccaccuacuucugccaacacuacggcaccaucucccaaaccuucggcggcggcaccaaagucgaaaucaaa

SEQ ID NO: 58191 - RNA, 321 nt, Artificial Sequence
  derived and/or modified sequence opt11 from anti-influenza_Chain
gacauccaaaugacccaaucccccuccucccucuccgccuccgucggcgaccgcgucaccaucaccugccgcgccucccaauccaucuccuccuaccucaacugguaccaacacaaacccggcaaagcccccaaaguccucauguacgccgucuccauccuccaauccggcguccccucccgcuucuccggcuccggcuccggcgccgacuucacccucaccaucuccucccuccaacccgaagacuucgccaccuacuacugccaacaauccuacuccuccccccucaccuucggcggcggcaccaaagucgaaaucaaa

SEQ ID NO: 58192 - RNA, 321 nt, Artificial Sequence
  derived and/or modified sequence opt11 from anti-influenza_Chain
gacauccaaaugacccaaucccccuccucccucuccgccuccgucggcgaccgcgucaccaucaccugccgcgccucccaaaacaucaaacgcuacuucaacugguaccaacaaaaacccggcaaagcccccaaacuccucaucuacgccgccuccaaccucgaaaacggcguccccucccgcuucuccggcuccggcuccggcaccgacuucacccucaccaucuccucccuccaacccgaagacuucgccaccuacuacugccaacaauccuucuccaaauccuggaccuucggccaaggcaccaacgucgacaucaaa

SEQ ID NO: 58193 - RNA, 321 nt, Artificial Sequence
  derived and/or modified sequence opt11 from anti-influenza_Chain
gacauccaaaugacccaauccccauccucccucuccgccuccgucggcgaccgcgucaccaucaccugccgcgccucccaaaacaucuacaaauaccucaacugguaccaacaacgccccggcaaagcccccaaaggccucaucuccgccgccuccggccuccaauccggcguccccucccgcuucuccggcuccggcuccggcaccgacuucacccucaccaucaccucccuccaacccgaagacuucgccaccuacuacugccaacaauccuacucccccccccucaccuucggcggcggcacccgcgucgaaaucaaa

SEQ ID NO: 58194 - RNA, 321 nt, Artificial Sequence
  derived and/or modified sequence opt11 from anti-influenza_Chain
gacauccaaaugacccaaucccccuccucccucuccucauccgucggcgaccgcgucaccaucaccugccgcgccucccaauccaucggcgccuacgucaacugguaccaacaaaaagccggcaaagccccccaaguccucaucuucggcgccuccaaccuccaauccggcguccccucccgcuucuccggcuccggauccggcaccgacuucacccucaccaucuccucccuccaacccgaagacuucgccaccuacuucugccaacaaaccuacuccacccccaucaccuucggccaaggcacccgccucgaaaucaaa

SEQ ID NO: 58195 - RNA, 321 nt, Artificial Sequence
  derived and/or modified sequence opt11 from anti-influenza_Chain
gacauccaaaugacccaaucccccuccucccucuccgccuccgucggcgaccgcgucaccaucuccugccgcgccucccaauccaucuccaccuaccucaacugguaccaacaacaacccggcaaagcccccaaaguccucaucuucggcgccaccaaccuccaauccggcguccccucccgcuucuccggauccggcuccggcaccgacuucacccucaccaucuccucccuccaacccgaagacuucgccaccuacuacugccaacaauccuacaacaccccccucaucuucggccaaggcaccaaacucgaaaucaaa

SEQ ID NO: 58196 - RNA, 321 nt, Artificial Sequence
  derived and/or modified sequence opt11 from anti-influenza_Chain
gacauccaaaugacccaaucccccuccucccucuccgccuccgucggcgaccgcgucaccaucuccugccgcgccucccaauccaucuccaccuaccucaacugguaccaacaacaacccggcaaagcccccaaaguccucaucuccggcgccaccaaccuccaauccggcguccccucccgcuucuccggcuccggcuccggcaccgacuucacccucaccaucuccucccuccaacccgaagacuucgccaccuacuacugccaacaauccuacaacaccccccucaucuucggccaaggcaccaaacucgaaaucaaa

SEQ ID NO: 58197 - RNA, 321 nt, Artificial Sequence
  derived and/or modified sequence opt11 from anti-influenza_Chain
gacauccaaaugacccaaucccccuccucccucuccgccuccgucggcgaccgccucaccaucaccugccgcgccucccaauccaucuccaccuaccuccacugguaccaacaaaaacccggcaaagcccccaaacuccucaucuacgccgccuccucccuccaaucaggcguccccucccgcuucucaggcucccgcuccggcaccgacuucacccucaccaucuccucccuccaacccgacgacuucgccaccuacuacugccaacaauccuacucacccccccucaccuucggccccggcaccaaagucgacaugaaa

SEQ ID NO: 58198 - RNA, 321 nt, Artificial Sequence
  derived and/or modified sequence opt11 from anti-influenza_Chain
gacauccaaaugacccaaucccccuccucccucuccgccuccgucggcgaccgcgucaccaucaccugccgcgccucccaauccaucuccaacuaccucaacugguaccaacacaaacccggcgaagcccccaaacuccucaacuacgccgccuccucccuccaauccggcguccccucccgcuucuccgccuccggcuccggcaccgacuucacccucaccaucuccucccuccaacccgaagacuucgccaccuacuacugccaacaauccuacaacacccccaucaccuucggacaaggcacccgccucgaaaucaaa

SEQ ID NO: 58199 - RNA, 321 nt, Artificial Sequence
  derived and/or modified sequence opt11 from anti-influenza_Chain
gacauccaaaugacccaaucacccuccucccucuccgccuccgucggcgaccgcgucaccaucaccugccgcgccucccaauccaucuccaacuaccucaacugguaccaacacaaacccggcgaagcacccaaacuccucaacuacgccgccuccucccuccaauccggcguccccucccgauucuccgccuccggcuccggcaccgacuucacccucuccaucuccggccuccaacccgaagacuucgccaccuacuacugccaacaauccuacaacacccccaucaccuucggccccggcacccgccucgaaaucaaa

SEQ ID NO: 58200 - RNA, 321 nt, Artificial Sequence
  derived and/or modified sequence opt11 from anti-influenza_Chain
gacauccaaaugacccaaucccccucaucccucuccgccuccgucggcgaccgcgucaccaucaccugccgcgccucccaauccaucuccaccuaccucaacugguaccaacaaaaacccggcaaagcccccaaacuccucaucuacgccgccuccucccuccacuccggcguccccucccgcuucuccggcuccggcuccggcaccgacuucgcccucaccaucuccucccuccaacccgaagacuucgccaccuacuacugccaacaauccuacuccccccccaucaccuucggccaaggcacccgacucgaaaucaaa

SEQ ID NO: 58201 - RNA, 321 nt, Artificial Sequence
  derived and/or modified sequence opt11 from anti-influenza_Chain
gacauccaaaugacccaaucccccuccucccucuccgcauccgucggcgaccgcgucaccaucaccugccgcgccucccaaaccaucuccaccuaccucaacugguaccaacaaaaauccggcaaagcccccaaacuccucaucuacgccgccuccggccuccaauccggcguccccucccgcuucuccggcuccggcuccggcaccgacuucacccucaccaucuccucccuccaacccgaagacuucgccaccuacuucugccaacaauccuacaacaccccccucaccuucggccaaggcaccaaagucgaaaucaaa

SEQ ID NO: 58202 - RNA, 321 nt, Artificial Sequence
  derived and/or modified sequence opt11 from anti-influenza_Chain
gacauccaaaugacccaaucccccuccucccucuccgccuccgucggcgaccgcgucaccaucuccugccgcgccucccaauccaucuccaccuaccucaacugguaccaacaacaacccggcaaagcccccaaaguccucaucuccggcgccaccgaccuccaauccggcguccccucccgcuucuccggcuccggcuccggcaccgacuucacccucaccaucuccucccuccaacccgaagacuucgccaccuacuacugccaacaauccuacaacaccccccucaucuucggccaaggcaccaaacuagaaaucaaa

SEQ ID NO: 58203 - RNA, 321 nt, Artificial Sequence
  derived and/or modified sequence opt11 from anti-influenza_Chain
gacauccaagucacccaaucccccuccucccucuccgccuccgucggcgaccgcgucaccaucaccugccgcgccucccaaaacaucuacaaauaccucaacugguaccaacaacgccccggcaaagcccccaaaggccucaucuccgccgccucaggccuccaauccggcguccccucccgcuucuccggcucaggcuccggcaccgacuucacccucaccaucaccucccuccaacccgaagacuucgccaccuacuacugccaacaauccuacucccccccccucaccuucggcggcggcacccgcgucgacaucaaa

SEQ ID NO: 58204 - RNA, 321 nt, Artificial Sequence
  derived and/or modified sequence opt11 from anti-influenza_Chain
caauccguccucacccaaccccccuccgaauccgucucccccggccaaaccgccuccgucaccugcuccggccacaaacucggcgacaaauacgucuccugguaccaacaaaaacccggccaaucccccguccuccucaucuaccaagacaaccgccgccccuccggcauccccgaacgcuucaucggcucaaacuccggcaacaccgccacccucaccaucuccggcacccaagcccucgacgaagccgacuacuacugccaagccugggacuccuccaccgccguauucggcggcggcaccaaacucaccguccucggc

SEQ ID NO: 58205 - RNA, 321 nt, Artificial Sequence
  derived and/or modified sequence opt11 from anti-influenza_Chain
gacauccaacucacccaaucccccuccucccucuccgccuccgucggcgaccgcgucaccaucaccugccgcgccucccaaggcaucuccaccuaccucgccugguaccaacaaaaacccggcaaaguccccaaacuccucaucuacgccgccuccacccuccaauccggcguccccucccgcuucuccggcuccggcuccggcaccgacuucacccucaccaucuccucccuccaacccgaagacgucgccaccuacuacugccaaaaauacaacuccgcccccuccuucggccccggcaccaaagucgacaucaaacgc

SEQ ID NO: 58206 - RNA, 321 nt, Artificial Sequence
  derived and/or modified sequence opt11 from anti-influenza_Chain
uccguccucacccaaccccccuccgccuccggcucccgcggccaauccaucaccaucuccugcaccggcuccaccuccgacaucggcuccuacaacuacgucuccugguaccaacaacaccccggcaccgcccccaaagucauccucuacgaagucucccaacgccccuccggcguccccgaccgcuucuccggcuccaaauccggcaacaccgccuuccucaccgucuccggccuccaagccgaagacgaagccgacuacuacugcgccuccuacgccggcaacaacaucuacgucuucggcuccggcaccaaagucacc

SEQ ID NO: 58207 - RNA, 321 nt, Artificial Sequence
  derived and/or modified sequence opt11 from anti-influenza_Chain
uccgcccucacccaaccccccuccgccuccggcucccgcggccaauccaucaccaucuccugcaccggcuccaccuccgacaucggcuccuacaacuacgucuccugguaccaacaacaccccggcaccgcccccaaagucauccucuacgaagucucccaacgccccuccggcguccccgaccgcuucuccggcuccaaauccggcaacaccgccuuccucaccgucuccggccuccaagccgaagacgaagccgacuacuacugcgccuccuacgccggcaacaacaucuacgucuucggcuccggcaccaaagucacc

SEQ ID NO: 58208 - RNA, 321 nt, Artificial Sequence
  derived and/or modified sequence opt11 from anti-influenza_Chain
gaaaucguccucacccaaucccccgccacccucucccucucccccggcgaacgcgccacccucuccugccgcgccucccaauccgucuccaccuuccucgccugguaccaacaaaaacccggccaagccccccgacuccucauguacgacgccuccaaccgcgccaccggcauccccgcccgcuucucaggcuccggcuccggcaccgacuucacccucaccaucuccucccucgaacccgaagacuucgccaucuacuacugccaacaacgcucccacuggccccccaucuucggccaaggcacccgccucgaaaucaaa

SEQ ID NO: 58209 - RNA, 321 nt, Artificial Sequence
  derived and/or modified sequence opt11 from anti-influenza_Chain
gacauccaaaugacccaaucccccgccucccucuccgucuccgucggcgaaaccgucaccaucaccugccgcgccucagaaaaaaucuacuccaaccucgccugguaccaacaaaaagaaggcaaauccccccaacuccucgucuacgccgccauccgccucgccgacggcguccccucccgcuucuccggcuccggcuccggcacccaauucucccucaaaaucaacucccuccaauccgaagacuucggcaccuacuacugccaacacuucuggggcaccccccucaccuucggcgccggcaccaaacucgaacucaaa

SEQ ID NO: 58210 - RNA, 321 nt, Artificial Sequence
  derived and/or modified sequence opt11 from anti-influenza_Chain
gacauccaaaugacccaaucccccuccuccgucuccgccuccgucggcgaccgcgucaccaucaccugccgcgccucccaagacaucuccaccuggcucgccugguaccaacaaaaacccggcaaagcccccaaacuccucaucuacgccgccuccucccuccaauccggcguccccucccgcuucuccggcuccggcuccggcaccgacuucacccucaccaucuccucccuccaacccgaagacuucgccaccuacuucugccaacaagccaacuccuucccccccaccuucggccaaggcaccaaacucgaaaucaaa

SEQ ID NO: 58211 - RNA, 321 nt, Artificial Sequence
  derived and/or modified sequence opt11 from anti-influenza_Chain
gacauccaaaugacccaaucccccuccuccgucuccgccuccgucggcgaccgcgucaccaucaccugccgcgccucccaagacaucuccaccuggcucgccugguaccaacaaaaacccggcaaagcccccaaacuccucaucuacgccgccuccucccuccaauccggcguccccucccgcuucuccggcuccggcuccggcaccgacuucacccuaaccaucuccucccuccaacccgaagacuucgccaccuacuucugccaacaagccaacuccuucccccccaccuucggcugcggcaccaaacucgaaaucaaa

SEQ ID NO: 58212 - RNA, 321 nt, Artificial Sequence
  derived and/or modified sequence opt11 from anti-influenza_Chain
gacauccaaaugacccaaucccccuccuccgucuccgccuccgucggcgaccgcgucaccaucaccugccgcgccucccaagacaucuccaccuggcucgccugguaccaacaaaaacccggcaaaugccccaaacuccucaucuacgccgccuccucccuccaauccggcguccccucccgcuucuccggcuccggcuccggcaccgacuucacccucaccaucuccucccuccaacccgaagacuucgccaccuacuucugccaacaagccaacuccuucccccccaccuucggccaaggcaccaaacucgaaaucaaa

SEQ ID NO: 58213 - RNA, 321 nt, Artificial Sequence
  derived and/or modified sequence opt11 from anti-influenza_Chain
gacauccaaaugacccaaucccccuccuccgucuccgccuccgucggcgaccgcgucaccaucaccugccgcgccucccaagacaucuccaccuggcucgccugguaccaacaaaaacccggcaaagcccccaaacuccucaucuacgccgccuccucccuccaauccggcguccccucccgcuucuccggcuccggcuccggcaccgacuucacccucaccaucuccucccuccaacccgaagacuucgccaccuacuacugccaacaagccaacuccuucccccccaccuucggccaaggcaccaaacucgaaaucaaa

SEQ ID NO: 58214 - RNA, 321 nt, Artificial Sequence
  derived and/or modified sequence opt11 from anti-influenza_Chain
gacauccaaaugacccaaucccccuccuccgucuccgccuccgucggcgaccgcgucaccaucaccugccgcgccucccaagacaucuccaccuggcucgccugguaccaacaaaaacccggcaaagcccccaaacuccucaucuacgccgcauccucccuccaauccggcguccccucccgcuucuccggcuccggcuccggcaccgacuucacccucaccaucuccucccuccaacccgaagacuucgccaccuacuacugccaacaagccaacuccuucccccccaccuucggcugcggcaccaaacucgaaaucaaa

SEQ ID NO: 58215 - RNA, 321 nt, Artificial Sequence
  derived and/or modified sequence opt11 from anti-influenza_Chain
gacauccaaaugacccaaucccccuccuccgucuccgccuccguaggcgaccgcgucaccaucaccugccgcgccucccaagacaucuccaccuggcucgccugguaccaacaaaaacccggcaaaugccccaaacuccucaucuacgccgccuccucccuccaauccggcguccccucccgcuucuccggcuccggcuccggcaccgacuucacccucaccaucuccucccuccaacccgaagacuucgccaccuacuacugccaacaagccaacuccuucccccccaccuucggccaaggcaccaaacucgaaaucaaa

SEQ ID NO: 58216 - RNA, 321 nt, Artificial Sequence
  derived and/or modified sequence opt11 from anti-influenza_Chain
gaaaucguccucacccaaucccccgccacccucucccucucccccggcgaacgcgccacccucuccugccgcgcaucccgcuccaucaccaccuuccucgccugguaccaacaaaaacccggccaagccccccgccuccucaucuacgacgccuccaaccgcgccaccggcguccccgcccgauucuccggcuccggcuccggcaccgacuucacccucaccaucaacucccucgaacccgacgacuucgccaucuacuacugccaacaacgcgaccacuggccccccaucuucggccaaggcacccgccucgaaaucaaa

SEQ ID NO: 58217 - RNA, 321 nt, Artificial Sequence
  derived and/or modified sequence opt11 from anti-influenza_Chain
gaaaucguccucacacaaucccccgccacccucucccucucccccggcgaacgcgccacccucuccugccgcgccucccgcuccaucaccaccuuccucgccugguaccaacaaaaacccggccaagccccccgccuacucaucuacgacgccuccaaccgcgccaccggcguccccgcccgcuucuccggcuccggcucaggcaccgacuucacccucaccaucaacucccucgaacccgacgacuucgccaucuacuacugccaacaacgcgaccacuggccccccaucuucggcugcggcacccgccucgaaaucaaa

SEQ ID NO: 58218 - RNA, 324 nt, Artificial Sequence
  derived and/or modified sequence opt11 from anti-influenza_Chain
gaaaucguccucacccaaucccccggcacccucucccucucccccggcgaacgcgccacccucuccugccgcgccucccaaaccgucuccuccuccuaccucgccugguaccaacaaaaacccggccaagccccccgccuccucaucuacggcgccuccucccgcgccaccggcauccccgaccgcuucuccggauccggcuccggcaccgacuucacccucaccaucucccgacucgaacccgaagacuucgccgucuacuacugccaacaauacggcaacucccccuacaccuucggccaaggcaccaaacucgaaaucaaa

SEQ ID NO: 58219 - RNA, 324 nt, Artificial Sequence
  derived and/or modified sequence opt11 from anti-influenza_Chain
gaaaucguccucacccaaucccccggcacccucuccgucucccccggcgaacgcgccacccucuccugccgcgccucccaauccaucuccuccggcuaccucgccugguaccaacaaaaacccggccaagccccccgccuccucaucuacggcgccuccucccgcgccaccggcauccccgaccgauucuccggcuccggcuccggcaccgacuucacccucaccaucucccgccucgaacccgaagacuucgccgucuacuacugccaacaauacggcaccuccccccaaaccuucggccaaggcaccaaagucgaaaucaaa

SEQ ID NO: 58220 - RNA, 324 nt, Artificial Sequence
  derived and/or modified sequence opt11 from anti-influenza_Chain
gaagucguccucacccaaucccccggcacccucucccucucccccggccaacgcgccacccucuccugccgcgccucccaauccgucuccuccuccuaccucgccugguaccaacaaaaacccggccaagccccccgccuccucaucuacgacgccucaaaccgcgccaccggcauccccgaccgcuucuccggcuccggcuccggcaccgacuucacccucaccaucucccgccucgaacccgaagacuucgccgucuacuacugccaacaauacggcuccucccccuacaccuucggccaaggcaccaaacucgaaaucaaa

SEQ ID NO: 58221 - RNA, 324 nt, Artificial Sequence
  derived and/or modified sequence opt11 from anti-influenza_Chain
gacauccaacucacccaaucacccuccucccucuccgccuccgucggcgaccgcgucaccaucaccugccgcgccucccaaggcaucaucaccuaccucaacugguaccaacaaaaacccggcaaagcccccaaacuccucaucuacgccaccuacucccuccaaaacggcguccccucccgcuucuccggcuccggcuccggcaccgacuucacccucaccaucuccucccuccaacccgaagacuucgccaccuacuacugccaacaauccuacuccucccucauguucaccuucggccaaggcaccaaacucgacaucaaa

SEQ ID NO: 58222 - RNA, 324 nt, Artificial Sequence
  derived and/or modified sequence opt11 from anti-influenza_Chain
gaaaccguccucacccaaucacccggcacccucucccucacccccggcgaacgcgccacccucuccugccgcgucggccaauccgucuccggcucccaccucgccugguaccaacaaaaacccggccaagccccccgccuccucaucuacggcgccuccucccgcgccaccggcauccccgaccgcuucggcggcucagucuccggcaccgacuucacccucaccaucucccgccucgaacccgaagacuccgccgucuacuacugccaacaauacggcgacucccgcuacaccuucggccaaggcaccaaacucgaaaucaaa

SEQ ID NO: 58223 - RNA, 324 nt, Artificial Sequence
  derived and/or modified sequence opt11 from anti-influenza_Chain
gaaaucguccucacccaaucccccggcacccucucccucucccccggcgaacgcgccacccucuccugccgcgccucccaauccgucuccuccucccaacucgccugguaccaacaaaaacccggccaagccccccgccucaucaucuacggcgccuccacccgcgccaccggcauccccgaccgcuucuccggcuccggcuccggcaccgacuucacccucaccaucggccgccucgaacccgaagacuucgccgucuucuucugccaacaauacuccaccuccccccccaccuucggccaaggcaccaaagucgacuucaaa

SEQ ID NO: 58224 - RNA, 324 nt, Artificial Sequence
  derived and/or modified sequence opt11 from anti-influenza_Chain
gacaucguccucacccaaucccccggcacccucucccucucccccggcgaacgagccacccucuccugccgcgccucccaaucagucuccuccuccuaccucgccugguaccaacaaaaacccggccaagccccacgccucgucauguacggcgccgccacccgagccaccggcauccccgaccgcuucuccggcuccggcuccggccccgacuucacccucaccaucucccgccucgaacccgaagacuucgccauguacuacugccaacaauacggcaacucccccaucaccuucggccaaggcacccgccucgaaaucaaa

SEQ ID NO: 58225 - RNA, 324 nt, Artificial Sequence
  derived and/or modified sequence opt11 from anti-influenza_Chain
gaaaucguacucacccaaucccccgccacccucucccucucccccggcgaacgcgccacccucuccugccgcgccucccaauccgucuccuccuaccucgccugguaccaacaaaaacccggccaagccccccgccuccucaucuacgacgccuccaaccgcgccaccggcauccccgcccgcuucuccggcuccggcuccggcaccgacuucacccucaccaucuccucccucgaacccgaagacuucgccgucuacuacugccaacaacgcucccacuggccccccaucaccuucggccaaggcacccgccucgaaaucaaa

SEQ ID NO: 58226 - RNA, 324 nt, Artificial Sequence
  derived and/or modified sequence opt11 from anti-influenza_Chain
uccuacgaacucacccaaccccccuccgucuccgucucacccggccaaaccgcccgcaucaccugcuccggcgacgcccuccccaaacaaaacgccuacugguaccaacaaaaacccggccaagcccccguccuccucaucuacaaagacuccgaacgccccuccggcauccccgaacgcuucuccggcuccuccuccggcaccaccgucacccuaaccaucuccggcguccaagccgaagacgaagccgacuacuacugccaauccgccgacuccuccggcaccuccugggucuucggcggcggcaccaaacucaccguccuc

SEQ ID NO: 58227 - RNA, 324 nt, Artificial Sequence
  derived and/or modified sequence opt11 from anti-influenza_Chain
uccuacguacucacccaagcccccuccgucuccgucgcccccggccaaaccgcccgcaucaccugcggcggcaacgccaucggcucaaaaaaaguccacugguaccaacacaaagccggccaagcccccguccucgucgucuacgacgacaccgaccgccccuccggcauccccgaacgcuucuccggcuccaacuccuggucaaccgccacccucaccaucaaccgagucgaagccggcgacgaagccgacuacuacugccaagucugggacuucaccaucgaccacgucgucuucggcggcggcaccaaacucaccguccuc

SEQ ID NO: 58228 - RNA, 324 nt, Artificial Sequence
  derived and/or modified sequence opt11 from anti-influenza_Chain
gaaaucguccucacccaaucccccggcacccucucccucucccccggcgaacgcgccacccucuccugccgcgccucccaauccgucuccuccuccuaccucgccugguaccaaaaaaaacccggccaagccccccgccuccucaucuacggcgccuccacccgcgccaccggcauccccgaccgcuucaccggcuccggcuccggcaccgacuucacccucuccaucucccgccucgaacccgaagacuucgccgucuacuacugccaacacuucggcaccuccgucuucaccuucggcggcggcaccaaagucgaaaucaaa

SEQ ID NO: 58229 - RNA, 324 nt, Artificial Sequence
  derived and/or modified sequence opt11 from anti-influenza_Chain
gaaaucgucaugacccaaucccccgccacccucuccgucucccccggcgaacgcgccacccucuccugccgcgccucccaaucagucggcaacucccucgccugguaccaacaacgccccggccaagccccccgccuccucaucuacggcgccucaacccgcgccaccggcauccccccccgcuucucaggcuccggcuccggcaccgaauucacccucaccaucuccucccuccaaaccgaagacuucgccgucuacuacugccaacaauacaucaacuggcgcccccucuccuucggcggcggcaccaaagucgaaaucaaa

SEQ ID NO: 58230 - RNA, 324 nt, Artificial Sequence
  derived and/or modified sequence opt11 from anti-influenza_Chain
caagagagcggggccgagcucgugcgcccgggcgcgagcgugaaauugagcuguaaagauagcggguacacguucacgaccuauuggaugaacugggucaagcaaaggcccgagcaagggcucgaguggauaggcaggaucgaucccuaugacucggaaacgcacuauaaccagaaauuuaaagauaaagcgaucuugaccguggacaagagcucgaacacggccuauaugcagcucagcucauugaccucggaagauagcgcggucuauuacugugucaggggcgggagcacggucgcguacuuuggcgugugggggcaaggg

SEQ ID NO: 58231 - RNA, 324 nt, Artificial Sequence
  derived and/or modified sequence opt11 from anti-influenza_Chain
gagaucgugcucacgcaaucgcccgggaccuugagcuuaagcccgggcgagcgcgcgaccuugagcugucgcgcaagccagcgcgugagcucguacuuggccugguaccagcaaaagcccgggcaagcgcccaggcucuugaucuauggcgcgagcacgcgcgcggccgggaucccggacagguucucgggcucgggcucgggcacggacuuuaccuugaccauaagcaggcucgagcccgaggacucggccguguacuauugccagcaauauggcaggaccccgcucacguucgggggcgggaccaaggucgagaucaagcgc

SEQ ID NO: 58232 - RNA, 324 nt, Artificial Sequence
  derived and/or modified sequence opt11 from anti-influenza_Chain
gagaucgugaugacgcaaucgcccgggaccuugagcuugagcccgggcgagcgcgcaaccuugagcugucgcgcgagccagagcgugagcucgagcuaucucgcgugguaucaacagaaaccgggccaggccccgcgauugcucauauucggggccucgagcagggccacgggcauacccgaucgcuuuagcgggagcgggagcgggaccgauuucacgcucacgaucucgcgcuuggaaccggaagauuucgcggucuauuacugucaacaguacgggagcucgcucacguucgggggcgggaccaagcucgagaucaagcgc

SEQ ID NO: 58233 - RNA, 324 nt, Artificial Sequence
  derived and/or modified sequence opt11 from anti-influenza_Chain
gaaaucguccucuaccaaucccccggcacccucucccucucccccggcgaacgcgccacccucuccugccgcgccucccaacgcgucuccuccuaccucgccugguaccaacaaaaacccggccaagcaccccgccuccucaucuacggcgccuccacccgcgccgccggcauccccgaccgcuucuccggcuccggcuccggcaccgacuucacccucaccaucucccgccucgaacccgaagacuccgccgucuacuacugccaacaauacggccgcaccccccuaaccuucggcggcggcaccaaagucgaaaucaaacgc

SEQ ID NO: 58234 - RNA, 324 nt, Artificial Sequence
  derived and/or modified sequence opt11 from anti-influenza_Chain
gacaucguccucacccaagcccccuccgucuccgucucccccggccaaaccgccuccaucaccugcuccggcgaccgccucggcgaaaaauucgccuccugguaccaacaaaaacccggccaaucccccguccucgucaucuacgaagacuccaaacgccccuccggcauccccgaccgcuucuccggcuccaacuccggcaacaccgccacccucaccaucuccggcacccaaaucauggacgaaggcgacuucuucugccaagccugggacuccuccaccgucguauucggcggcggcaccaaacucaccguccucggccaa

SEQ ID NO: 58235 - RNA, 324 nt, Artificial Sequence
  derived and/or modified sequence opt11 from anti-influenza_Chain
gacaucgaacucacccaaucccccuccgucuccgucucccccggccaaaccgccuccaucaccugcuccggcgacaaacucggcgacaaauucgucugcugguaccaacaaaaagccggccaaucccccaucgucgucaucuaccaagacgacaaacgccccuccggcauccccgaacgcuucuccggcuccaacuccggcaacaccgccacccucaccaucuccggcacccaagccauggacgaagccgacuacuucugccaagccugggacuccaccaccgucgucuucggcggcggcaccaaacuaaccguccucggccaa

SEQ ID NO: 58236 - RNA, 324 nt, Artificial Sequence
  derived and/or modified sequence opt11 from anti-influenza_Chain
caauccguccucacccaaccacccuccgccuccggcucccgcggccaauccaucaccaucuccugcaccggcuccaccuccgacaucggcuccuacaacuacgucuccugguaccaacaacaccccggcaccgcccccaaagucauccucuacgaagucucacaacgccccuccggcguccccgaccgcuucucaggcuccaaauccggcaacaccgccuuccucaccgucuccggccuccaaaccgacgacgaagccgacuacuacugcgccuccuacgccggcaacaacaucuacgucuucggcuccggcaccaaagucacc

SEQ ID NO: 58237 - RNA, 327 nt, Artificial Sequence
  derived and/or modified sequence opt11 from anti-influenza_Chain
aacuucaugcucacccaaccccacuccgucuccgaaucccccggcaaaaccgucaccaucuccugcaccggcuccggcggcaacaucgcccgcaacuacguccaaugguaccaacaacgccccggcuccgcccccguaaccgucauccucgaagacgacaaacgccccuccggcauccccgaccgcuucuccggcuccaucgaccgcucauccaacuccgccucccucaccaucuccggccuccgaaccgaagacgaagcccucuacuacugccaauccuacgacgacuccgaccucgucgucuucggcggcggcaccaaacucacc

SEQ ID NO: 58238 - RNA, 327 nt, Artificial Sequence
  derived and/or modified sequence opt11 from anti-influenza_Chain
augcucgaaccccuccaaauccucuccaucugcuccuucauccucuccgcccuccacuucauggccuggaccaucggccaccucaaccaaaucaaacgcggcgucaaccucaaaauccaaauccgcaaccccaacaaagaagccaucaaccgcgaagucuccauccuccgccacaacuaccaaaaagaaauccaagccaaagaaaccaugaaaaaaauccucuccgacaacauggaaguccucggcgaccacaucgucgucgaaggccucuccaccgacgaaaucaucaaaaugggcgaaaccguccucgaagucgaagaacuccaa

SEQ ID NO: 58239 - RNA, 327 nt, Artificial Sequence
  derived and/or modified sequence opt11 from anti-influenza_Chain
gacauccgccucacccaaucccccgccacccucuccgucucccccggcgaacgagccacccucuccugccgcgccucccacuccgucucccgcaaccucgccugguaccaacaaaaacccggccgcgccccccgccuccucgucuacgacaccuccucccgagccaccggcauccccgcccgcuucuccggcuccggcuccggcaccgaauucacccucaccaucuccucccuccaauccgaagacuucgccgucuacuacugccaacaauacaacaacuggccccgcaccuucggccaaggcaccaaagucgacaucaaacgcacc

SEQ ID NO: 58240 - RNA, 327 nt, Artificial Sequence
  derived and/or modified sequence opt11 from anti-influenza_Chain
gaaaucguaaugacacaaucacccggaacccuaagccuaagcccaggcgaacgcgcaacccugagcugccgcgcaagccaaagcguaagcucgagcuaccucgcaugguaccaacaaaaaccaggccaggccccacgccuacucauauacggggccucaaccagagccacaggcguacccgaccgcuuccacggaggcggaagcggaaccgacuucacacucacaaucucgcgccuagaaccggaagacuucgcagucuacuacugccaacaauacgacaccucaagcggacucacauucggaggcggaaccaaagucgaaaucaaa

SEQ ID NO: 58241 - RNA, 327 nt, Artificial Sequence
  derived and/or modified sequence opt11 from anti-influenza_Chain
gaaaucgucaugacccaauuccccgccacccucuccgucucccccggcgaacgagucacccuauccugccgcgccucccaauccgucuccaacaaccucgccugguaccaacaaaaacccggccaacccccccgacuccucaucuacgacgccuccacccgcgccaccggcguccccgccaaauucuccggcaccggcuccggcaccgaauucacccucuccaucuccucccuccaauccgaagacuucgcagucuacuacugccaacaauaccacaacuggccccccuccuacuccuucggccucggcaccaaacucgaaaucaaa

SEQ ID NO: 58242 - RNA, 327 nt, Artificial Sequence
  derived and/or modified sequence opt11 from anti-influenza_Chain
gaaaucauccucgcccaaucccccggcacccucucccuaucccccggcgaacgcgccacccucuccugccgcgccucccaauucgucuccacccgcucacucgccugguaccaacaacgccccggccaagccccacgccuccucaucuacggcgccucaucccgagccaccggcauccccgaccgcuucuccggcuccggcuccggcaccgacuucacccucaccaucucccgccuagaacccgaagacuucgccgucuacuacugccaacacuacggcuacucaccccgcuacgccuucggccaaggcuccaaagucgaaaucaaa

SEQ ID NO: 58243 - RNA, 327 nt, Artificial Sequence
  derived and/or modified sequence opt11 from anti-influenza_Chain
gaaaucguccucacccaaucccccggcacccucucccucucccccggcgaacgcgccacccucuccugccgcgccucccacuucgucaacuaccgcucccucgccugguaccaacaaacccccggccaagucccccgccuccucaucuacggcgccuccacccgcgccaccggcauccccgaccgcuucuccggcuccggcuccggcaccgacuucacccucaccaucucccgccucgaacccgaagacuucgccgucuacuucugccaacaauacggcggcuccccccgcuacaccuucggccaaggcacccgccucgaaaucaaa

SEQ ID NO: 58244 - RNA, 327 nt, Artificial Sequence
  derived and/or modified sequence opt11 from anti-influenza_Chain
gaaaucguccucacccaaucccccggcacccucucccucucacccggcgaacgcgccacccucuccugccgcgccucccacuucgucaucggacgcgccgucgccugguaccaacaaaaacccggccaagccccccgccuccucaucuacggcgccuccucccgcgccaccggcauccccgaccgcuucuccggcuccggcuccggcaccgacuucacacucaccaucucccgccucgaaaccgaagacuucgccgucuucuacugccaacacuacggcuccuccccccgcuacgccuucggccaaggcaccaaacucgaaaucaaa

SEQ ID NO: 58245 - RNA, 327 nt, Artificial Sequence
  derived and/or modified sequence opt11 from anti-influenza_Chain
gaaaucguccucacccaaucccccgccacccucucccucucccccggcgaacgcgccacccucuccugccgcgcaucccaauccgucggcaacuaccucgccugguaccaacaaaaacccggccaagccccccgccuccucaucuacgacuccuccaaccgcgcccccggcauccccgcccgauucuccggcuccggcuccggcaccgacuucacccucaccaucuccucccucgcccccgaagacuucgccgucuacuacugccaacaacgcuccaaauggccccccauguacuccuucggccacggcaccaaacucgaaaucaaa

SEQ ID NO: 58246 - RNA, 327 nt, Artificial Sequence
  derived and/or modified sequence opt11 from anti-influenza_Chain
caagccgucgucacacaagaacccucccucaccgucucccccggcggcaccgucacccucaccugcggcuccuccaccggccccgucaccuccggccacuaccccuacugguuccaacaaaaacccggccaagccccccgcacccucaucuccgccaccuccaacacccacuccuggacccccgcccgcuucuccggcucccuccucggcggccgcgccgcccucacccucuccggcgcccaacccgaagacgaagccgacuacuacugcuuccucuccuacuccggcgccugggucuucggcggcggcaccacccucaccguccuc

SEQ ID NO: 58247 - RNA, 327 nt, Artificial Sequence
  derived and/or modified sequence opt11 from anti-influenza_Chain
gccauccaaaugacccaaucccccuccucccucuccgccuccgucggcgaccgcgucaccaucaccugccgcgccucccaaaacauccgcuccuaccucaacugguaccaacaaaaacccggcaaagcccccaaccuccucaucuacggcaccaccucccucgaauccggcguccccucccgcuucuccggcuccggcuccggcaccgacuucacccucaccaucuccucccuccaacccgaagacuucgccaccuacuacugccaacaaucauaccacaccccccaaaccuucggccaaggcaccaaagucgaaaucaaacgcacc

SEQ ID NO: 58248 - RNA, 327 nt, Artificial Sequence
  derived and/or modified sequence opt11 from anti-influenza_Chain
gacauccaaaugacccaaucccccuccucccucuccgccuccgucggcgaccgcaucaccaucaccugccgcgccucccaaggcaucgacaacuaccucgccugguuccaacaaaaacccggcaaaguccccgaacuccucaucuacgccgccuccacccuccaauccggcguccccucccgcuucuccggcuccggcuccggcaccggcuucacccucaccaucuccucccuccaacccgaagacgucgccaccuacuacugccaaaaauacgacuccgccccccucaccuucggcggcggcaccaaagucgacaucaaacgcacc

SEQ ID NO: 58249 - RNA, 327 nt, Artificial Sequence
  derived and/or modified sequence opt11 from anti-influenza_Chain
gacauccaacucacccaaucccccuccucccucuccgccuccgucggcgaccgcgucaccaucaccugccgcgccucacaaggcaucaccgacuaccucgccugguaccaacaaaaacccggcaccauccccaaacuccucaucuacgccgccuccacccuccaauccggcguccccucccgcuucuccggcggcggcuacggcaccgacuucacccucaccaucuccucccuccaacccgaagacgucgccaccuacuacugccaaaaauacaacuccgccccccucaccuucggcggcggcaccaaagucgaaaucaaacgcacc

SEQ ID NO: 58250 - RNA, 327 nt, Artificial Sequence
  derived and/or modified sequence opt11 from anti-influenza_Chain
gacaucgucaugacccaaucccccuucucccucucacucucccccggcgaacgcgccacccucuccugccgcgccucccaauccaucuccaacuaccucgccugguaccaacaaaaacccggccaagccccccgccuccucaucuacgacuccuccaaccgcgccaccggcguccccgcccgcuucucaggcuccggcuccggcaccgacuucacccucaccaucuccucccucgaacccgaagacuucgccgucuacuacugccaacaacgcuccaacuggauguacaccuucggccaaggcaccaaagucgaaaucaaacgcacc

SEQ ID NO: 58251 - RNA, 327 nt, Artificial Sequence
  derived and/or modified sequence opt11 from anti-influenza_Chain
gacauccaaaugacccaaucccccuccucccucuccgccuccgucggcgaccgcgucaccaucaccugccgcgccucccaaggcaucuccuccuaccucgccugguaccaacaaaaacccggcaaaguccccacccuccucaucuacgacgccuccacccuccgauccggcguccccucacgcuucuccggcuccggcuccgccaccgacuucacccucaccaucuccucccuccaacccgaagacgucgccaccuacuacugccaacgcuacaacuccgccccccccaucaccuucggccaaggcacccgccucgaaaucaaacgc

SEQ ID NO: 58252 - RNA, 327 nt, Artificial Sequence
  derived and/or modified sequence opt11 from anti-influenza_Chain
gaaaucgucaugacccaaucccccggcacccucucccucucccccggcgaacgcgccacccucuccugccgcgccucccaauccgucuccuccuccuaccucgccugguaccaacaaaaacccggccaagccccccgccuccucaucuacgacgccuccucccgcgccaccgacauccccgaccgcuucuccggcuccggcuccggcaccgacuucacccucaccaucucacgccucgaacccgaagacuucgccgucuacuacugccaacaauacggcuccucccucuggaccuucggccaaggcaccaaagucgaaaucaaacgc

SEQ ID NO: 58253 - RNA, 327 nt, Artificial Sequence
  derived and/or modified sequence opt11 from anti-influenza_Chain
uccuacguccucacccaaccccccuccgucuccgucgcccccggccaaaccgcccgcaucaccugcggcggcaacaacaucggcuccaaauccguccacugguaccaacaaaaacccggccaagcccccguccucgucgucuacgacgacuccgaccgccccuccggcauccccgaacgcuucuccggcuccaacuccggcaacaccgccacccucaccaucucccgcgucgaagccggcgacgaagccgacuacuacugccaagucugggacuccuccuccgaccacgccgucuucggcggcggcacccaacucaccguccucggc

SEQ ID NO: 58254 - RNA, 327 nt, Artificial Sequence
  derived and/or modified sequence opt11 from anti-influenza_Chain
gaaaucguacucacccaaucccccggcacccucucccucucccccggcgaacgcgccacccucuccugccgcgccucccaauccgucuccuccuccuaccucgccugguaccaacaaaaacccggccaagccccccgccuccucaucuacggcgccuccucccgcgccaccggcauccccgaccgcuucuccggcuccggcuccggcaccgacuucacccucaccaucucccgccucgaacccgaagacuucgccgucuacuacugccaacaauacggcuccuccccccgcaccuucggcggcggcaccaaagucgaaaucaaacgc

SEQ ID NO: 58255 - RNA, 327 nt, Artificial Sequence
  derived and/or modified sequence opt11 from anti-influenza_Chain
uccuacguccucacccaaccccccuccgucucagucgcccccggccaaaccgcccgcaucaccugcggcggcaacaacaucggcuccaaaggcguccacugguaccaacaaaaacccggccaagcccccguccucgucgucuacgacgacuccgaccgccccuccggcauccccgaacgcuucuccggcuccaacuccggcaacaccgccacccucaccaucucccgcgucgaagccggcgacgaagccgacuacuacugccaagucugggacuccuccuccgaccacgucgucuucggcggcggcaccaaacucaccguccucggc

SEQ ID NO: 58256 - RNA, 327 nt, Artificial Sequence
  derived and/or modified sequence opt11 from anti-influenza_Chain
gaaaucguccucacacaaucccccggaacccucagccucagccccggcgaacgcgcaacccucuccugccgcgccagccaauccgucagcucaaacuaccucggcuggacacaacaaaaaccaggccaagcaccccgccuacucauauacggcgccucaagccgcgccuccggcauccccgaccgcuucagcggcggcggcagcggcaccgacuucacacucacaaucucacgccuagaaccagaagacuucgccgucuacuacugccaacaauacggcagcucaccccuaaccuucggcggcggcaccaaagucgaaauaaaaaga

SEQ ID NO: 58257 - RNA, 327 nt, Artificial Sequence
  derived and/or modified sequence opt11 from anti-influenza_Chain
caauccgucgucacccaaccccccuccgucuccgucgcccccggccaaaccgcccgcaucaccugcggcggcaacaacaucggcuccaaauccguccacugguaccaacaaaaacccggccaagcccccguccucgucgucuacgacgacuccgaccgccccuccggcauccccgaacgauucuccggcuccaacuccggcaacaccgccacccucaccaucucccgcgucgaagccggcgacgaagccgacuacuacugccaagucugggacuccuccuccgaccacuacgucuucggcaccggcaccaaagucaccguccucggc

SEQ ID NO: 58258 - RNA, 327 nt, Artificial Sequence
  derived and/or modified sequence opt11 from anti-influenza_Chain
uccuacguccucacccaaccccccuccgaauccgucgcccccggccaaaccgcccgcaucaccugcggcggcaacaacaucggccgcaacuccguccacugguaccaacaaaaacccggccaagcccccguccucgucgucuacgacgacuccgaccgccccuccggcauccccgaacgcuucuccggauccaaauccggcaacaccgccacccucaucaucucccgcgucgaagucggcgacgaagccgacuacuacugccaagucuggcacuccuccuccgaccacuacguauucggcaccggcaccaaagucaccguccucggc

SEQ ID NO: 58259 - RNA, 327 nt, Artificial Sequence
  derived and/or modified sequence opt11 from anti-influenza_Chain
gaaaucgucaugacccaaucccccggcacccucucccucucccccggccaacgcgccacccucuccugccgcgccucccaauccgucuccuccuccuaccucgccugguaccaacaaaaacccggccaagccccccgccuccucauguacggcgccuccucccgcgccaccggcauccccgaccgcuucuccggcuccggcuccggcaccgacuucacccucaccaucucccgccuagaacccgaagacuucgccgucuacuacugccaacaauacggcuccuccucccucaccuucggcggcggcaccaaacucgaaaucaaacgc

SEQ ID NO: 58260 - RNA, 327 nt, Artificial Sequence
  derived and/or modified sequence opt11 from anti-influenza_Chain
caagccggccucacccaaccccccuccgucuccgucgcacccggccaaaccgcccgcaucaccugcggcggcaacaacaucggcuccaaauccguccacugguaccaacaaaaacccggccaagcccccguccucgucgucuacgacgacuccgaccgccccuccggcauccccgaacgcuucuccggcucaaacuccggcaacaccgccacccucaccaucucccgcgucgaagccggcgacgaagccgacuacuacugccaagucugggacucauccuccgaccacgucgucuucggcggcggcaccaaacucaccguccucggc

SEQ ID NO: 58261 - RNA, 327 nt, Artificial Sequence
  derived and/or modified sequence opt11 from anti-influenza_Chain
caauccgucgucacccaaccccccuccgaaucagucgcccccggccaaaccgcccgcaucaccugcggcggccacaacaucggcuccaacuccguccacugguaccaacaaaaacccggccaagcccccguccucgucgucuacgacaacucagaccgccccuccggcauccccgaacgcuucuccggcuccaacuccggcaacaccgccacccucaccaucucccgcgucgaagccggcgacgaagccgacuacuacugccaagucuggggcuccuccuccgaccacuacgucuucggcaccggcaccaaagucaccguccucggc

SEQ ID NO: 58262 - RNA, 327 nt, Artificial Sequence
  derived and/or modified sequence opt11 from anti-influenza_Chain
gaaaucguccucacacaaucccccggcacccucucccucucccccggcgaacgcgccacccucuccugccgcgccucccaauccgucuccuccaacuaccucggcugguaccaacaaaaacccggccaagccccccgacuccucaucuacggagccuccucccgcgccuccggcauccccgaccgcuucuccggcggcggcuccggcaccgacuucacccuaaccaucucccgccucgaacccgaagacuucgccgucuacuacugccaacaauacggcuccuccccccucaccuucggcggcggcaccaaagucgaaaucaaacgc

SEQ ID NO: 58263 - RNA, 327 nt, Artificial Sequence
  derived and/or modified sequence opt11 from anti-influenza_Chain
gaaaucguccucacccaaucccccgccacccucuccgucucccccggcgaacgcgccacccucuccugccgcgccucccaauccgucgacuccaaccucgccugguaccaacaaaaacccggacaagccccccgccuccucgucuacucagccucaacccgcgccaccggcauccccgcccgcuucuccggcuccggcuccggcaccgaauucacccucgccaucuccucccuccaauccgaagacuucgccgucuacuacugccaacacuacaccaacuggcccccccgccucaccuucggcggcggcuccaaagucgaaaucaaa

SEQ ID NO: 58264 - RNA, 327 nt, Artificial Sequence
  derived and/or modified sequence opt11 from anti-influenza_Chain
gaaaucguccucacccaaucccccgccacccucuccgucucccccggcgaacgcgccacccucuccugccgcgccucccaauccgucucccacaaccucgccugguaccaacaaaaacccggccaagccccccgccuccucgucuacucagccuccacccgcgccaccggcauccccgcccgcuucuccggcuccggcuccggcaccgaauucacccucgccaucuccucacuccaauccgaagacuucgccgucuacuacugccaacacuacaccaacuaccccccccgccucaccuucggcggcggcuccaaagucgaaaucaaa

SEQ ID NO: 58265 - RNA, 327 nt, Artificial Sequence
  derived and/or modified sequence opt11 from anti-influenza_Chain
gaaaucgucaugacccaaucccccgccacccuauccgucucccccggcgaacgcgccacccucuccugccgcgccucccaauccgucgacuccaaccucgccugguaccaacaaaaacccggccaagccccccgccuccucgucuacuccgccuccacccgcgccaccggcauccccgcccgcuucuccggcuccggcuccggcacagaauucacccucgccaucuccucccuccaauccgaagacuucgccgucuacuacugccaacacuacaccaacuggcccccccgccucaccuucggcggcggcuccaaagucgaaaucaaa

SEQ ID NO: 58266 - RNA, 327 nt, Artificial Sequence
  derived and/or modified sequence opt11 from anti-influenza_Chain
gaaaucguccucacccaaucccccgccacccucuccgucucccccggcgaacgcgccacccucuccugccgcgccucccaauccgucuccuccaaccucgccugguaccaacaaaaacccggccaagccccccgccuccucgucuacuccgccucaacccgcgccaccggcauccccgcccgcuucucaggcuccggcuccggcaccgaauucacccucgccaucuccucccuccaauccgaagacuucgccgucuacuacugccaacacuacaccaacuggcccccccgccucaccuucggcggcggcuccaaagucgaaaucaaa

SEQ ID NO: 58267 - RNA, 327 nt, Artificial Sequence
  derived and/or modified sequence opt11 from anti-influenza_Chain
gaaaucguccucacccaaucccccgcaacccucuccgucucccccggcgaacgcgccacccucuccugccgcgccucccaauccgucgaccacaaccuagccugguaccaacaaaaacccggccaagccccccgccuccucgucuacuccgccuccacccgcgccaccggcauccccgcccgcuucuccggcuccggcuccggcacagaauucacccucgccaucucaucccuccaauccgaagacuucgccgucuacuacugccaacacuacaccaacuggcccccccgccucaccuucggcggcggcuccaaagucgaaaucaaa

SEQ ID NO: 58268 - RNA, 327 nt, Artificial Sequence
  derived and/or modified sequence opt11 from anti-influenza_Chain
gaaaucguccucacccaaucccccgccacccucuccgucucacccggcgaacgcgccacccucuccugccgcgccucccaauccgucucccacaaccucgccugguaccaacaaaaacccggccaagccccccgccuccucgucuacuccgccuccacccgcgccaccggcaucccagcccgcuucuccggcuccggcuccggcaccgaauucacccucgccaucuccucccuccaauccgaagacuucgccgucuacuacugccaacacuacaccaacuggcccccccgccucaccuucggcggcggcuccaaagucgaaaucaaa

SEQ ID NO: 58269 - RNA, 327 nt, Artificial Sequence
  derived and/or modified sequence opt11 from anti-influenza_Chain
gaaaucguccucacccaaucacccgccacccucuccgucucccccggcgaacgcgccacccucuccugccgcgccucccaauccgucucccacaaccucgccugguaccaacaaaaacccggccaagccccccgccuccucgucuacuccgccuccacccgcgccaccggcaucccagcccgcuucuccggcuccggcuccggcaccgaauucacccuagccaucuccucacuccaauccgaagacuucgccgucuacuacugccaacacuacaccaacuuccccccccgccucaccuucggcggcggcuccaaagucgaaaucaaa

SEQ ID NO: 58270 - RNA, 327 nt, Artificial Sequence
  derived and/or modified sequence opt11 from anti-influenza_Chain
gagaucgugcucacgcaaucgcccgcgaccuugagcgugagcccgggcgagcgcgcgaccuugagcugucgcgcgagccagagcguggacucgaaccuggccugguaccagcaaaagcccgggcaagcgcccaggcuccuggucuauagcgcgagcacgcgcgcgaccgggaucccggccagauucucaggcucgggcucgggcacggaauuuaccuuggccauaagcucgcuccagagcgaggacuuugccguguacuauugccagcacuauaccaauuucccacccaggcucacguucggaggcgggagcaaggucgagaucaag

SEQ ID NO: 58271 - RNA, 327 nt, Artificial Sequence
  derived and/or modified sequence opt11 from anti-influenza_Chain
gaaaucguccucacccaaucccccgccacccucuccgucucccccggcgaacgcgccacccucuccugccgagccucccaauccgucgacuccaaccucgccugguaccaacaaaaacccggccaagccccccgccuccucgucuacuccgccuccacccgcgccaccggcauccccgcccgcuucuccggcuccggcuccggcacagaauucacccucgccaucuccucccuccaauccgaagacuucgccgucuacuacugccaacacuacaccaacuaccccccccgccucaccuucggcggcggcuccaaagucgaaaucaaa

SEQ ID NO: 58272 - RNA, 327 nt, Artificial Sequence
  derived and/or modified sequence opt11 from anti-influenza_Chain
gaaaccacccucacucaaucccccgccacccucuccgucucccccggcgaacgcgccacccucuccugccgcgccucccaagucaucucccacaaccucgccugguaccaacaaaaacccggccaagccccccgccuccucaucuacggcgccuccacccgcgccuccggcauccccgcccgcuucuccggcuccggcuccggcacagacuacacccucaccaucaccucccuccaauccgaagacuucgccgucuacuacugccaacacuacuccaacuggccaccccgccucaccuucggcggcggcaccaaagucgaaaucaaa

SEQ ID NO: 58273 - RNA, 327 nt, Artificial Sequence
  derived and/or modified sequence opt11 from anti-influenza_Chain
gaaaucguccuaacccaaucccccgccacccucuccgucucccccggcgaacgcgcaacccucuccugccgcgccucccaagucaucucccacaaccucgccugguaccaacaaaaacccggccaagccccccgccuccucaucuacggcgccuccacccgcgccuccggaauccccgcccgcuucuccggcuccggcuccggcaccgacuacacccucaccaucaccucccuccaauccgaagacuucgccgucuacuacugccaacacuacuccaacuggcccccccgccucaccuucggcggcggcaccaaagucgaaaucaaa

SEQ ID NO: 58274 - RNA, 327 nt, Artificial Sequence
  derived and/or modified sequence opt11 from anti-influenza_Chain
gaaaucguccucacccaaucccccgccacccucuccgucucccccggcgaacgcgccacccucuccugccgcgccucccaagucaucucccacaaccucgccugguaccaacaaaaacccggccaagccccccgccuccucaucuacggcgccuccacccgcgccuccggcauccccgcccgcuucuccggcuccggcuccggcaccgacuacacccucaccaucaccucccuccaacccgaagacuucgccgucuacuacugccaacacuacuccaacuggcccccccgacucaccuucggcggcggcaccaaagucgaaaucaaa

SEQ ID NO: 58275 - RNA, 327 nt, Artificial Sequence
  derived and/or modified sequence opt11 from anti-influenza_Chain
gaaaucgucaugacccaaucccccgccacccucuccgucucccccggcgaacgcgccacccucuccugccgcgccucccaagucaucucccacaaccucgccugguaccaacaaaaacccggccaagccccccgccuccucaucuacggcgcauccacccgcgccuccggcauccccgcccgcuucuccggcuccggcuccggcaccgacuacacccucaccaucaccucccuccaauccgaagacuucgccgucuacuacugccaacacuacuccaacuggcccccccgccucaccuucggcggcggcaccaaagucgaaaucaaa

SEQ ID NO: 58276 - RNA, 327 nt, Artificial Sequence
  derived and/or modified sequence opt11 from anti-influenza_Chain
gaaaucguccucacccaaucccccgccacccucuccgucucccccggcgaacgcgccacccucuccugccgcgccucccaagucaucucccacaaccucgccugguaccaacaaaaacccggccaagccccccgccuccuaaucuacggcgccuccacccgcgccuccggcauccccgcccgcuucuccggcuccggcuccggcaccgacuacacccucaccaucaccucccuccaauccgaagacuucgccgucuacuacugccaacacuacuccaacuuccccccccgccucaccuucggcggcggcaccaaagucgaaaucaaa

SEQ ID NO: 58277 - RNA, 327 nt, Artificial Sequence
  derived and/or modified sequence opt11 from anti-influenza_Chain
gaaaucguccucacccaaucccccgccacccucuccgucucccccggcgaacgcgccacccucuccugccgcgccucccaagucaucucccacaaccucgccugguaccaacaaaaaccaggccaagccccccgccuacucaucuacggcgccuccacccgcgccuccggcauccccgcccgcuucuccggcuccggcuccggcaccgacuacacccuaaccaucaccucccuccaauccgaagacuucgccgucuacuacugccaacacuacuccaacuaccccccccgccucaccuucggcggcggcaccaaagucgaaaucaaa

SEQ ID NO: 58278 - RNA, 327 nt, Artificial Sequence
  derived and/or modified sequence opt11 from anti-influenza_Chain
gaaaucguccucacccaaucccccgccacccucucagucucccccggcgaacgcgucacccucuccugccgcgccucccaauccgucgccaacaaccucgccugguaccaacaaaaacccggccaauccccccgccuccucaucuacggcgccuccacccgcgacaccggcauccccgcccgcuucuccggcuccggcuccggcaccgaauucacccucaccaucuccucccuccaauccgaagacuucgccgucuacuacugccaacaauacaacaacuggccccccauguacaccuucggccaaggcaccaaacucgaaaucaaa

SEQ ID NO: 58279 - RNA, 327 nt, Artificial Sequence
  derived and/or modified sequence opt11 from anti-influenza_Chain
gacaucgucaugacccaaucccccuccacccucuccgccuccgucggcgaccgcgucaccaucaccugccgcgccucccaauccaucggcaacuggcucgccugguaccaacaaaaacccggcaaagcccccaaacuccucaucuacaaagucuccacccucgaauccggcguccccucccgcuucucaggcuccggcuccggcaccgaauucacccucaccaucaacucccuccaacccgacgacuucgccaccuacuacugccaacgcuacaccuccaacucccaaggcuucaccuucggccaaggcaccaaacucgaaaucaaa

SEQ ID NO: 58280 - RNA, 327 nt, Artificial Sequence
  derived and/or modified sequence opt11 from anti-influenza_Chain
gacaucgucaugacccaaucccccgccacccucuccgucucccccggcgaacgcgccacccucuccugccgcgccucccaagucgucggcaccaaccucgccugguaccaacaaaaacccggccaagccccacgccuccucaucuacgccgccuccacccgcgccaccggcauccccgcccgcuucuccggcuccggcuucggcaccgacuucacccucaccaucuccucccuccaauccgaagacuucgccgucuacuacugccaacaauacaacaacuggccccucuccuucggcggcggcaccaaagucgaaauccgccgcacc

SEQ ID NO: 58281 - RNA, 327 nt, Artificial Sequence
  derived and/or modified sequence opt11 from anti-influenza_Chain
gacauccaaaugacccaaucccccucaucccucuccgccuccgucggcgaccgcgucaccaucgucugccgcgccucccaaggcaucaacacccaccuccacugguaccaacaaaaaccaggcaaagcccccaaacuccucaucuacuccgccuccacccuccacaccggcguccccucccgccucuccggcuccggcuccggcaccgacuucacccucuccaucuccucccuccaacccgaagacuucgccaccuacuacugccaacaauccuacaacuacccccgcaccuucggccaaggcaccaacgucgacaucaaacgcacc

SEQ ID NO: 58282 - RNA, 327 nt, Artificial Sequence
  derived and/or modified sequence opt11 from anti-influenza_Chain
gacauccucaugacccaaucccccuccucccucuccgccuccgucggcgaccgcgucaccaucaccugccgcgccucccaagacauccgcaaccgccucgccugguaccaacaaaaacccggcaaagcccccaaacgccucaucuacgccgccuccucccuccaauccggcguccccucccgcuucuccggcuccggcuccggcaccgaauucacccucaccaucaacucccuccaacccgaagacuucgccaccuacuacugccuccaacacaacuccuaccccuggaccuucggccccggcaccaaagucgaaaucaaacgcacc

SEQ ID NO: 58283 - RNA, 327 nt, Artificial Sequence
  derived and/or modified sequence opt11 from anti-influenza_Chain
gacaucgucaugacccaaucccccgccacccucuccgucucccccggcgaaggcgccacccucuccugccgcgccucccaaggcaucggcuccaaccucgccugguaccaacacaaacccggccaagccccccgccuccucaucuacgccgccuccacccgcgccaccggcguccccgcccgcuucuccggcuccggcuccggcaccgaauucacccucaccaucuccucccuccaauccgaagaccucgccgucuacuucugccaacaauacaacaccuggccccucaccuucggcggcggcaccaaagucgaaaucauccgcacc

SEQ ID NO: 58284 - RNA, 327 nt, Artificial Sequence
  derived and/or modified sequence opt11 from anti-influenza_Chain
gacaucgucaugacccaaucccccuccacccuauccgccuccgucggcgaccgcgucaccaucaccugccgcgccucccaaaccaucuaccgcuggcucgccugguaccaacaaaaacccggcaaagcccccaaaguccucaucuacaaagccuccacccucgaauccggcguccccucccgcuucuccggcuccggcuccggcaccgaauucacccucgccaucuccucccuccaacccgacgacuucgccaccuacuacugccaacaauacaacuccuuccccuaccgcuucggccaaggcaccaaagucgaaaucaaacgcacc

SEQ ID NO: 58285 - RNA, 327 nt, Artificial Sequence
  derived and/or modified sequence opt11 from anti-influenza_Chain
gacaucgucaugacccaaucccccuccucccucuccgccuccgucggcgaccgcgucuccaucaccugccgcgccucacaaaccaucacccgcuuccucaacugguaccaacaaaaacccggcaaaggccccaaacuccucaucuacgccgccuccaccguccaccgcggcguccccucccgcuucuccggcuccggcuccggcaccgacuucacccucaccaucuccucacuccaacccgaagacuucgccaccuacuacugccaacaauccuacuccgcccccuucaccuucggccccggcaccaccgucgacauccgccgcacc

SEQ ID NO: 58286 - RNA, 327 nt, Artificial Sequence
  derived and/or modified sequence opt11 from anti-influenza_Chain
gacaucgucaugacccaaccccccgccacccucuccgucucccccggcgaacgcgccacccucuccugcggcgccucccaaggccucggcuccaaccucgccugguaccaacaaaaacccggccaagccccccgccuccucaucuacgccgccuccacccgcgccaccggcaucaccgcccgcuucuccggcuccggcuccggcaccgaauucacccucaccaucaacucccuccaauccgaagacuucgcccuauacuacugccaacaauacaccuacuggccccucaccuucggcggcggcaccaaagucgaaaucaaacgcacc

SEQ ID NO: 58287 - RNA, 327 nt, Artificial Sequence
  derived and/or modified sequence opt11 from anti-influenza_Chain
gauaucgugcucacgcaaucgcccgcgaccuugagcgugagcccgggcgagcgcgcgaccuugagcugucgcgcgagccagagcgugaacaggaacuuggccugguuccagcaaauacccgggcaagcgcccaggcucuugaucuuugacgcgagcacgcgcgcggccgauaucccggccagguucucgggcggaggcucgggcgcggaauuuaccuugaccgugagcucgcuccagcccgaggacuuugccguguacuauugccagcaauaugacaaguggccgcccggguucgggcaagggaccaaggucgagaucaagcgcacg

SEQ ID NO: 58288 - RNA, 330 nt, Artificial Sequence
  derived and/or modified sequence opt11 from anti-influenza_Chain
caaucaguccucacccaaccccccuccgccuccggcgcccccggccaacgcgucacccucuccugcuccggcuccggcuccaacaucggcuccaacaccgucuccugguaccaacaacuccccggcaccgcccccaaacuccucgucuucaccaacaaccaacgccccuccggcguccccgaccgcuucuccggcuccaaauccggcaccucagccucccucgccaucuccggccuccaauccgaagacgaagccgacuacuacugcgccgccugggacgacucccucaacggccaacucuucggcggcggcaccaaacucaccguccuc

SEQ ID NO: 58289 - RNA, 330 nt, Artificial Sequence
  derived and/or modified sequence opt11 from anti-influenza_Chain
caauccguccuaacccaaccccccucagucuccgccgcccccggccaacgcgucaccaucuccugcuccggcaccuccuccaacaucggcaaaaacuacgucuccugguaccaacaacuccccggcgccgcccccaaacuccucaucuacgacaacgacaaacgccccuccggcauccccgaccgcuucuccggcuccaaauccggcaccuccgccacccucggcaucaccggccuccaaaccggcgacgaagccgacuacuacugcggcaccugggacuccucccucuccgucggcauguucggcggcggcacccgccucaccguccuc

SEQ ID NO: 58290 - RNA, 330 nt, Artificial Sequence
  derived and/or modified sequence opt11 from anti-influenza_Chain
gaaaccacccucacccaaucccccgccacccuauccgucucccccggcgaacgcgccacccucuccugccgcgccucccaauccguaucccgcaaccucgccugguaccaacaaaaacccggccaagccccccgccuccucaucuacggcgccuccucccgcgccaccggcauccccgaccgcuucuccggcuccggcuccggcaccgacuucacccucaccaucucccgccucgaacccgaagacuucgccgucuacuacugccaacaauacggcuccucauccaucaccuucggacaaggcacccgccucgaaaucaaacgcaccguc

SEQ ID NO: 58291 - RNA, 330 nt, Artificial Sequence
  derived and/or modified sequence opt11 from anti-influenza_Chain
caaucaguccugacccagcccccgagcgcaagcgggaccccgggccagcgcgugaccauaagcugcagcggaagcucaagcaacaucggaagcaacaccguaaacugguacaaacaacugcccgggaccgcgcccaggcuccuaaucuacagcaacgaccagcgcccaagcggagucccggacagauucucaggcucaaaaucaggcacaagcgcaagccuggccauaagcggacuccagagcgaagacgaggccaacuacuacugcgcggccugggacgacagccugagcggauggguauucggaggcggaaccaaacucacaguccua

SEQ ID NO: 58292 - RNA, 330 nt, Artificial Sequence
  derived and/or modified sequence opt11 from anti-influenza_Chain
caauccgcccucacccaaccccgcuccgucuccggcucccccggccaauccgucaccaucuccugcaccggcuccuccuccgacgucggcgccuccaacuccgucuccugguaccaacaacaccccggcaaagcccccaaacucgucaucuacgacgucaccgaacgcccauccggcgucccccaccgcuucuccggcuccaaauccggcaacaccgccucccucaccgucuccggccuccaacccgaagacgaagccgacuacuucugcugcgccuacggcggcaaauaccucgucgucuucggcggcggcaccaaagucaccguccuc

SEQ ID NO: 58293 - RNA, 330 nt, Artificial Sequence
  derived and/or modified sequence opt11 from anti-influenza_Chain
caauccgcacucacccaacccgccuccgucuccggcucacccggccaauccaucaccaucuccugcaccggcaccuccucagacgucggcggcuacaacuacgucuccugguaccaacaacaccccggcaaagcccccaaacuccucaucuacgaagucaccaacuggcccuccggcgucuccaaccgcuucuccggcuccaaauccggaaacaccgccucccucaccaucuccggccuccaagccgaagacgaagccgacuacuacugcuccuccuacgccggcuccuccaccugggucuucggcggcggcacccgcgucaccguccuc

SEQ ID NO: 58294 - RNA, 330 nt, Artificial Sequence
  derived and/or modified sequence opt11 from anti-influenza_Chain
caaaccgucgucacccaagaacccucccucaccgucucccccggcggcaccgucacccucaccugcgccuccuccaccggcgccgucaccuccuccuacuuccccaacugguuccaacaaaaacccggccaagccccccgcccccucaucuacuccaccaccauccgccacuccuggacccccgcccgcuucuccggcucccuccucggcggcaaagccgcccuaacccucuccggcguccaacccgaagacgaagccgacuacuacugccuccucuacuccggcggcgaccccgucgccuucggcggcggcaccaaacucaccguccuc

SEQ ID NO: 58295 - RNA, 330 nt, Artificial Sequence
  derived and/or modified sequence opt11 from anti-influenza_Chain
caauccguccucacccaaucccccuccgucuccgccgcccccggccaaaaagucaccaucuccugcuccggcuccgacuccaacaucggcgacuacuucgucugcugguaccaacaccuccccggcaaacccccccaacuccucaucuacgaaaacaacaaacgccccuccggcauccccgaccgcuucuccggcuccaaaucaggcaccuccgccacccucggcaucaccggcauccaaaccggcgacgaagccgacuacuacugcgccaccugggacggcucccucuccgccugggucuucggcggcggcaccaaacucaccguccuc

SEQ ID NO: 58296 - RNA, 330 nt, Artificial Sequence
  derived and/or modified sequence opt11 from anti-influenza_Chain
cagagcgcacucacgcaaccgcgcucggucucgggcucgcccgggcaaucgaucacgaucucgugcacgggcgggagcucggacauaggcgcgagcaauagcgugagcugguaccagcaacaucccgggaaagcgcccaagcucgugaucuuugacgugaccgagcgcccgagcggggucccgcacagguucucgggcucgaaaucgggcaauaccgcgagcuugaccgugagcgggcuccagcccgaugacgaggccgauuacuuuugcugugccuauggcgggaaauaucucguggucuuuggcgggggcacgaaagugaccgugcuc

SEQ ID NO: 58297 - RNA, 330 nt, Artificial Sequence
  derived and/or modified sequence opt11 from anti-influenza_Chain
caagccgucgucacccaagaacccucccucgccguaucccccggcggcaccgucacccucaccugcggcuccuccaccggcgccgucacccgcggccacuacccauacugguuccaacaaaaacccggccaagccccccgcgcccucaucuacgacuccgccggcaaccgccacuccuggacccccgcccgcuucuccggcucccuccucggcggcaaagccgcccucacccucuccggcgcccaacccgaagacgaagccgaauacuacugccuccucuccuacuccggcgucugggucuucggcggcggcaccaaacucaccguccuc

SEQ ID NO: 58298 - RNA, 330 nt, Artificial Sequence
  derived and/or modified sequence opt11 from anti-influenza_Chain
gaaaucgucaugacccaaucccccgccacccucuccgucucccccggcgaacgcgucacccucuccugccgcgccucccaauccaucaccgacggccucgccugguaccaacaaaaauccggccaagccccccgccuccucaucuacggcgccuccacccgcgccaccggcauccccgcccgcuucuccggcuccggcuccggcaccgaauucacacucaccaucuccucccuccaauccgaagacuucgccgucuacuacugccaacaauacaacaacuggccccccgucaccuucggccaaggcaccaaagucgaaaucaaacgcacc

SEQ ID NO: 58299 - RNA, 330 nt, Artificial Sequence
  derived and/or modified sequence opt11 from anti-influenza_Chain
uccucagaacucacccaaccccccuccgccuccggcacccccggccaacgcgucaccaucuccugcuccggcuccaccuccaacaucggcuacaaccccgucuccugguaccaacaaguccccggcaccgcccccaaacuccucaucuacuccaacaccgaacgccccuccggaguccccgaccgcuucuccggcuccaaauccggcaccuccgccucccucgccaucuccggccuccaauccgaagacgaagccgacuacuacugcgccgccugggacgacacccucaacggccccgucuucggcggcggcaccaaagucaccguccuc

SEQ ID NO: 58300 - RNA, 330 nt, Artificial Sequence
  derived and/or modified sequence opt11 from anti-influenza_Chain
caauccgcccucacccaacccgccuccgucuccggcucccccggccaauccaucaccaucuccugcaccggcaccuccuccgacgucggcggcuacaacuacgucuccugguaccaacaacaccccggcgaagcccccaaacucaugaucuccgacgucuccaaccgccccuccggcgucuccaaccgcuucuccggcuccaaauccggcaacaccgccucucucaccaucuccggccuccaagccgaagacgaagccgacuacuacugcaccuccuacaccuccuccaacacccucgucuucggcggcggcaccaaacucaccguccuc

SEQ ID NO: 58301 - RNA, 330 nt, Artificial Sequence
  derived and/or modified sequence opt11 from anti-influenza_Chain
caauccguccucacccaaccccccuccgucuccgccgcccccggacaaaaagucaccaucuccugcuccggcuccuccuccaacaucggccacaacuucgucuccugguaccaacaacuccccgccaccgcccccaaacuccucaucuacgacaccgacaaacgccccuccggcauccccgaccgcuucuccggcuccaaauccggcaccuccgccacccucggcaucaccggccuccaaaccggcgacgaagccgacuacuacugcggcaccugggacuccucccuauccuccgucaucuucggcggcggcaccaaacucaccguccuc

SEQ ID NO: 58302 - RNA, 330 nt, Artificial Sequence
  derived and/or modified sequence opt11 from anti-influenza_Chain
gacauccaaaugacccaaucccccuccacccucuccgccuccgucggcgaccgcgucaccaucaccugccgcgccucacaaaccaucaacaacuaccucgccugguaccaacaaaaacccggcaaagcccccaaacuccucaucuacaaagccuccucccucgaauccggcguccccucccgcuucuccggcuccggcuccggcaccgaauucacccucaccaucuccucccuccaacccgacgacuucgccaccuacuacugccaagaauacaacaacgacuccccccuaaccuucggcggcggcaccaaagucgaaaucaaacgcacc

SEQ ID NO: 58303 - RNA, 330 nt, Artificial Sequence
  derived and/or modified sequence opt11 from anti-influenza_Chain
gacaucgaacucacccaagaccccuccgucuccgucgcccccggccaaaccgcccgcauccccugcguccgcuucaacaugggccccaccuccguccacugguaccaacaaaaacccggccaagcccccguccucgucgucuacgacgacuccgaccgccccuccggcauccccgaacgcuucuccggcuccaacuccggcgacuccgccacccucaccaucucccgcgucgaagccggcgacgaagccgacuacuacugccaagucugggacaugucauccgaccgacgcgucuucggaggcggcaccacccucaccguccucggccaa

SEQ ID NO: 58304 - RNA, 330 nt, Artificial Sequence
  derived and/or modified sequence opt11 from anti-influenza_Chain
gacaucgucaugacccaaucccccggcacccucucccucucccccggcgaacgcgccacccucuacugccgcgccucccaauccguccgcuccggcuaccucgccugguaccaacacaaacccggccaagccccccuccuccucuucuacgacgccuccggccgagccaccggcauccccgaccgcuucuccggcuccggcuccggcaccgacuucacacucaccaucucccgccucgaacccgaagacuucgccgucuacuacugccuccaauacggcuccuccccccgcaccuucggccaaggcaccaaagucgaaaucaaacgcacc

SEQ ID NO: 58305 - RNA, 330 nt, Artificial Sequence
  derived and/or modified sequence opt11 from anti-influenza_Chain
gacaucguccucacccaaucccccuccuuccuauccgccuccgucggcgaccgcgucaccaucaccugccgcgccucccaacucaucuccuccuacuucgccugguaccaacaaaaacccggcaaaccccccaaacuccucaucuacgccgccuccacccuccaauccggcguccccucccgcuucuccggcuccggcuccggcacccaauucucccucaccaucuccucccuccaacccgaagacuucgccaccuacuacugccaacaacucaacuccuacccccccaucaccuucggccaaggcacccgccucgaaaucaaacgcacc

SEQ ID NO: 58306 - RNA, 330 nt, Artificial Sequence
  derived and/or modified sequence opt11 from anti-influenza_Chain
gacaucacccucacccaaucccccgccacccucuccgucucacccggcgaacgcgccacccucuccugccgcgccucccaauccgucuccuccaaccucgccugguaccaacaaaaacccggccaagccccccgccuccucaucuacggcgccuccaaccgcgccaccgacauccccgcccgcuucuccggcuccggcuccggcaccgaauucacccucaccaucuccucccuccaauccgaagacuucgccgucuacuacugccaacaauucaacgacuggcccuuccucaccuucggcggcggcaccaaagucgaaaucaaacgcacc

SEQ ID NO: 58307 - RNA, 330 nt, Artificial Sequence
  derived and/or modified sequence opt11 from anti-influenza_Chain
gacaucgucaugacccaaucccccuccuuccucuccgccuccgucggcgaccgcgucaccaucaccugccgcaccucccaagucaucuccuccuaccucgccugguaccaacaacgccccggcaaagcccccaaacuccucaucuacgccgccuccacccuccaauccggcguccccucccgcuucuccggcuccggcuccggcacccgcuucucccucaccaucucaaaccuccaacccgaagacuucgccacauacuucugccaacaacucaccaccuacccccccaucaccuucggccaaggcacccgccucgaaaucaaacgcacc

SEQ ID NO: 58308 - RNA, 330 nt, Artificial Sequence
  derived and/or modified sequence opt11 from anti-influenza_Chain
gacauagucuugacccagagcccgagcgugagcguggccccgggccagaccgcgcgcauaaccuguggcgggaacgauaucgggagcaagagcgugcacugguaccagcaaaagcccgggcaagcgcccgugcucguggucuuugacgaucgcgaucgcccgagcgggaucccggaaagguucucgggcucgaacucgggcaauaccgcgacccugaccauaagcagggucgaggccggggacgaggccgauuacuauugccaggucugggacauaaccucggacuuggucguguucgggggcgggaccaagcucacggucgugggccag

SEQ ID NO: 58309 - RNA, 330 nt, Artificial Sequence
  derived and/or modified sequence opt11 from anti-influenza_Chain
gacaucgucaugacccaaccccccggcacccucuccgucucccccggcgaacgcgccacccucucaugccgcgccucccaauccgucuccaccaaccucgccugguaccaacaaaaacccggccaagccccccgccuccucauccacggcgccuccacccgcgccaccggcauccccgcccgcuucuccggcuccggcuccggcgccgaauucacccucaccaucuccucccuccaauccgaagacgucgccgucuacuacugccaacaauacgacaacuggcuccccaucaccuucggccccggcaccaaagucgacauccaacgcacc

SEQ ID NO: 58310 - RNA, 330 nt, Artificial Sequence
  derived and/or modified sequence opt11 from anti-influenza_Chain
gaccccaugcucacgcaaacggccucgcccgugagcgcggccgugggcgggaccgugaccauaaacugccaagcgagccagagcguguacaacaaaaacaaccuggccugguaccagcaaaagcucgggcaaccgcccaagcuccugaucuacgccgcgagcacgcucacgagcggggucccgagcagauucaaaggcucaggcucaggcacacaauucacccugaccauaagcgaccucgagugcgacgacgcagccacauacuacugcgcaggcgacuacucgggcgggaucuacgccuucggcggaggcacaaaaguagaaauaaaa

SEQ ID NO: 58311 - RNA, 330 nt, Artificial Sequence
  derived and/or modified sequence opt11 from anti-influenza_Chain
gagcucgugaugacgcaaacgcccgcgagcgugagcgcggccgugggcgggaccgugaccauaagcugucaaucgagcgagagcguguacaagaacaauaacuuggccugguuccagcaaaagcucgggcaaccgcccaagcucuugaucuaugacgcgagcaagcucgcgagcggagucccgagcagguucucgggcucgggcucgggcacgcaauuuaccuugaccauaagcgaucucgagugcgaugacgcggccacguacuauugcgcgggcgauuacucgggcucgaacuaugccuuuggcgggggcacgaaauuggaaauaaaa

SEQ ID NO: 58312 - RNA, 330 nt, Artificial Sequence
  derived and/or modified sequence opt11 from anti-influenza_Chain
gagcccaugcucacgcaaacggccucgagcguaagcgcggccgugggcgggagcgugaccauaagcugucaaucgagccagagcguggacucgaacaaucaauugagcugguaccagcaaaagcccgggcaaccgcccaagcuccugaucuaugccgcgagcacgcucacgagcggggucccgagcagguucaagggcucgggcucaggcacgcaauuuaccuugaccauaagcgaucucgagugcgaugacgcggccacguacuauugcgcgggcgauuacucgggcgggaucuaugccuuuggcgggggcacggaaguggucgugaaa

SEQ ID NO: 58313 - RNA, 330 nt, Artificial Sequence
  derived and/or modified sequence opt11 from anti-influenza_Chain
gaucccaugcuaacgcaaacggccgcgagcgugagcgcggccgugggcgggaccgugaccauaagcugucaaucgagcgagagcguguacaagaacaauaacuuggccugguuccagcaaaagcucgggcaaccgcccacgcucuugaucugggacgcgagcaagcucgcgagcggggucccgagcagguucucgggcucgggcucgggcacgcaauuuaccuugaccauaagcgaucucgagugcgaugacgcggccacguacuauugcgcgggcgauuacucgggcgugaacuaugccuuuggcgggggcacggaaguggucgugaaa

SEQ ID NO: 58314 - RNA, 330 nt, Artificial Sequence
  derived and/or modified sequence opt11 from anti-influenza_Chain
gagcucgugaugacgcaaacgcccgcgagcgugagcgcggccgugggcgggaccgugaccauaagcugucaaucgagcgagagcguguacaagaacaauaacuuggccugguuccagcaaaagcucgggcaaccgcccaagcucuugaucuaugacgcgagcaagcucgcgagcggggucccgagcagguucucgggcucgggcucgggcacgcaauuuaccuugaccauaagcgaucucgagugcgaugacgcggccacguacuauugcgcgggcgauuacucgggcucgaacuaugccuuuggcgggggcacggaaguggucgugaaa

SEQ ID NO: 58315 - RNA, 330 nt, Artificial Sequence
  derived and/or modified sequence opt11 from anti-influenza_Chain
gaccccaugcucacccaaaccgccuccuccgucuccgccaccgucggcggcaccgucaccaucuccugccaauccucccaauccgucgacaacaacaaagaccucgccugguuccaacaaaaacccggccacucccccaaacuccucaucuacuucgccucccgccucgccuccggcguccccucccgcuucaaaggcuccggcuccggcacccacuucacccucaccaucuccgaccucgaaugcgacgacgccgccaccuacuacugcgccggcgacuacuccggcgccaacuacgccuucggcggcggcaccaaacuagaaaucaaa

SEQ ID NO: 58316 - RNA, 330 nt, Artificial Sequence
  derived and/or modified sequence opt11 from anti-influenza_Chain
gaccccaugcucacccaaaccgccucccccgucuccgccgccgucggcggcaccgucaccaucaacugccaauccucccaauccgucuacaacaacaaccgccucuccugguuccaacaaaaacccggccaaccccccaaacuccucaucuacuccgccucaacccucgccuccggcgucuccucccgcuucaaaggcuccggcuccggcacccaauucacccucaccaucuccgaccucgaaugcgacgacgccgccaccuacuacugcgccggcgacuacuccggcggcaucuacgccuucggcggcggcaccgaacucgaaauacuc

SEQ ID NO: 58317 - RNA, 330 nt, Artificial Sequence
  derived and/or modified sequence opt11 from anti-influenza_Chain
gagcucgugcucacgcaaacgcccgcgagcgugagcgcggccgugggcgggaccgugagcauaagcugucaaucgagccagagcguguacaagaacaauaacuuggccugguuccagcaaaagcucgggcaaccgcccacgcucuugaucugggacgcgagcaagcucgcgagcggggucccgagcagguucucgggcucgggcucgggcacgcaauuuaccuugaccauaagcgaucucgagugcgaugacgcggccacguacuauugcgcaggcgauuacucgggcgugaacuaugccuuuggcgggggcacgaaauuggaaauaaaa

SEQ ID NO: 58318 - RNA, 330 nt, Artificial Sequence
  derived and/or modified sequence opt11 from anti-influenza_Chain
gagcucgaucucacgcaaacgcccgcaagcgugagcgcggccgugggcgggaccgugaccauaagcugucaaucaagcgagagcguguacaagaacaauaacuuggccugguuccagcaaaagcucgggcaaccgcccacgcucuugaucugggacgcgagcaagcucgcgagcggggucccgagcagguucucgggcucaggcucgggcacgcaauuuaccuugaccauaagcgaucucgagugcgaugacgcggccacguacuauugcgcgggcgauuacucgggcgugaacuaugccuuuggcgggggcacggaaguggucgugaaa

SEQ ID NO: 58319 - RNA, 330 nt, Artificial Sequence
  derived and/or modified sequence opt11 from anti-influenza_Chain
gauauccagaugacacaaucgcccucgagccugagcgcgagcguaggcgaucgcgugaccauaaccugucaaucgagcgagagcguguacaagaacaauaacuuggccugguaccagcaaaagcccggaaaaccgcccaagcuccugaucugggacgcgagcaagcucgcgagcggggucccgagcagguucucgggcucgggcucgggcacggacuucacccugaccauaagcucgcuccagcccgaggacguggccacguacuauugcgcgggcgauuacucgggcgugaacuaugccuuuggcggaggcacggaaguggucgugaaa

SEQ ID NO: 58320 - RNA, 333 nt, Artificial Sequence
  derived and/or modified sequence opt11 from anti-influenza_Chain
gacaucgucaugacccaaucccccgacucccucgccgucucccucggcgaacgcgccaccaucaacugcaaauccucccaauccgucaccuucaacaacaaaaacuaccucgccugguaccaacaaaaacccggccaaccccccaaacuccucaucuacugggccuccacccgcgaauccggcguccccgaccgcuucuccggcuccggcuccggcaccgacuucacccucaccaucuccucccuacaagccgaagacgucgccgucuacuacugccaacaacacuaccgcaccccccccaccuucggccaaggcaccaaagucgaaaucaaa

SEQ ID NO: 58321 - RNA, 333 nt, Artificial Sequence
  derived and/or modified sequence opt11 from anti-influenza_Chain
caauccgcccucacccaacccgccuccgucuccggcucccccggccaauccaucaccaucuccugcaccggcaccggcuccgacgucggcuccuccaaccucgucuccugguaccaacaacaccccgccaaagcccccaaacucaucaucuacgaagucaccaaacgccccuccggcgucuccaaccgcuucuccggcuccaaauccggaaacaccgcaucccucaccaucuccggccuccaagccgaagacgaagccgacuacuacugcugcuccuacgccggcuccuccuccucccgcgucuucggcaccggcaccaaagucaccguccuc

SEQ ID NO: 58322 - RNA, 333 nt, Artificial Sequence
  derived and/or modified sequence opt11 from anti-influenza_Chain
caauccguccucacccaaccccccuccgccuccggcacccccggccaacgcgucaccaucuccugcuccggcuccaccucaaacaucggcuccaacgccgucaacugguaccaacaacuccccggcaccgcccccaaacuccucaucuacuccaacaaccaacgccccuccggcguccccgaccgcuucuccggcuccaaauccggcaccuccgccucccucgccaucuccggccuccaauccgaagacgaagccgacuacuacugcgccgccugggacgacucccucuccggcuccugggucuucggcggcggcaccaaacucaccguccuc

SEQ ID NO: 58323 - RNA, 333 nt, Artificial Sequence
  derived and/or modified sequence opt11 from anti-influenza_Chain
gaaaccacccucacccaaucacccggcacccucucccucucccccggcgaacgcgccacccucuccugccgcgucucccaauccgucuccuccaacuaccucgccugguaccaacaaaaacccggccaagccccccgccuccucaucuacggcgccuccucccgcgccaccggcauccccgaccgcuucuccggcuccggcuccggcacagacuucacccucaccaucucccgccucgaacccgaagacuucgccgucuacuacugccaacaauacggcaccuccccccgcgccuucggccacggcaccaaagucgaaaucaaacgcaccguc

SEQ ID NO: 58324 - RNA, 333 nt, Artificial Sequence
  derived and/or modified sequence opt11 from anti-influenza_Chain
caauccguccucacccaaccccccuccgucuccggcgcccccggccaacgcgucaccaucucaugcggcggcucccgcucaaacaucggcgccggcuacgacguccacugguaccaacaauuccccggcaccgcccccaaagucgucaucuacggcaacaacaaccgccccuccggcguccccgaccgcuucuccggcuccaaauccggcaccuccgccucccucgccaucaccggccuccaagccgaagacgaagccaacuacuacugccaaucauacgacaccaaccucggcggcuccaucuucggcggcggcacccaagucaccguccuc

SEQ ID NO: 58325 - RNA, 333 nt, Artificial Sequence
  derived and/or modified sequence opt11 from anti-influenza_Chain
aacuucaugcucacccaaccccacuccgucuccgaaucccccggcaaaaccgucaccaucuccugcaccggauccuccggcuccaucgccuccaacuacguccaaugguaccaacaacgccccggcuccgcccccaccaccgucaucuacgaagacuaccaacgccccuccggcguccccgaccgcuucuccggcuccaucgacuccuccuccaacuccgccucccucaccaucuccggccucaaaaccgaagacgaagccgacuacuacugccaauccuacgacgacuccgaccaccucaucuucggcggcggcaccaaacucaccguccuc

SEQ ID NO: 58326 - RNA, 333 nt, Artificial Sequence
  derived and/or modified sequence opt11 from anti-influenza_Chain
caauccaugcucacccaaccccccuccgccuccggcacccccggccaacgcgucacuaucuccugcuccggcuccuccuccaacaucggcuccaacaccgucaacugguucaaacaccuccccggcaccgcccccaaacuccucaucuaccgcaacgaccuccgccccuccggcguccccgaccgcuucuccggcuccaaauccggcaccuccgccucccucgccaucuccggccuccaauccgaagacgaagccgacuacuacugcgccaccugggacgacucccucaacggauucuacgucuucggcaccggcaccaaagucaccguccuc

SEQ ID NO: 58327 - RNA, 333 nt, Artificial Sequence
  derived and/or modified sequence opt11 from anti-influenza_Chain
gacauccaacucacccaaucccccuccucccucuccgcauccgccggcgaccgagucuccaugaccugccgcgccucccaaaucaucuccuccucccucaacugguaccaacaaaaacccggcaaagcccccaaacuccucauauacgccgccuccaaccuccaauccggcguccccucccgcuucuccggcuccggcuccggcaccgacuucacccucaccaucuccucccuccaacccgaagacuucgccaccuacuacugccaacaauccuacuccaccccccccgaacucaccuucggcggcggcaccaaagucgacaucaaacgcacc

SEQ ID NO: 58328 - RNA, 333 nt, Artificial Sequence
  derived and/or modified sequence opt11 from anti-influenza_Chain
uccuacguccucacccaaccccccuccgccuccggcacccccggccaacgcgucaccaucuccugcuccggcuccaccuucaacaucggcuccaacgccgucgacugguaccgccaacuccccggcaccgcccccaaacuccucaucuacuccaacaaccaacgccccuccggcguccccgaccgcuucuccggcucccgcuccggcaccuccgccucccucgccaucuccggccuccaauccgaagacgaagccgacuacuacugcgccgccugggacgacauccucaacguccccgucuucggcggcggcaccaaacucaccguccucggc

SEQ ID NO: 58329 - RNA, 333 nt, Artificial Sequence
  derived and/or modified sequence opt11 from anti-influenza_Chain
caauccgcccucacccaacccgccgccgucuccggcucccccggccaauccaucaccaucuccugcaccggcaccuccuccgacgucggcggcuacaacuacgucuccugguaccaacaacaccccggcaaagcccccaaacucaugaucuacgaagucuccaaccgccccuccggcgucuccaaccgcuucuccggcuccaaauccggcaacaccgccucccucaccaucuccggccuccaagccgaagacgaagccgacuacuacugcuccuccuacaccuccuccuccaccuacgucuucggcaccggcaccaaagucaccguccucggc

SEQ ID NO: 58330 - RNA, 333 nt, Artificial Sequence
  derived and/or modified sequence opt11 from anti-influenza_Chain
uccuacguccucacccaaccccccuccgucuccggcacccccggccaacgcgucaccaucuccugcuccggcucccgcuccaacgucggcgacaacuccgucuacugguaccaacacguccccgaaauggcccccaaacuccucgucuacaaaaacacccaacgccccuccggcguccccgcccgcuucuccggcuccaaauccggcaccuccgccucccucgccaucaucggccuccaauccggcgacgaagccgacuacuacugcgucgccugggacgacuccgucgacggcuacgucuucggcuccggcaccaaagucacaguccucggc

SEQ ID NO: 58331 - RNA, 333 nt, Artificial Sequence
  derived and/or modified sequence opt11 from anti-influenza_Chain
uccguccucacccaaccacccuccgucuccgccgcccccggccaaaaagucaccaucuccugcuccggcuccuccuccaacaucggcaacgacuacgucuccugguaccaacaacuccccggaaccgcccccaaacuccucaucuacgacaacaacaaacgccccuccggcauccccgaccgcuucuccggcuccaaauccggcaccuccgccacccucggcaucaccggccuccaaaccggcgacgaagccaacuacuacugcgccaccugggaccgccgccccaccgccuacgucgucuucggcggcggcaccaaacuaaccguccucggc

SEQ ID NO: 58332 - RNA, 333 nt, Artificial Sequence
  derived and/or modified sequence opt11 from anti-influenza_Chain
caauccgcccucacccaaccccgcuccgucuccggcucccccggccaauccgucaccaucuccugcaccggcaccuccuccgacgucggcggcuacaacuacgucuccugguaccaacaacaccccggcaaagcccccaaacucaugaucuacgacgucuccaaacgccccuccggcguccccgaccgcuucuccggcuccaaauccggcaacaccgccucccucaccaucuccggccuccaagccgaagacgaagccgacuacuacugcuccuccuacaccuccuccuccacccacgucuucggcaccggcaccaaagucaccguccucggc

SEQ ID NO: 58333 - RNA, 333 nt, Artificial Sequence
  derived and/or modified sequence opt11 from anti-influenza_Chain
uccuacguccucacccaaccacccucagccuccggcacccccggccaacgcgucaccaucuccugcuccggcuccuccucaaacaucggcuccaacuacgucuacugguaccaacaacuccccggcaccgcacccaaacuccucaucuaccgcgacggccaacgccccuccggcguccccgaccgcuucuccggcucaaaauccggcaccuccgccucccucgccaucuccggccuccgcuccgacgacgaagccgacuacuacugcgccaccugggacgacaaccucuccggccccgucuucggcggcggcaccaaacucaccguccucggc

SEQ ID NO: 58334 - RNA, 333 nt, Artificial Sequence
  derived and/or modified sequence opt11 from anti-influenza_Chain
caauccgcccucacccaacccgccuccgucuccggcucccccggccaauccaucacaaucuccugcaccggcaccuccuccgacgucggcggcuacaacuacgucuccugguaccaacaacaccccggcaaagcccccaaacucaugaucuacgaagucuccaaccgccccuccggcgucuccaaccgcuucuccggcuccaaauccggcaacaccgccucccucaccaucuccggccuccaagccgaagacgaagccgacuacuacugcuccuccuacaccuccucauccacccuagucuucggcaccggcaccaaagucaccguccucggc

SEQ ID NO: 58335 - RNA, 333 nt, Artificial Sequence
  derived and/or modified sequence opt11 from anti-influenza_Chain
accgugcuaacgcaaccgcccucggucucgggcgcgcccgggcaaagggucacgaucucgugcacgggcucgagcucgaacauuggcgcgggcuaugacgugcacugguaccagcaauugcccgggaccgcgcccaagcucuugaucuauggcaauagcaaucgcccgagcggggucccggacagguucucgggcucgaaaucaggcacgagcgcaaccuugggcauaaccgggcuccagaccggggacgaggccgauuacuauugcgggaccugggacucgagcuugagcgcguacguguucgggaccgggaccaaggucacggucuugggc

SEQ ID NO: 58336 - RNA, 333 nt, Artificial Sequence
  derived and/or modified sequence opt11 from anti-influenza_Chain
gggagcgcgcucacgcaaccgcgcucggucucgggcucgcccgggcaaucggucacgaucucgugcacgggcacgagcucggacgugggcggguacaauuacgugagcugguaccagcaacaucccgggaaagcgcccaagcucaugaucuaugacgugagcaagcgcccgagcggggucccggacagguucucgggcucgaaaucgggcaauaccgcgagcuugaccauaagcgggcuccaggccgaggacgaggccgauuacuauugcucgagcuauaccucgagcucgacccaugucuuuggcacgggcacgaaagugaccgugcucggg

SEQ ID NO: 58337 - RNA, 333 nt, Artificial Sequence
  derived and/or modified sequence opt11 from anti-influenza_Chain
gaaaucguccucacccaaucccccggcacccucucacucucccccggcgaacgcgccacccucuccugccgcgccucccaauccgucuccuccuccuaccucgccugguaccaacaaaaacccggccaagcaccccgccuacucaucuucggcgccuccacccgcgccaccggcauccccgaccgcuucuccggcuccggcuccggcaccgacuucacccucaccaucucccgccucgaacccgaagacuucgccgucuucuacugccaacaauacggcucccuaccccucaccuucggcggcggcaccaaagucgaaaucaaaggcaccguc

SEQ ID NO: 58338 - RNA, 333 nt, Artificial Sequence
  derived and/or modified sequence opt11 from anti-influenza_Chain
gaaaucguccuaacccaaucccccggcacccucucccucucccccggcgaacgcgccacccucuccugccgcgccucccaauccguccgcuccaacaaccucgccugguaccaacacaaacccggccaagccccccgccuccucaucuucggcgccuccucccgcgccaccggcauccccgaccgcuucuccggcuccggcuccggcaccgacuucacccucaccaucucccgccucgaacccgaagacuucgccgucuacuacugccaacaauacggcuccucccccgcccucaccuucggaggcggcaccaaagucgaaaucaaacgcacc

SEQ ID NO: 58339 - RNA, 333 nt, Artificial Sequence
  derived and/or modified sequence opt11 from anti-influenza_Chain
cagagcuuggaagagagcgggggcgggcucgugaaaccgggcgggagcuugaccuugaccuguaccgugagcgggcuaucacucuauagcaaugaaauaaacugggucaggcaagcgcccgggaacggacucgaguggauaggcgcgaucgcgggcucgggcucggccgauuacgcgagcugggccaagggcaggagcacgaucacgcgcaauaccgaucucaauaccgugacauugaaaaugaccucgcucacggccgcggacacggccacguacuuuugcgcgagcuuuugggaucucuggggcccgggcacgcucgugaccgugagcucg

SEQ ID NO: 58340 - RNA, 333 nt, Artificial Sequence
  derived and/or modified sequence opt11 from anti-influenza_Chain
cagagcguggaagagagcgggggcgggcucgugaaaccgggcgggagccugaccuugaccuguaccgugagcgggcucucgcucuauagcaaugaaauaaacugggucaggcaagcgcccgggaacgggcucgaguggauaggcgcgaucgcgggcucgggaucggccgauuacgcgagcugggccaagagcaggagcacgaucacgcgcaauaccaaucucaauaccgugaccuugaaaaugaccucgcucacggccgcggacacggccacguacuuuugcgcgagcuuuugggaucucuggggcccgggcacgcucgugaccgugagcucg

SEQ ID NO: 58341 - RNA, 333 nt, Artificial Sequence
  derived and/or modified sequence opt11 from anti-influenza_Chain
cagagcuuggaagagagcgggggcgggcuagugaaaccgggcgggagccugaccuugaccuguacagugagcgggcucucgcucuauagcaaugaaauaaacugggucaggcaagcgcccgggaacgggcucgaguggauaggcgcgaucgcgggcucgggcucggccgauuacgcgagcugggccaagagcaggagcacgaucacgcgcaauaccaaucucaauaccgugacccugaaaaugaccucgcucacggccgcggacacggccacguacuuuugcgcgagcuuuugggaucucuggggcccaggcacgcucgugaccgugagcucg

SEQ ID NO: 58342 - RNA, 333 nt, Artificial Sequence
  derived and/or modified sequence opt11 from anti-influenza_Chain
aauaucgugcucacgcaaucgcccgcgagcuuggccgugagcuugggccagcgcgcgaccauaagcugucgcgcgagcgagagcguggacauauacgggaacucguucaugcacugguaccagcaaaagcccgggcaaccgcccaagcucuugaucuaucucgcgagcaagcucgagugcggggucugugccagguucaauggcucgggcugucgcacggacuuuaccuuggccauagacccggucgagggcgaugacggggccacguacuauugccagcaaaauuacgaggacccguggacguucgggggcgggaccaagcucgagaucaag

SEQ ID NO: 58343 - RNA, 333 nt, Artificial Sequence
  derived and/or modified sequence opt11 from anti-influenza_Chain
aauaucgugcucacgcaaucgcccgcgagcuuggccgugagcccgggccagcgcgcgaccauaagcugucgcgcgagcgagagcauagacauauacgggaacucguucaugcacugguaccagaaaaagcccgggcaaccgcccaagcucuugaucuaucgcgcgagcaaucucgagagcggggucccggccagguucaauggcucgggcucgcgcacggacuuuacccugaccauagacccggucgagggcgaugacggggccacguacuauugccagcaaaauuacgaggacccguggacguucgggggcgggaccaagcucgagaucaag

SEQ ID NO: 58344 - RNA, 333 nt, Artificial Sequence
  derived and/or modified sequence opt11 from anti-influenza_Chain
gaaaucguccuaacccaaucccccgccacccucucccucuaccccggcgaacgcgccacccucuccugccgcgccucccaauccgucucccgcuaccucgccugguaccaacaaaaacccggccaagccccccgccuccucaucuacgacgccuccaaccgcgccaccggcauccccgcccgcuucuccggcuccggcuccggcaccgacuucacccucaccaucuccucccucgaacccgaagacuucgccgucuacuacugccaacaacgcuccaacuggcuaaaaaucaccuucggccaaggcacccgccucgaaaucaaaggcaccguc

SEQ ID NO: 58345 - RNA, 336 nt, Artificial Sequence
  derived and/or modified sequence opt11 from anti-influenza_Chain
gacaucgucaugacccaaucccccgacucccucgccgucucccucggcgaacgcgccaccaucaacugcaaauccucccaauccguccucuacuccuccaacaacaaaaacuaccucgccugguaccaacaaaaacccggccaaccccccaaacuccucaucgacugggccuccacccgcgaauccggcguccccgaccgcuucuccggcuccggcuccggcaccgacuucacccucaccaucuccaaccuccaagucgaagacgucgccgucuacuacugccaacaauacuaccgcucccccuccuucggccaaggcaccaaacucgaaaucaaa

SEQ ID NO: 58346 - RNA, 336 nt, Artificial Sequence
  derived and/or modified sequence opt11 from anti-influenza_Chain
gacaucgucaugacccaaaccccccucucccucuccgucacccccggccaacccgccuccaucuccugcaaauccucccaaucccuccuccacuccgacggcaaaaccuaccucuacugguaccuccaaaaacccggccaauccccccaacuccucaucuacgaagucuccaaccgcuucuccggcguccccgaccgcuucuccggcuccggcuccggcaccgacuucacccucaaaaucucccgcgucgaagccgaagacgucggcgucuacuacugcaugcaaaacauccuccucccccucaccuucggcggcggcaccaaagucgaaaucaaa

SEQ ID NO: 58347 - RNA, 336 nt, Artificial Sequence
  derived and/or modified sequence opt11 from anti-influenza_Chain
gaaaucgucaugacccaaacaccccucucccucuccgucacccccggccaacccgccuccaucuccugccgcuccucccaaucccuccuccacuccgacggcaaaaccuaccucuacugguaccuccaaaaacccggccaaccaccccaacuccucaucuccgaagucuucaaccgcuucuccggcguccccgaccgcuucuccggcuccggcuccggcaccgacuucacccucaaaaucucccgcgucgaagccgaagacgucggcgucuacuacugcaugcaaucccuccaacucccccucaccuucggcggcggcaccaaagucgaaaucaaa

SEQ ID NO: 58348 - RNA, 336 nt, Artificial Sequence
  derived and/or modified sequence opt11 from anti-influenza_Chain
gacaucgucaugacccaauccccccuaucccuccccgucacccccggcgaacccgccuccaucuccugccgcgccucccaaucccuccuccacuccaacggcuacaacuaccucgacugguaccuccaaaaacccggccaauccccccaacuccucauccaacucggcuccacccgcgccuccggcguccccgaccgcuucucaggcuccggcuccggcaccgacuucacccucgaaauaucccgcgucgaagccgaagacgucggcgucuacuacugcaugcaagcccuccaacucccccucgccuucggccaaggcacccgccucgaaaucaaa

SEQ ID NO: 58349 - RNA, 336 nt, Artificial Sequence
  derived and/or modified sequence opt11 from anti-influenza_Chain
gacaucguaaugacccaauccccccucucccuccccgucucccccggcgaacccgcauccaucuccugccgcuccucacaaucccuccuccacggcaacggcuacaacuaccucgacugguaccuccaaaaacccggccaauccccccgccuacucaucuaccucggcuccaaccgcgccuccggcguccccgaccgcuucuccggcuccggcuccggcaccgacuucacccucaaaaucucccgcgucgaagccgaagacgucggcgucuacuacugcaugcaagcccuccaaaccccccucaccuucggcggcggcaccaaagucgaaaucaaa

SEQ ID NO: 58350 - RNA, 336 nt, Artificial Sequence
  derived and/or modified sequence opt11 from anti-influenza_Chain
caauccguccucacccaaccccccuccgucuccggcgcccccggccaacgcgucaccaucuccugcaccggcuccucaucaaacaucggcgccggcuacgacguccacugguaccaacaacuccccggcaccgcccccaaacuccuaaucuacgacaacaacaaccgccccuccggcguccccgaccgcuucuccggcuccaaauccggcgccucagccucccucgccaucaccggccuccaagccgaagacgaagcccacuacuacugccaauccuacgacaacucccucuccggcuccgucuucggcggcggcacccaacucaccguccucucc

SEQ ID NO: 58351 - RNA, 336 nt, Artificial Sequence
  derived and/or modified sequence opt11 from anti-influenza_Chain
caauccguccucacccaaccccccuccgucuccggcgcccccggccaacgcgucaccaucuccugcaccggcuccuccuccaacaucggcuccgacuacgacguccacugguacaaacaacuccccggcaccgcccccaaacuccucaucuucggcaacuccaaccgccccuccggcguccccgaccgcuucuccggcuccaaauccggcaccuccgccucccucgccaucaccggccuccaagccgaagacgaagccgacuacuacugccaauccuacgacuccucccucuccggcuuccacgucuucggcuccggcaccaaagucaccguccuc

SEQ ID NO: 58352 - RNA, 336 nt, Artificial Sequence
  derived and/or modified sequence opt11 from anti-influenza_Chain
caauccguccucacccaaccccccuccgucuccgccgcccccggccaaaaagucaccaucuccugcuccggcuccuccuccaacaucggcaacgacuacgucuccugguaccaacaacuacccggaaccgcccccaaacuccucaucuacgacaacaacaaacgccccuccggcauccccgaccgcuucuccggcuccaaauccggcaccuccgccacccucggcaucaccggccuacaaaccggcgacgaagccaacuacuacugcgccaccugggaccgccgccccaccgccuacgucgucuucggcggcggcaccaaacucaccguccucggc

SEQ ID NO: 58353 - RNA, 336 nt, Artificial Sequence
  derived and/or modified sequence opt11 from anti-influenza_Chain
gaaaucguacuaacccaaucccccggcacccucucccuaucccccggcgaacgcgccacccucuccugccgcgccucccaaucagucuccuccuccuaccucgccugguaccaacaaaaacccggccaagccccccgccuccuaaucuacggcgccuccacccgcgccaccggcauccccgaccgcuucuccggccgcggcuccggcacagacuucacccucaccaucuccucccucgaacccgaagacuucgccgucuacuacugccaaaacuacggcucccccuuccucuucaccuucggccccggcaccaaagucgacaucaaacgcaccguc

SEQ ID NO: 58354 - RNA, 336 nt, Artificial Sequence
  derived and/or modified sequence opt11 from anti-influenza_Chain
gacauccaacucacccaauccccccucuccccccccgucacccucggccaacccgccuccaucuccugccgcuccucccaaucccuccucuacaccgacggcuucaccuaccucuccugguaccaccaacgccccggccaauccccccgccgccucaucuacaaaaucuccaaccgcgacuccggcguccccgaccgcuucuccggcuccggcuccggcaccgacuucacccucaaaaucucccgagucgaagccgaagacgucggcgucuacuacugcaugcaagccacccacuggccccucaccuucggcgaaggcacaaaagucgaaaucaaa

SEQ ID NO: 58355 - RNA, 336 nt, Artificial Sequence
  derived and/or modified sequence opt11 from anti-influenza_Chain
gacaucgaacucacccaagaacccuccgccuccggcacccccggccaacgcgucaccaucuccugcuccggcgacaccuccaacaucggcuccaacaccgucuccugguuccaacuccuccccggcaccgcccccaaacuccuaaucuucaccgacaaccaacgccccuccggaguccccggccgcuucucaggcuccaaauccggcaccucagccucccucgccaucuccggccuccaauccgaagacgaaaccgacuacuacugcgccgccugggacgacucccucaacggcugggucuucggcggcggcacaaaacucaccguccucggccaa

SEQ ID NO: 58356 - RNA, 336 nt, Artificial Sequence
  derived and/or modified sequence opt11 from anti-influenza_Chain
gacaucguccucacccaaucccccuccgccuccggcucccccggccaauccgucaccaucuccugcacaggcaccuccuccgacgucggcggcuacgacuacgucuccugguaccaacaacaccccggcaaagcccccaaacucaugaucuacgaaguccgcaaacgccccuccggcguccccgaccgcuucuccggcuccaaauccggcaacaccgccucccucaccgucuccggccuccaagccgaagacgaagccuacuacuacugcgccuccuacgccggcaccuacauccaccucuucggcggcggaaccaaacucaccguccucggccaa

SEQ ID NO: 58357 - RNA, 336 nt, Artificial Sequence
  derived and/or modified sequence opt11 from anti-influenza_Chain
caagagcaauugauggagagcgggggcgggcucgugaaaccgggcgggagcuugaccuugaccuguaccgugagcgggcucucgcucuauagcaaugaaauaaacugggucaggcaagcgcccgggaacgggcucgaguggauaggcgcgauagcgggcucgggcucggccgauuacgcgagcugggccaagagcaggagcacgaucacgcgcaauaccaaucucaauaccgugaccuugaaaaugaccucgcucacggccgcggacacggccacguacuuuugcgcgagcuuuugggaucucuggggcccgggcacgcucgugaccgugagcucg

SEQ ID NO: 58358 - RNA, 336 nt, Artificial Sequence
  derived and/or modified sequence opt11 from anti-influenza_Chain
caacagcaauugauggagagcgggggcgggcucgugaaaccgggcgggagcuugaccuugaccuguaccgugagcgggcucucgcucuauagcaaugaaauaaacugggucaggcaagcgcccgggaacgggcucgaguggauaggcgcgaucgcgggcucgggcucggccgauuacgcgagcugggccaagagcaggagcacgaucacgcgcaauaccgaucucaauaccgugaccuugaaaaugaccucgcucacggccgcggacacggccacguacuuuugcgcgagcuuuugggaucucuggggcccgggcacgcucgugaccgugagcucg

SEQ ID NO: 58359 - RNA, 336 nt, Artificial Sequence
  derived and/or modified sequence opt11 from anti-influenza_Chain
caacagcaauuggucgagagcgggggcgggcucgugaaaccgggcgggagcuugaccuugaccugucgcgugagcgggcucucgcucuuuagcaaugaaauaaacugggucaggcaagcgcccgggaacgggcucgaguggauaggcgcgaucgggggcgggggcucggccgauuacgcgagcugggccaagagcaggagcacgaucacgcgcaauaccaaucucaauaccgugaccuugcgcaugaccucgcucacggccgcggacacggccgcguacuuuugcgcgagcuuuugggaucucuggggcccgggcacgcucgugaccgugagcucg

SEQ ID NO: 58360 - RNA, 336 nt, Artificial Sequence
  derived and/or modified sequence opt11 from anti-influenza_Chain
gaagugcaauuggucgagagcgggggcgggcucgugaaaccgggcgggagcuugcgcuugagcugugccgcgagcgggcucucgcucuuuagcaaugaaauaaacugggucaggcaagcgcccgggaaagggcuagaguggauaggcgcgaucgggggcgggggcucggccgauuacgcgagcugggccaagagcagguucacgaucucgcgcgauaacgcgaaaaauagcuuguacuugcaaaugaacucgcucagggccgaggacacggccguguacuuuugcgcgagcuuuugggaucucuggggcccgggcacgcucgugaccgugagcucg

SEQ ID NO: 58361 - RNA, 336 nt, Artificial Sequence
  derived and/or modified sequence opt11 from anti-influenza_Chain
gacaucgucaugacccaauccccccuaucccuccccgucacccccggcgaacccgccuccaucuccugccgcuccucccaaucccuccuccgcuccaacggcuacaacuaccucgacugguaccuacaaaaacccggccaauccccccaacuccucaucuaccucggcuccaaccgcgccuccggcguccccgaccgcuucuccggcuccggcuccggcaccgacuucacccucaaaaucucccgcgucgaagccgaagacgucggcgucuacuacugcaugcaagcccuccaaacccccuacaccuucggccaaggcaccaaacucgaaaucaaa

SEQ ID NO: 58362 - RNA, 339 nt, Artificial Sequence
  derived and/or modified sequence opt11 from anti-influenza_Chain
gacaucgucaugacccaauccccagacuuccuccccgucucccucggcgaacgcgccaccaucaacugcaaauccucccaacgcguccucuacuccuccaacaacaaaaacuaccucgccugguaccaacucaaacccggccaaccccccaaacucaucaucuacugggccuccacccgcgaauccggcguccccgaccgcuucuccggcuccggcuccggcaccgaauucacccucaccaucuccucccuccaagccgaagacgucgccgucuacuacugccaacaauacuacucccgccccuacaccuucggccaaggcaccaaacucgaaaucaaa

SEQ ID NO: 58363 - RNA, 339 nt, Artificial Sequence
  derived and/or modified sequence opt11 from anti-influenza_Chain
gacaucgucaugacccaaucccccgacucccucgccgucucccucggcgaacgcgccaccaucaacugcaaauccucccaauccguccucuacuccuccaacaacaaaaacuaccucgccugguaccaacaaaaacccggccaaccccccaaacuccucaucuacugggccuccacccgcgaauccggcguccccgaccgcaucuccggcuccggcuccggcgccgacuucacccucaccaucuccucccuccaagccgaagacgucgccgucuacuacugccaacaauacuucgccaccccccgcaccuucggccaaggcaccaaagucgaaaucaaa

SEQ ID NO: 58364 - RNA, 339 nt, Artificial Sequence
  derived and/or modified sequence opt11 from anti-influenza_Chain
gacaucgucaugacccaaucccccgacucccucgccgucucccucggcgaacgcgccaccaucaacugcaaauccucccaauccguccucuacucauccaacaacaaaucccaccucgccugguaccaacaaaaacccggccaaccccccaaacuccucaucuacugggccuccacccgcgaauccggcguccccgaccgcuucuccggcuccggcucaggcaccgacuucacccucaucaucuccucccuccaagccgaagacgucgccgucuacuacugccaacaauacuacuucuccccccucaccuucggcggcggcaccaaagucgaaaucaaa

SEQ ID NO: 58365 - RNA, 339 nt, Artificial Sequence
  derived and/or modified sequence opt11 from anti-influenza_Chain
gacaucgucaugacccaaucccccgacucccucgccgucucccucggcgaacgcgccaccaucaacugccgcuccucccaauccaucuuccacaacuccaacaacgaaaacuaccucgccugguaccaacaaaaacccggccaaccccccaaacuccucaucuacugggccuccacccgcgaauccggcguccccgaccgcuucuccggcuccggcucaggcaccgacuucacccucaccaucuccucccuccaagccgaagacgucgccgucuacuucugccaacaauacuacaacgccccccucaccuucggcggcggcaccaaagucgaaaucaaa

SEQ ID NO: 58366 - RNA, 339 nt, Artificial Sequence
  derived and/or modified sequence opt11 from anti-influenza_Chain
gaaaucguccucacacaauccccccucucccuccccgucacccccggcgaacccgccuccaucuccugccgcucaucccaaucccuccuccacuccaacggcuacaacuaccucgacugguaccuccaaaaacccggccaauccccccaacuccucaucuaccucggcuccaaccgcgccuccggcguccccgaccgcuucuccggcuccggcuccggcaccgacuucacccucaaaaucucccgcgucgaagccgaagacgucggcgucuacuacugcaugcaagcccuccaaaccccccucaccuucggcggcggcaccaaagucgaaaucaaacgc

SEQ ID NO: 58367 - RNA, 339 nt, Artificial Sequence
  derived and/or modified sequence opt11 from anti-influenza_Chain
gacaucguccucacccaaccccccuccguauccgucgcccccggccaaaccgccaccaucaccugcggcggcaacuacaucggcuccaaaucagucaacugguaccaacaacgacccggccacgcccccguccucgucgucuacgacgacuccgaccgccccuccggcaucccagaccgcuucuccggcuccaacucccgcuccaccgccaccaccgccacccucaccaucucccgcgucgaagcaggcgacgaagccgacuacuacugccaagucugggaaaccuccgaagaccucugggucuucggcggcggcaccaaacucaccguccucggccaa

SEQ ID NO: 58368 - RNA, 342 nt, Artificial Sequence
  derived and/or modified sequence opt11 from anti-influenza_Chain
gacgucgucaugacccaaucccccgacucccucgccgucucccucggcgaacgcgccaccaucaacugcaaauccucccaauccguccucuacuccuccaacaacaaaaacuaccucgccugguaccaacaaaaacccggccaaccccccaaacuccucaucuacugggccuccacccgcgaauccggcguccccgaccgcuucuccggcuccggcuccggcaccgacuucacccucaccaucuccucccuccaagccgaagacgucgccgucuacuacugccaacaauacuacuccaccccccucaccuucggcggcggcaccaaagucgacaucaaacgc

SEQ ID NO: 58369 - RNA, 342 nt, Artificial Sequence
  derived and/or modified sequence opt11 from anti-influenza_Chain
gacauccaaaugacccaaucccccgacucccucgccgucucccucggcgaaaaagccaccaucaacugcaaauccucccaauccauccucaacuccuccaacaacaaaaacuaccucgccugguaccaacaaaaacccggccaaccccccaaacuccucaucuacugggccuccacccgcgaauccggcguccccgaccgcuucuccggcuccggcuccggcaccgacuucacccucaccaucuccucccuccaagccgaagacgucgccgucuacuacugccaacaauacuacuccuccccccccacauucggccaaggcaccaaagucgaaaucaaacgc

SEQ ID NO: 58370 - RNA, 342 nt, Artificial Sequence
  derived and/or modified sequence opt11 from anti-influenza_Chain
gagaucgugcucacacaaucgcccgcgaccuugagcuuguacccgggcgagcgcgcgaccuugagcugucgcgcgagccagagcgugagcagguacuuggccugguaccagcaaaagcccgggcaagcgcccaggcucuugaucuaugacgcgagcaaucgcgcgaccgggaucccggccagauucucgggcucgggcucgggcacggacuuuacccugaccauaagcucgcucgagcccgaggacuuugccguguacuauugcugugacaggcaacagcgcucgaacuggcucaagaucacguucgggcaagggaccaggcucgagaucaagggcacgguc

SEQ ID NO: 58371 - RNA, 342 nt, Artificial Sequence
  derived and/or modified sequence opt11 from anti-influenza_Chain
gacaucgucaugacccaaucccaaaaauucgucuccaccuccgucggcgaccgcgucuccgucaccugcaaagccucccaaaacgucggcuccaacgucgccugguaccaacacaaacccggccacucccccaccgcccucaucuacuccgccucccaccgcuacuccggcguccccgaccgcuucaccggcuccgaauccggcaccgacuucacccucaccaucuccaacguccaauccgaagaccucgccgaauacuucugccaacaauacuacuccuaccccuacaccuucggcggcggcaccaaacucgaaaucaaacgcgccgacgccgcccccacc

SEQ ID NO: 58372 - RNA, 342 nt, Artificial Sequence
  derived and/or modified sequence opt11 from anti-influenza_Chain
gacaucgaaaugacccaauccccccucucccuccccgucacccccggcgaauccgccuccaucuccugccgcuccucccaaucccuccuccacuccaacggcuacaacuaccucgacugguaccuccaaaaacccggccaauccccccaacuccucaucuaccucggcuccucccgcgccuccggcguccccgaccgcuucuccggcuccggcuccggcaccgacuucacccucaaaaucucccgcgucgaagccgaagacgucggcgucuacuacugcaugcaaggccuccaaacccccuacaccuucggccaaggcaccaaacucgaaaucaaacgcacc

SEQ ID NO: 58373 - RNA, 342 nt, Artificial Sequence
  derived and/or modified sequence opt11 from anti-influenza_Chain
gacaucgaaaugacccaauccccccucucccuccccgucacccccggcgaacccgccuccaucuccugccgcuccucccaaucccuccuccacuccaacggcuacaaccaccucgccugguaccuccaaaaacccggccgcuccccccaccuccucaucuaccucgccuccacccgcgccuccggcguccccgaccgcuucuccggcuccggcuccggcaccgacuucacccucaaaaucucccgcgucgaagccgaagacgucggcaucuacuacugcaugcaaucccuacaaaccuccaucaccuucggccaaggcacccgccucgaaaucaaacgaacc

SEQ ID NO: 58374 - RNA, 345 nt, Artificial Sequence
  derived and/or modified sequence opt11 from anti-influenza_Chain
caagugcaauugguccagagcggggccgaggucaagaaaccgggcucgagcgugcgcgugagcuguaaaacgagcgggggcacguucucgagcuaugccgugaccugggucaggcaagcgcccgggcaagggcucgaguggaugggcgggaucauaggcauguucgggaccacgaacuaugcccagaaauuucaagggcgcuugaccauaaccgcggacgagaugacgagcacggccuauauggagcucucgagcuugcgcucggaagauaccgcggucuauuacugugccaggggcucguacuauuacgagaccacgcucgauuacuggggcaggggcacgcuc

SEQ ID NO: 58375 - RNA, 345 nt, Artificial Sequence
  derived and/or modified sequence opt11 from anti-influenza_Chain
gaagugcaauugguccagagcggggccgaggucaagaaaccgggcucgagcgugaaagugagcuguaaaacgagcgggggcacguucucgagcuaugccgugaccugggucaggcaagcgccagggcaagggcucgaguggaugggcgcgaucauaggcauguucgggaccacgaacuaugcccagaaauuucaagggcgcgugaccauaaccgcggacgagcucacgagcacggccuauauggagcucucgagcuugcgcucggacgauaccgcggucuauuacugugccaggggcucguacuauuacgagagcucgcuagauuacuggggcaagggcacgcuc

SEQ ID NO: 58376 - RNA, 345 nt, Artificial Sequence
  derived and/or modified sequence opt11 from anti-influenza_Chain
cagguccagcucgugcaaucgggcgcggaagugaaaaagcccgggagcucggucaaggucucgugcaagaccucgggcgggaccuuuagcucguacgcggucacgugggugcgccaggccccgggccagggcuuggaauggaugggcgggauaaucgggauguuuggcacgaccaauuacgcgcaaaaguuccagggcagggucacgaucacggccgaugaauugaccucgaccgcguacauggaauugagcucgcucaggagcgaggacacggccguguacuauugcgcgcgcgggagcuauuacuaugaaucgagcuuggacuauugggggcgcgggaccuug

SEQ ID NO: 58377 - RNA, 345 nt, Artificial Sequence
  derived and/or modified sequence opt11 from anti-influenza_Chain
gaagugcaacugguccagagcggggccgaggucaagaaaccgggcgcgagcgugaaagugagcuguaaagcgagcggguacacguucacgggcuauuacguguacugggucaggcaagcgcccgggcaagggcucgaguggaugggcuggaucucggccuauaacgggaacacgaacuaugcccagaaauuucaagggcgcgugaccauaaccgcggacaagagcacgagcacggccuauauggagcucucgagcuugcgcucggaagauaccgcggucuauuacugugccagaagcaggagcuuggacgugugggggcaagggaccacggucacggucucgagc

SEQ ID NO: 58378 - RNA, 345 nt, Artificial Sequence
  derived and/or modified sequence opt11 from anti-influenza_Chain
gacaucgucaugacccaauccccccucucccuccccgucacccccggcgaacccgccuccaucuccugccgcuccucccaaucccuccuccacuccaacggccacaucuacuucgacugguaccuacaaaaacccggccaauccccccaacuccucaucuaccucgucuccaaacgcgccuccggcguccccgaccgcuucuccggcuccggcuccggcaccgacuucacccucaaaaucucacgcgucgaagccgaagacgucggcgucuacuacugcaugcaagcccucgaaacccccuucaccuucggccccggcaccaaaguccacaucaaacgcaccguc

SEQ ID NO: 58379 - RNA, 345 nt, Artificial Sequence
  derived and/or modified sequence opt11 from anti-influenza_Chain
caauccgcccucacccaacccgccuccgucuccggcucccccggccaauccaucaccaucuccugcaccggcaccuccuccgacgucggcgccuacaacuacgucuccugguaccaacaccaccccggcaaagcccccaaacucaugaucuacgacgucaccuaccgccccuccggcgucuccacccgcuucuccggcuccaaauccggcaacaccgccucccucaccaucuccggccuacaagccgaagacgaagccgacuacuacugcuccucccaaucccgcuccuccacccucgucaucuucggcggcggcaccaaacucaccguccucggccaacccaaa

SEQ ID NO: 58380 - RNA, 345 nt, Artificial Sequence
  derived and/or modified sequence opt11 from anti-influenza_Chain
gacaucguccucacccaaucacccgucucccucgccgucucccucggcgaauccgccaccgucaacugcaaauccucccaauccguccucuccaacuccaaaaaccucaacuaccucgccugguaccaacacaaacccggccaaccccccaaacuccucaucuacugggccuccacccgcgaauccggcguccccgaccguuucucaggcuccggcuccggcaccgacuucacccucaccaucuccucacuccaagccgaagacgucgccgucuacuacugccaacaacacuacuccaucccccucaccuucggccccggcaccaaagucgacaucaaacgcacc

SEQ ID NO: 58381 - RNA, 348 nt, Artificial Sequence
  derived and/or modified sequence opt11 from anti-influenza_Chain
gacaucguccucacccaauccccccucucccuccccgucacccccggcgaacccgccuccaucuccugccgcuccucccaaucccuccucgacuccaacggcuacaacuaccucgacugguaccuccaaaaacccggccaauccccccaacuccucaucuaccucgccuccuaccgcgcccccggcguccccgaccgcuucuccggcuccggcuccggcaccgacuucacccucaaaaucucccgcgucgaagccgaagacgucggccucuacuacugcaugcaagcccuccaaaccccccccauguacaccuucggccaaggcaccaaacucgaaaucaaacgcaca

SEQ ID NO: 58382 - RNA, 351 nt, Artificial Sequence
  derived and/or modified sequence opt11 from anti-influenza_Chain
cucgagagcgggggcgggcucgugcaaccgggcgggagcuugcgcuugagcugugccgcgagcgggaucacauucucgagcuaugccaugagcugggucaggcaagcgcccgggaaagggcucgagugggugagcacggucaauagcgggggcgggagcacguacuauggcgauagcgugcgcgggcgcuuuaccauaagcagggacaauagcaagagcacgcucuaucuccagcucaauagcuugcgcgcggaagauaccgcgaucuauuacugugccaaggacaagggcaggcccauauucgggcucgugaccccgagcuauuacauggacgugugggggaacgggacc

SEQ ID NO: 58383 - RNA, 351 nt, Artificial Sequence
  derived and/or modified sequence opt11 from anti-influenza_Chain
caagagcaauugguacagagcggggccgaggucaagaaaccgggcgcgagcgugaaagugagcuguaaagcgagcaggaaaucguucauaggcuauuacgugcacugggucagacaagcgcccgggcaagggcucgaguggaugggcuggaucucgcccgauagcgaugccacgaaauaugcccagaaauuucaagggagcgugaucaugaccagggacacgagcgugagcacggucuauauggagcucucgcgcuugaccucggacgauaccgcgcucuauuacugucucuuguucaggggcgggaacucgcucucgugggggcaagggaccuuggucacggucucgagc

SEQ ID NO: 58384 - RNA, 351 nt, Artificial Sequence
  derived and/or modified sequence opt11 from anti-influenza_Chain
caagugcaauugcaagagagcgggcccgggcucgugaaaccaagcgagacccugagcuugaccuguaccgugagcgggagcucgaucucgaacuauuacuggagcuggaucaggcaaucgcccgggaaagggcucgaguggauaggcuuuaucuauuacgggggcaauaccaaguacaaucccucgcucaagagcagggucacgaucucgcaagauaccucgaaaucgcaagugagcuugaccaugagcucggucacggccgcggaaucggccguguacuuuugcgcgcgagcgagcuguagcgggggcuauugcauacucgauuacuggggccagggcacgcucgugacc

SEQ ID NO: 58385 - RNA, 351 nt, Artificial Sequence
  derived and/or modified sequence opt11 from anti-influenza_Chain
gagguccagcucguggaaucgggcgggggccugguccagcccgggggcucgcucaggcuaucgugcgcggccucgggcuuuaccuuuagcauauacgcgaugucgugggugcgccaggccccgggcaagggcuuggaaugggucucagccauaagcucgagcggggacucgaccuauuacgcggacucggucaagggcagguucacgaucucgcgcgauaacgcgcgcaauaccuuguacuugcaaaugaacucgcucagggccgaggacacggccguguacuauugcgcgcgcgcguacggguacacguucgaucccuggggccagggcacgcucgugaccguaagcucg

SEQ ID NO: 58386 - RNA, 354 nt, Artificial Sequence
  derived and/or modified sequence opt11 from anti-influenza_Chain
caaguccaacuccaagaauccggccccggccucgucaaacccuccgaaacccucucccuaaccugcaccgucuccggcuacuccuucgacuccggcuacuacuggggcuggcuccgccaacccccaggcaaaggccucgaauggaucggcuccaucuaccacucacgcaacaccuacuacaaccccucccucaaaucccgcgucaccaucuccgucgacaccuccaaaaaccaauucucccuccaacucuccuccgucaccgccgccgacaccgcagucuacuacugcgcccgcggcaccugguacuccucaaaccuccgcuacugguucgaccccuggggcaaaggcacccuc

SEQ ID NO: 58387 - RNA, 354 nt, Artificial Sequence
  derived and/or modified sequence opt11 from anti-influenza_Chain
caacccguccucacccaaccccccuccgccucagccucccucggcgccuccgucacccucaccugcacccucuccuccgccuacuccaacuacaaagucgacugguaccaacaacgccccggcaaaggcccccgauucgucaugcgcgucggcacaggcggcaucgucggcuccaaaggcgacggcauccccgaccgcuucuccguccucggcuccggccucaaccgcuaccucaccaucaaaaacauccaagaagaagacgaaucagacuaccacugcggcgccgaccacggcuccggcuccaacuucgucucccccuacgucuucggcggcggcaccaaacucaccguccua

SEQ ID NO: 58388 - RNA, 354 nt, Artificial Sequence
  derived and/or modified sequence opt11 from anti-influenza_Chain
caaguccaacucguccaauccggcgccgacgucaaaaaacccggcuccuccgucaccgucuccugcaaagccuccggcggcuccuucuccaacuacggcaucaacuggguccgccaagcccccggccaaggccucgaauggaugggcggcaucaucccccucaucaacgcccccaacuacgcccccaaauuccaaggccgcgucaccaucaccgccgacauguucuccaacaucgucucccuccaacucaccucccuacgcaccgacgacaccgccgucuacuacugcgcccgccgcaaaaugaccaccgccauagacuacuggggccaaggcacccucgucaccgucuccucc

SEQ ID NO: 58389 - RNA, 354 nt, Artificial Sequence
  derived and/or modified sequence opt11 from anti-influenza_Chain
cagguccagcucgugcaaucgggcgcggaagugaaaaagcccgggagcucggucaaggucucaugcagggaaucgggcgggaccuuuaacggguacacgaucacgugggugcgccaggccccgggccagggccuggaauggaugggcgggauaaucccgaugaugggcacggucaauuacgcgcaaaagcuccagggcagggucacgaucacgaccgacuacuuuaccaagaccgcguacauggacuugaacaaucucaggagcgaggacacggccauguacuauugcgugaaaauacgcuauaccgggcaacagcuccugugggggcaagggacccuggucacggucucgagc

SEQ ID NO: 58390 - RNA, 354 nt, Artificial Sequence
  derived and/or modified sequence opt11 from anti-influenza_Chain
caagugcaauugguccagagcggggccgaggucaagaaaccgggcgcgagcgugaaagugagcuguaaagcgagcgggcacacguucacgggcuauuacauacacugggucagacaagcgcccgggcaagggcucgaguggaugggcuggaucaaucccgauagcggggccacgagcucggcccagaacuuucaagggcgcgugaccaugaccggggacacgagcucgagcacggccuauauggagcucucgcgcuugagcuuugacgauaccgcggucuauuacugugccaggguccuguucacgagcccguucgauuucuggggcgagggcacgcucgugaccgugagcucg

SEQ ID NO: 58391 - RNA, 354 nt, Artificial Sequence
  derived and/or modified sequence opt11 from anti-influenza_Chain
caacccguccucucccaacccccauccgccuccgccucccucggcgcauccgucacccuaaccugcacccucucauccggcuucgacaacuaccaagucgccugguaccaacaacgccccggcaaaggcccccgcuucgucaugcgcgucggcaacggcggcaacgucgccucaaaaggcgacggcauccccgaccgcuucuccgucuccggcuccggccucaaccgauaccuaaccaucaaaaacauccaagaagacgacgaauccgacuacuacugcggcgcagaccacggcuccggcaacaacuucgucucccccuacgucuucggcggcggcaccaaacucaccguccuc

SEQ ID NO: 58392 - RNA, 354 nt, Artificial Sequence
  derived and/or modified sequence opt11 from anti-influenza_Chain
gaagugcaauuggucgagagcggggccgaggucaagaaaccgggcgcgagcgugaaagugagcuguaaagcgagcggguacacguucucgcgcuauuacauacacugggucaggcaagcgcccgggcaagagcucgaguggaugggcuggaucaaucccgauagcggggacacgaacuaugcccagaaauuucgcgggcgcgugaccauggcaagagacacgagcauaagcacagucuauauggagcucaauagcuugcgcuaugacgauaccgcggucuauuucugugccaggaucauauggucgagcucgggcauggacgugugggggcaagggaccacggucacggucucg

SEQ ID NO: 58393 - RNA, 354 nt, Artificial Sequence
  derived and/or modified sequence opt11 from anti-influenza_Chain
gaagugcaauugcucgagagcgggggcggggucgugcaaccgggcaggagcuugcgcuugagcugugccgcgagcggguucacguucaggaccuauggcaugcacugggucaggcaagcgcccgggaaagggcucgaguggguggccgugaucucgcacgauggcaaucucaaguacuauggcgggagcgugaaagggcgcuuuaccauaagcagggacaauagcaagaacgcgcucuaucuccagaugaauagcuugcgaguggacgauaccgcgcucuauuacugugccaggggcauaggcauaaccgaugccuuugacauacgcgggcaagggaccauggucguggucucg

SEQ ID NO: 58394 - RNA, 354 nt, Artificial Sequence
  derived and/or modified sequence opt11 from anti-influenza_Chain
gaagugcaauuggucgagagcggaggcgggcucgugcaaccgggcgggagcuugcgauugagcuguaccgcgagcgggcuaucggucucgagcacguacaugaacugggucaggcaagcgcccgggaaagggcucgaguggguaagcguguucuauagcgagaccaggaccuauuacgcggacucggucaagggcagguucacggucucgcgccauaacucgaacaauacccuguaccugcaaaugaacucgcucaggguagaggacacggccguguacuauugcgcgcgcgugcaaaggcucucguacgggauggaugucuggggccagggcacgaccgugaccgugagcucg

SEQ ID NO: 58395 - RNA, 354 nt, Artificial Sequence
  derived and/or modified sequence opt11 from anti-influenza_Chain
gaagugcaauuggucgagagcgggggcgggcucgugcaaccgggagggagcuugcgcuugagcuguaccgcgagcgggcucucggucucgagcacguacaugaacugggucaggcaagcgcccgggaaagggcucgagugggugaguguguucuauagcgagaccaggaccuauuacgcggacucggucaagggcagguucacggucucacgccauaacucgaacaauaccuuguacuugcaaaugaacucgcucagggccgaggacacggccguguacuauugcgcgcgcgugcaaaggcucucguacgggauggaugucuggggccagggcacgaccgugaccgugagcucg

SEQ ID NO: 58396 - RNA, 354 nt, Artificial Sequence
  derived and/or modified sequence opt11 from anti-influenza_Chain
gacaugcaauuggucgagagcgggggcggacucgugcccccgggcgggagcuugcgcuugagcugugccgcgagcggguucucggucucggacaauuacauaaacugggucaggcaagcgcccgggaaaggacucgauugggugagcguguucuauagcgcggacaggaccucguacgcggacucggucaagggcagguucacggucucgagccaugacucgaaaaauacaguguacuugcaaaugaacucgcucagggccgaggacacggccguguacuauugcgcacgcgugcaaaagagcuauuacgggauggaugucuggggccagggcacgaccgugaccgugagcucg

SEQ ID NO: 58397 - RNA, 357 nt, Artificial Sequence
  derived and/or modified sequence opt11 from anti-influenza_Chain
gaaguccaacucgucgaauccggccccguccuagucaaacccaccgaaacacucaccgucaccugcaccgucuccggcuucuccgucgacaacgaccgcaugggcgucuccuggauacgccaaccccccggcaaagcccucgaauggcuagcccacaucuucuccaacgacgaaaaauccuacuccaccucccuccgcucccgccucaccaucuccaaagacaccuccaaacgccaagucguccucuccaugaccgacauggaccccgucgacaccgccaccuacuacugcgcccgcgcccccuccgaauacgccgccauggacgucuggggccaaggcaccauggucaccgucucc

SEQ ID NO: 58398 - RNA, 357 nt, Artificial Sequence
  derived and/or modified sequence opt11 from anti-influenza_Chain
caggugcagguggugcagagugggacggaggugaagaagccggggaguagugugaaggugaguugucagacgaguggggggagguuuaugaguuaugcgauaacgugggugaggcaggcgccgggacaggggcuggaguggaugggggggauagugccgguauuugggacggcgaauuacgcgcagaaguuucaggggagggugacgauaacgacggaugauaguacgaggacggcguauauggaguugaguagucugaggagugaggauacggcaguguauuauuguggguuuagguaugggagcggguauggguuugauagcugggggcaggggacguuggugacggugagcagu

SEQ ID NO: 58399 - RNA, 357 nt, Artificial Sequence
  derived and/or modified sequence opt11 from anti-influenza_Chain
gaaguccaacucgucgaaucaggcgccggcgucaaaaaacccggcuccuccgucaaagucuccugcaaagccuccggcaacaccuucuccuccaacgccaucuccuggguccgccaagcccccggccaaggccucgaauggaugggcggcauccucggcaugcuccgcaccaccaacuacgcccaaaaauuccaaggccgcgucaccaucaccgccgacgaauucaugaacaccgccuacauggaacucuccucccucaccuccgaagacaccgccgucuacuacugcgcccgcuccuccggcuacuaccccgacuacuuccaccucuggggccaaggcacccuagucaccgucucc

SEQ ID NO: 58400 - RNA, 357 nt, Artificial Sequence
  derived and/or modified sequence opt11 from anti-influenza_Chain
caagugcaauugcaagagagcgggcccgggcucgugaaaccgagcgagaccuugagcuugaccuguaccgugagcgggagcucgaucucaaacuauuacuggagcuggaucaggcaaucgcccgggaaagggcucgaguggauaggcuuuaucuauuacgggggcaacaccaaguacaaucccucgcucaagagcagggucacgaucucgcaagauaccucgaaaucgcaagugagccugaccaugagcucggucacggccgcggaaucggccguguacuuuugcgcgcgcgcgagcuguagcgggggcuauugcauacucgauuacuggggccagggcacgcucgugaccgugagc

SEQ ID NO: 58401 - RNA, 357 nt, Artificial Sequence
  derived and/or modified sequence opt11 from anti-influenza_Chain
gaagugcaauuggucgagagcgggggcgggcucgugcaaccgggcgggagcuugcgcauaagcugugccgcgagcggguucacggucucgagcaauuacaugagcugggucaggcaagcgcccgggaaagggcucgagugggugagcgugaucuauagcgggggcucgaccuauuacgcggacucagucaagggcagguucucguucucgcgcgauaacucgaaaaauaccguguucuugcaaaugaacucgcucagggccgaggacacggccguguacuauugcgcgcgcugucucucgcgcaugcgcggguacgggcucgaugucuggggccagggcacaaccgugaccgugagc

SEQ ID NO: 58402 - RNA, 357 nt, Artificial Sequence
  derived and/or modified sequence opt11 from anti-influenza_Chain
caaguccaacuccaagaauccggccccggccuagucaaacccuccgaaacccucucccucaccugcaccgucuccggcgccuccaucuccuccgacuacugguccuggauccgccucccccccggcaaaggccucgaauggaucggcuacaucuacaaccgcggcuccaccaaauacacccccucccucaaaucacgcgucaccaucucccucgacaccgccgaaaaccaauucucccuccgccuccgcuccgucaccgccgccgacaccgccaucuacuacugcgcccgccacgucggcggccacacauacggcaucgacuacuggggccaaggcacccucgucaccgucuccucc

SEQ ID NO: 58403 - RNA, 357 nt, Artificial Sequence
  derived and/or modified sequence opt11 from anti-influenza_Chain
caaguccaacuccaagaauccggccccggccuugucaaacccuccgaaacccucucccucaccugcaccgucuccggcgccuccaucuccuccgacuacugguccuggauccgccucccccccggcaaaggccucgaauggaucggcuacaucuacaaccgcggcuccaccaaauacacccccucacucaaaucccgagucaccaucucccucgacaccgccgaaaaccaauucucccuccgccuccgcuccgucaccgcagccgacaccgccgucuacuacugcgcccgccacgucggcggccacaccuacggcaucgacuacuggggccaaggcacccucgucaccgucuccucc

SEQ ID NO: 58404 - RNA, 357 nt, Artificial Sequence
  derived and/or modified sequence opt11 from anti-influenza_Chain
cagguccagcuccaggaaucgggcccgcgccuagucaagcccucagaaucgcucucacucacgugcacggucucgggcgggagcauaagcaauagcuuuuggggguggauacgccagcccccgggcgagggccuggaauggaucggguacguguacaacagcgggaacacaaaauacaacccgagccugaaaucgcgcgugaccauaagcagggacacaagcaagagccagcucuauaugaagcucaggagcgugaccgcggccgauaccgcagucuauuacugugccaggcacgaugacgcaagccauggcuacagcauaagcuggggccauggcacgcucgugaccgugagcucg

SEQ ID NO: 58405 - RNA, 357 nt, Artificial Sequence
  derived and/or modified sequence opt11 from anti-influenza_Chain
gagguccaucuccagcaaucgggcccggaauuggucaagcccggggccucggucaagaugucgugcgaggccucaggcuauaccuuuaccgauuacuaugucgcgugggugaaacagagcccgggcgagagcuuugaauggaucgggcgcgugaacccguacucgggcgggaccucguacaaucaaaaguucaagggcaaggccacgcucauagucgauaaaucgagcucgaccgcguacauggaauugagcucgcucacgagcgaggacucagccguguacuauugcgcacgcugggacuauggcguguacgagggcuauaucgauuacuggggccagggcucggccuugaccgug

SEQ ID NO: 58406 - RNA, 360 nt, Artificial Sequence
  derived and/or modified sequence opt11 from anti-influenza_Chain
caaguccaacucguccaacccggcgccgaagucaaaaaacccggcuccuccgucaaagucuccugcaaagccuccggcggcaucuucucccccuacgccaucuccuggguccgccaagcccccggccaaggccucgaauggaugggcggcaucaucgccaucuucggcaccaccaacuacgcccaaaaauuccaaggccgcgucaccaucaccgccgacaaauccaccaccaccgccuaccucgaacucaacucccuccgcuucgaagacaccgccgucuacuacugcgcccgcggcggccgcuacuacgucgacuacuucgacuacuggggccaaggcacccucgucuccgucuccucc

SEQ ID NO: 58407 - RNA, 360 nt, Artificial Sequence
  derived and/or modified sequence opt11 from anti-influenza_Chain
caagugcaauugcaagagagcgggcccgaucucgugaaaccgggcgcgagcgugaaaaugagcuguaaagcgagcggguacucguucacguacuaucacaugcacugggucaagcaaacgcacgggaaaucgcucgaguggauaggcaggaucccguacaauggcgggaccaauuacucgcaaagguucaagggcaaggccguguucacggucgauaugucgagcucgaccgcguacauggaauugcgcucgcucacgagcgaggacucggccguguacuauugcgcgcgcgaugccaauuacgagggcgauugguauuucgaugucuggggccagggcacgaccgugaccgugagcuca

SEQ ID NO: 58408 - RNA, 360 nt, Artificial Sequence
  derived and/or modified sequence opt11 from anti-influenza_Chain
caagugcaauugguccagagcggggccgaggucaaggaaccgggcucggccaugaaagugagcuguaaagcgagcgggggcacguucucgagcgaugccuuuugcugggucaggcaagcgcccgggcgcgggcucgaguggaugggcgggaucauacccguguuccagaccgcgaacuauggcccgaacuuucaagggcgcgugaccauaagcgcggacguauacacgaccacgcucuaucucgagcucucgggcuugaccucggaagauaccgcggucuauuucugugccaggagcggggacggguacaauuacuauuucccgcucuggggccagggcacgcucgugaccgugagcucg

SEQ ID NO: 58409 - RNA, 360 nt, Artificial Sequence
  derived and/or modified sequence opt11 from anti-influenza_Chain
caaaucacccuccgcgaauccggccccacccucgucaaacccacccaaacccucacccuaaccugcaccuucuccggcuucucccucuccaccaacggcgucaacgucggcuggauccgccaaccccccggcaaagcccucgaauggcucgcccucaucuacugggacgacgacaaacgcuacucccccucccucaaacgccgacucaccaucaccaaagacaccuccaaaaaccaagucguccucacccucaccaacauggaccccgucgacaccgccaccuacuacugcgcccaccgccccgacuucuacggcgacuucgaauacuggggccccggcacccucgucaccgucuccucc

SEQ ID NO: 58410 - RNA, 360 nt, Artificial Sequence
  derived and/or modified sequence opt11 from anti-influenza_Chain
caagugcaauugguccagagcgggagcgaggucaagaaaccgggcacgagcgugaaagugagcuguaccgcgagcgggagcguguucacgaacuauggcauaagcugggucagacaagcgcccgggcaagggcucgaguggaugggcgggaucauacccuuguucggggccgcgaaauaugcccagaaauuucaagggcgcgugaccauaaccgcggacgagagcacgaaaacggucuauauggagcucucgcgcuugaccucgaaagauaccgcgaucuauuucugugccaaggccccgcgaguguacgaguacuauuucgaucaauggggccagggcacgcccgugaccgugagcucg

SEQ ID NO: 58411 - RNA, 360 nt, Artificial Sequence
  derived and/or modified sequence opt11 from anti-influenza_Chain
caagugcaauugguccagagcggggccgaucucaagaaaccgggcgcgagcgugaaagugagcuguaaagcgagcggguacacguucacggacuauuacauacacugggucaggcaagcgcccgggcaagggcucgaguggaugggcuggaucaaucccgagagcggggacacgaaauaugcccagaaauuccaagggcgcgugaccaugaccagggacacgagcauaaccacggccuauauggagcucgggcgacugcgaucggacgauaccgcggucuauuacugugccagggacgugagcacgaccuggagcugguucgcgcccuggggccagggcacgcucgugaccgugagcucg

SEQ ID NO: 58412 - RNA, 360 nt, Artificial Sequence
  derived and/or modified sequence opt11 from anti-influenza_Chain
caaguccaacuccaagaauccggccccggccucgucaaacccuccgaaacccucucacuaaccugcuccgucuccggcggcuccaucaacuacuacuacugguccuggauccgccaaccccccggcaaaggccucgaaugcaucggcuacaucuccgacaccggccgcaccuacuacaaccccucccuccgcucccgcgucacaaucuccgucgacaccuccaaaaaccaauucucccucaaccucaccuccaugaccgccgccgacaccgccgucuacuacugcgcccgcgaccccaccggcucccgccaaaaaaacgccuucgacauguggggccaaggcaccauggucaccgucucc

SEQ ID NO: 58413 - RNA, 360 nt, Artificial Sequence
  derived and/or modified sequence opt11 from anti-influenza_Chain
caaguccaacuccaagaauccggcccccgagucguccgccccucagaaacccucucccucaccugcaccgucucaggcggcucaaucuccuccuacaacuggaucuggauccgccaaccccccggcaaaggccucgaauggaucggccacaucuacgacuacggccgcaccuucuacaacuccucccuccaaucccgccccaccaucuccgucgacgccuccaaaaaccaacuaucccuccgccucaccuccgucaccgccuccgacaccgccgucuacuacugcgcccgcccccucggcauccuccacuacuacgccauggaccucuggggccaaggcaccaccgucaccgucuccucc

SEQ ID NO: 58414 - RNA, 360 nt, Artificial Sequence
  derived and/or modified sequence opt11 from anti-influenza_Chain
caaguccaacuccaagaauccggccccggccucgucaaacccuccgaaacccucucccucaccugcuccgucuccggcggcucaaucuccuccgacuucugguccuggauccgacaaccccccggcaaaggccucgaauggaucggcuacgucuacaaccgcggcuccaccaaauacucccccucccucaaaucacgcgucaccaucuccgccgacauguccaaaaaccaauucucccucaacaugucauccgucacagccgccgacaccgccgucuacuacugcgccaaaaacggccgcucaucaaccuccuggggcaucgacgucuggggcaaaggcaccaccgucaccgucuccucc

SEQ ID NO: 58415 - RNA, 360 nt, Artificial Sequence
  derived and/or modified sequence opt11 from anti-influenza_Chain
caaguccaacuccaagaauccggccccggccucgucaaacccuccgaaacccucucccucaccugcaccgucuccggcggcuccaucuccgccuaccacugguccuggauccgccaaccccccggcaaaggccucgaauggaucggccacaucuucgacuccggcuccaccuacuacaaccccucccucaaaucccgcgucaccaucucccucgacgccuccaaaaaccaacucucccuccgacucaccuccgucaccgccuccgacaccgccaucuacuacugcgcccgcccccucggcucccgcuacuacuacggcauggacgucuggggccaaggcaccacagucaccgucuccucc

SEQ ID NO: 58416 - RNA, 360 nt, Artificial Sequence
  derived and/or modified sequence opt11 from anti-influenza_Chain
gaagugcaauuagucgagagcgggggcgggcucgugcaaccgggcgggagcuugcgcauaagcugugccgcgagcggguucacggucucgagcaauuacaugagcugggucaggcaagcgcccgggaaagggcucgagugggugagcgugaucuauagcgggggcucgaccuauuacgcggacucggucaagggcagguucucguucucgcgcgauaacucgaaaaauaccguguucuugcaaaugaacucgcucagagccgaggacacggccguguacuauugcgcgcgcugucucucgcgcaugcgcggguacgggcucgaugucuggggccagggcacgaccgugaccgugagcucg

SEQ ID NO: 58417 - RNA, 360 nt, Artificial Sequence
  derived and/or modified sequence opt11 from anti-influenza_Chain
caagugcaauugcaagagagcgggcccgggcucgugaaaccgagcgagacccugagcuugaccuguaccgugagcgggagcucaaucucgaacuauuacuggagcuggaucaggcaaucacccgggaaagggcucgaguggauaggcuuuaucuauuacgggggcaauaccaaguacaaucccucgcucaagagcagggucacgaucucacaagauaccucaaaaucgcaagugagcuugaccaugagcucggucacggccgcggaaucggccguguacuuuugcgcgcgcgcgagcuguagcgggggcuauugcauacucgauuacuggggccagggcacgcucgugaccgugagcucg

SEQ ID NO: 58418 - RNA, 360 nt, Artificial Sequence
  derived and/or modified sequence opt11 from anti-influenza_Chain
cagguccagcuccagcaaucgggcgcggaagugaaaaagcccgggagcucggucaaggucucgugcaaggucucgggcgugaucuuuagcgggagcgcgaucucgugggugcgccaggccccgggccagggcuuggaauggaugggcgggauaagcccgcucuuuggcacgaccaauuacgcgcaaaaguuccagggcagggucacgaucacggccgaucaaucgaccaauacaacguacauggaagugaacucgcucagguacgaggacacggccguguacuuuugcgcgcgcgggcccaaguacuauagcgaguacauggacgugugggggaaagggaccacggucacggucucgagc

SEQ ID NO: 58419 - RNA, 360 nt, Artificial Sequence
  derived and/or modified sequence opt11 from anti-influenza_Chain
caagugcaauugguccagagcggggccgaggucaagaaaccgggcucgagcgugaaagugagcuguaaagcgagcgggggcacguucucgagcuaugccauaagcugggucaggcaagcgcccgggcaagggcucgaguggaugggcgggaucaugggcauguucgggaccacgaacuaugcccagaaauuucaagggcgcgugaccauaaccgcggacgaguucacgagcgcggccuauauggagcucaggagcuugcgcucggaagauaccgcggucuauuacugugccaggagcucgggcuauuacccggaauauuuccaggacuggggccagggcacgcucgugaccgugagcucg

SEQ ID NO: 58420 - RNA, 360 nt, Artificial Sequence
  derived and/or modified sequence opt11 from anti-influenza_Chain
caaaugcaauugguccagagcggggccgaggucaagaaaccgggcucgagcgugaaagugagcuguaaagcgagcgggggcacguucucgagcuaugccauaaccugggucaggcaagcgcccgggcaagggcucgaguggaugggcgggaucauaggaauguucgggagcacgaacuaugcccagaacuuucaagggcgcgugaccauaaccgcggacgagagcacgagcacggccuauauggagcucucgagcuugcgcucggaagauaccgcggucuauuacugugccaggagcacgggcuauuacccggccuaucuccaucacuggggccagggcacgcucgugaccgugagcucg

SEQ ID NO: 58421 - RNA, 360 nt, Artificial Sequence
  derived and/or modified sequence opt11 from anti-influenza_Chain
gaagugcaauuggucgagagcggggccgaggucaagaaaccgggcucgagcgugaaagugagcuguaaagcgagcgggggcacguucucgagcuauggcauaagcugggucaggcaagcgcccgggcaagggcucgaguggaugggcgauaucauaggcauguucgggagcacgaacuaugcccagaacuuucaagggcgcuugaccauaaccgcggacgagagcacgagcacggccuauauggagcucagcucauugcgcucggaagauaccgcggucuauuacugugccaggagcucgggcuauuacccggccuaucucccgcacuggggccagggcacgcucgugaccgugagcucg

SEQ ID NO: 58422 - RNA, 360 nt, Artificial Sequence
  derived and/or modified sequence opt11 from anti-influenza_Chain
gaagugcaauuggucgagagcggggccgaggucaagaaaccgggcucgagcgugaaagugagcuguaaagcgagcgggggcacguucucgagcuaugccauaagcugggucaggcaagcgcccgggcaagggcucgaguggaugggcgggaucauaggcauguucgggaccgcgaacuaugcccagaaauuucaagggcgcgugaccauaaccgcggacgaguucacgagcacggccuauauggagcucucgagcuugcgcucggaagauaccgcggucuauuacugugccaggggcaauuacuauuacgagagcucacucgauuacuggggccagggcacgcucgugaccgugagcucg

SEQ ID NO: 58423 - RNA, 360 nt, Artificial Sequence
  derived and/or modified sequence opt11 from anti-influenza_Chain
caaguccaacuaguccaaagcggagccgaagucaaaaaaccaggcuccagcgucaaagucagcugcaaagccagcggcggcccauucagaaacuucgccauaaacugggucagacaagcacccggacaaggacucgaauggaugggcggcaucaucgccgucuucggcaccacaaaauacgcccacaaauuccaaggccgcguaaccauaaccgcagacgacagcacaaacacagccuacauggaacucggcagccuaaaaucagaagacacagccgucuacuacugcgccagaggcccacacuacuacucaagcuacauggacgucuggggcgaaggcacaaccguaaccgucagcagc

SEQ ID NO: 58424 - RNA, 360 nt, Artificial Sequence
  derived and/or modified sequence opt11 from anti-influenza_Chain
gagguggcguugguggagacgggggcggaggugaagaagccggggaguagugugaaggugccguguaagaguagugggagcccguuuaggaguaaugcggugagcugggugaggcaggcgccggggcagggguuggagugggugggggggauauuggggguguuugggaguccgaguuaugcgcagaaguuucaggggagggugacgauaacggcggaugagagcacgaauacggugcauauggaguugagaggguugaggagugaggauacggcgguguauuauugugcgagggggccgacguauuauuauagcuauauggauguaugggggaaggggacgacggugacggugaguagu

SEQ ID NO: 58425 - RNA, 360 nt, Artificial Sequence
  derived and/or modified sequence opt11 from anti-influenza_Chain
caaaugcaauugguccagagcggggccgaggucaagaaaccgggcucgagcgugaaagugagcuguaaagcgagcgggggcacguucucgagcuaugccauaagcugggucaggcaagcgcccgggcaagggcucgaguggaugggcgggaucuuuggcauguucgggaccgcgaacuaugcccagaaauuucaagggcgcgugacaauaaccgcggacgaguucacgagcgcggccuauauggagcucucgagccugggcucggaagauaccgcgauguauuacugugccaggagcucgggcuauuacccgcaauauuuccaggacuggggccagggcacgcucgugaccgugagcucg

SEQ ID NO: 58426 - RNA, 360 nt, Artificial Sequence
  derived and/or modified sequence opt11 from anti-influenza_Chain
cagguccagcucgugcaaucgggcgcggaagugaaaaagcccgggagcucggucaaggucucgugcaaggccucgggcgugaccuuuagcuauuacgcgaugucgugggugcgacaggccccgggccagggcuuggaauggaugggcgggauaagcccgauguuuggcacgaccacguacgcgcaaaaguuccagggcagggucacgaucacggccgaugacucgaccucgaccgcguacauggaagugcgcucgcucaggagcgaggacacggccguauacuauugcgcgcgcucgagcaacuacuaugacucggucuaugacuauugggggcaagggaccuuggucacggucucgagc

SEQ ID NO: 58427 - RNA, 360 nt, Artificial Sequence
  derived and/or modified sequence opt11 from anti-influenza_Chain
gagguccagcucguggaaacgggcgcggaagugaaaaagcccgggagcucggucaaggucccgugcaagagcucgggcucgcccuuucgcucgaacgcggucucgugggugcgacaggccccgggccagggcuuggaaugggucgggggcauacucggggucuuuggcucgcccucguacgcgcaaaaguuccagggcagggucacgaucacggcagaugaaucgaccaauaccgugcacauggaauugcgcgggcuaaggagcgaggacacggccguguacuauugcgcgcgcgggcccacguacuauuacucguacauggacgugugggggaaagggaccacggucacggucucgagc

SEQ ID NO: 58428 - RNA, 360 nt, Artificial Sequence
  derived and/or modified sequence opt11 from anti-influenza_Chain
caagugcacuugguccagagcggggccgaggucaggaaaccgggcgcgagcgugaaagugagcuguaaagugagcggguacacgcucaaugaauugagcauacacuggcucaggcaagcgcccgggcgcgggcuagaguggaugggaucguucgaucccgaggacggggaaacgaucuaugcccagaaauuucaagggcgcgugaccaugaccggggacacgagcacggacacagccuaucuagagcucacgagcuugcgcucggaagauaccgcgcucuauuacugugccaggggcuggggcgcggucacgagcccguucgauuucuggggccagggcacgcucgugaccgugagcucg

SEQ ID NO: 58429 - RNA, 360 nt, Artificial Sequence
  derived and/or modified sequence opt11 from anti-influenza_Chain
gaagugcaauugguccagagcggggccgaggucaagaaaccgggcucgagcaugaaagugagcuguaaagcgagcgggagcauauucucgaacuauggcauaagcugggucaggcaagcgcccgggcaagggcucgaguggaugggcgggaucauacccauauucggggccgcgaacuaugcccagaaauuucaagggcgcgugaccauaaccgcggacgagagcacgagcacggucuauauggaggucaggagcuugcgcucggaagauaccgcggucuauuacugugccaggcgccagcaauuguacaagggcuauuaccaucacuggggccagggcacgcucgugaccgugagcucg

SEQ ID NO: 58430 - RNA, 360 nt, Artificial Sequence
  derived and/or modified sequence opt11 from anti-influenza_Chain
caagugcaauugguccagagcggggccggggucaagaaaccgggcucgagcaugaaagugagcuguaaagcgagcgggagcauauucucgaacuauggcauaagcugggucaggcaagcgcccgggcaagggcucgaguggaugggcgggaucauacccauauucggggccgcgaacuaugcccagaaauuucaagggcgcgugaccauaaccgcggacgagagcacgagcacggucuauauggaggucaggagcuugcgcucggaagauaccgcggucuauuacugugccaggcgccagcaauuguacaagggcuauuaccaucacuggggccagggcacgcucgugaccgugagcucg

SEQ ID NO: 58431 - RNA, 360 nt, Artificial Sequence
  derived and/or modified sequence opt11 from anti-influenza_Chain
caaguccaacuccaagaauccggccccggccucgucaaacccuccgaaacccucucccucaccugcaccgucuccggcggccucaucggcaccggcuccuacuacuggggcuggauccgccaaacccccggcaaaggcauggaauggaucggcuccaucuccuacuccggcuccaccuacuaccaccccucccucaaaucccgcgucaccaucuccgacgacaccuccaaaaaccaacucuuccucaaacuccgcuccgucaccgccgccgacaccgcccaauacuacugcgcccgcuacaacuggggcauccgcuacuucgacuucuggggccgcggcacccucgucaccgucuccucc

SEQ ID NO: 58432 - RNA, 360 nt, Artificial Sequence
  derived and/or modified sequence opt11 from anti-influenza_Chain
cagguccagcuagugcaaucgggcgcggaagugcgcaagcccgggagcucgguaaaggucucgugcaaggucucgggcgggaucauacgcaaguacgcgaucaauugggugcgccaggccccgggccagggcuuggaauggaugggcgggauaaucgcgaucuuuaacacggccaauuacgcgcaaaaguuccagggcagggucacgaucacggccgaugaaucgaccucgaccguguacauggaauugagcucgcucaggagcgaggacacggccuuguacuauugcgcgcgcgggaugaauuacuauagcgauuacuuugacuauugggggcaagggagcuuggucacggucucgccc

SEQ ID NO: 58433 - RNA, 360 nt, Artificial Sequence
  derived and/or modified sequence opt11 from anti-influenza_Chain
caaguccaacucguccaauccggcggcggcgucguccaacccggccgcucccuccgccucuccugcgccgccuccggcuucaccuuccgcucccacgccaugcacuggguccgccaagcccccggcaaaggccccgaaugggucgcccucaucuccuacgacgaagucaacaaauucuacgccgacuccgucaaaggccgcuucaccaucucccgcgacgucuccaaaaacaccgucuuccuccaaaugaacucccucuccgccgacgacaccgccgucuacuacugcgcccgcggccacuccggcuccuaccgacucuucgacuucuggggccaaggaacccucgucaccgucuccucc

SEQ ID NO: 58434 - RNA, 360 nt, Artificial Sequence
  derived and/or modified sequence opt11 from anti-influenza_Chain
caagugcaauuggucgagagcgggggagggcucgugcaaccgggcgggagcuugcgccugagcugugcagcgagcggguucauauucggggacuuugccauacacugggucaggcaagcgagcgggaaagggcucgaguggguggccaggaucaggagcgggcucaaccgcuuugaaacggccuaugccgcgagcguggaagggcgcuugaccauaagcagggacgauagcaagagcauggccuaucuccagaugaauaacgugaaagcggaagauaccgcggucuaucucuguaccuaucucgugggcgcggucggguuccagcacuggggccagggcacgcucgugaccgugagcucg

SEQ ID NO: 58435 - RNA, 360 nt, Artificial Sequence
  derived and/or modified sequence opt11 from anti-influenza_Chain
caagugcaauuggucgagagcgggggcggggucgugcaaccgggcaggagcuugcgcuugagcugugccgcgagcggguucacguucucgagcuauggcauauacugggucaggcaagcgcccggaaaagggcucgaguggguggccuuuaucucguacgaugaaauaaacaaguucuaugccgauagcgugaaagggcgcuuuaccauaagcagggacaauagcaagaacacggucuuucuccagaugaauagcuugcgcgaugaagauaccgcggucuauuacugugccaagcccuugcgcgggagcuaucgcuauuucgaucucuggggcaggggcacggucgugaccgugagcucg

SEQ ID NO: 58436 - RNA, 363 nt, Artificial Sequence
  derived and/or modified sequence opt11 from anti-influenza_Chain
caagugcaauugcaagagagcgggccagaucucgugaaaccgggcgcgagcgugaugauaagcuguaaagcgagcggguacucguucacguacuauuacaugcacugggucaagcaaucgcacgggaaaacgcucgaguggauaggcaggaucuaucccuauaacggggacacgaacuauaacaggcgcuuuaaagauaaagcgaucuugaccguggacgagagcucgagcacggccuauauggagcucaggagcuugaccucggaagauagcgcggucuauuucugugccagggacgcgaacuaugaaggggacugguacuuugacgugugggggcaagggaccacggucacggucucgagc

SEQ ID NO: 58437 - RNA, 363 nt, Artificial Sequence
  derived and/or modified sequence opt11 from anti-influenza_Chain
caaguccaacucguccaauccggcggcggcgucguccaacccggccgcucacuccgccuaucaugcgccgccuccggcuucaccuucuccuccuacgccaugcacuggguccgccaagcccccggcaaaggccucgaaugggucgccaucaucuccuacgacggcaacgaccaauacuacaccgacuccgucaaaggccgauucaccaucucccgcgacuccuccaaagucuaccuacaaaugcaccgacuccgccccgaagacaccgccgucuacuacugcgccaaagaauucgaaaccuccggcuacuuccacggcuccuucgacuacuggggccaaggcauccucgucaccgucuccucc

SEQ ID NO: 58438 - RNA, 363 nt, Artificial Sequence
  derived and/or modified sequence opt11 from anti-influenza_Chain
caaguccaagucguccaauccggcgccgaagucaaaaaacccggcuccuccguccgcgucuccugccaagccuccggcggcaccuucaugaacuacgccaucaucuggguccgccgcgcccccggccaaggccucgaauggaugggcggcaucauccccgucuuccccaccccaaacuacgcccaaauguuccaaggccgcgucaccaucuccaccgacgaaucccgcuccaccuccuuccucgaacucacaaaccuccgauacgaagacaccgccgucuacuacugcgcccgccgcaucuaccacggcggcaacuccggcuucgacuucuggggccaaggcacccucguaaccgucuccucc

SEQ ID NO: 58439 - RNA, 363 nt, Artificial Sequence
  derived and/or modified sequence opt11 from anti-influenza_Chain
caaguccaacuccaagaauccggccccggccuccucaaacccuccgacacccucgcccucaccugcaccgucuccggcggcuccaucaccuccgacuacugguccuggauccgccaaccccccggccgcggccucgacuggaucggcuucuucuacaacggcggcuccaccaaauacaaccccucacucaaaucccgcgucaccaucuccgccgacaccuccaaaaaccaacucucccucaaacucaccuccguaaccgccgccgacaccggcgucuacuacugcgcccgccacgacgccaaauucuccggcuccuacuacgucgccuccuggggccaaggcacccgcgucaccgucuccucc

SEQ ID NO: 58440 - RNA, 363 nt, Artificial Sequence
  derived and/or modified sequence opt11 from anti-influenza_Chain
caaguccaacuccaagaauccggccccggccuccucaaacccuccgacacccucgcccucaccugcaccgucuccggcggcuccaucaccuccgacuacuggucauggauccgccaaccccccggccgcggccucgacuggaucggcuucuucuacaacggcggcuccaccaaauacaaccccucccucaaaucccgcgucaccaucuccgccgacaccuccaaaaaccaacucucacuaaaacucaccuccgucaccgccgccgacacaggcgucuacuacugcgcccgccacgacgucaaauucuccggcuccuacuacgucgccuccuggggccaaggcacccgcgucaccgucuccucc

SEQ ID NO: 58441 - RNA, 363 nt, Artificial Sequence
  derived and/or modified sequence opt11 from anti-influenza_Chain
caaguccaacuccaagaauccggccccggccucgucaaacccuccgaaacccucuccgucaccugcaaagucuccggcgacuccaucuccuccuacuccugguccuggauccgccaaccccccggcaaaggccucgaaugggucggcuaccucuacuacuccggcuccaccaaauacaaccccucccucaaaucccgcaccaccaucuccgucgacaccucaaccaaccaacucucccucaaacucuccuucgucaccgccgccgacaccgccgucuacuucugcgcccgcaccggcuccgaauccaccaccggcuacggcauggacgucuggggccaaggcaccaccgucaccgucucaucc

SEQ ID NO: 58442 - RNA, 363 nt, Artificial Sequence
  derived and/or modified sequence opt11 from anti-influenza_Chain
gaagugcaauuggucgagagcggggccgaggucaagaaaccgggcucgagcgugaaagugagcuguaaagcgagcgggggcccguucaggagcuaugccauaagcuggguaaggcaagcgcccgggcaagggcccgaguggaugggcgggaucauacccauauucgggaccacgaaauaugccccgaaauuucaagggcgcgugaccauaaccgcggacgauuucgcgggcacggucuauauggagcucucgagcuugcgaucggaagauaccgcgauguauuacugugcaaagcacaugggcuaucaagugcgcgagaccauggacgugugggggaaagggaccacggucacggucucgagc

SEQ ID NO: 58443 - RNA, 363 nt, Artificial Sequence
  derived and/or modified sequence opt11 from anti-influenza_Chain
caagugcaacugguccagagcggggcagaggucaagaaaccgggcucgagcgugaaagugagcuguaaagcgagcgggggcccguucaggagcuaugccauaagcugggucaggcaagcgcccgggcaagggcccgaguggaugggcgggaucauacccauauucgggaccacgaaauaugccccgaaauuucaagggcgcgugaccauaaccgcggacgauuucgcgggcacggucuauauggagcucucgagcuugcgcucagaagauaccgcgauguauuacugugccaagcacaugggcuaucaagugcgcgagaccauggacgugugggggaaagggaccacggucacggucucgagc

SEQ ID NO: 58444 - RNA, 363 nt, Artificial Sequence
  derived and/or modified sequence opt11 from anti-influenza_Chain
gaagugcaauuggucgagaccggggccgaggucaagaaaccgggcgcgagcgugaaagugagcuguaaagcgagcggguacacguucacgagcuauuacaugcacugggucaggcaagcgcccgggcaagggcucgaguggaugggcuggauaaaucccaauagcgggggcacgaacuaugcacagaaauuucaagggcgcgugaccaugaccagggacacgagcauaagcacggccuauauggagcucucgagauugcgcucggacgauaccgcggucuauuacugugccagggaagggaaauggggaccgcaagcggccuuugacauaugggggcaagggaccauggucacggucucgagc

SEQ ID NO: 58445 - RNA, 363 nt, Artificial Sequence
  derived and/or modified sequence opt11 from anti-influenza_Chain
gaggugcaguugguggagaguggggcggaggugaagaagccggggaguagugugaaggugaguuguaaggcgaguggggggacguuuaguuuuuauaguaugaguugggugaggcaggcgccggggcagggguuggaguggaugggggggauaauaccgauguuugggacgacgaauuaugcgcagaaguuucaggggagggugacgauaacggcgguggagagcacgaguacggcguauauggaggugaguagucugaggagugaggauacggcgguguauuauugugcgaggggggauaaggggauauauuauuauuauauggaugugugggggaaggggacgacggugacggugaguagu

SEQ ID NO: 58446 - RNA, 363 nt, Artificial Sequence
  derived and/or modified sequence opt11 from anti-influenza_Chain
gagguccagcucguggaaacgggcgcggaagugaaaaagcccgggagcucggucaaggucucgugcaaggccucgggcgggaccuuucgcacgcacgcgauaucgugggugcgccaggccccgggccagggcuuggaauggaugggcgggauaaucgcgaucuuuggcacggccaauuacgcgcaaaaguuccagggcaggaucacgaucacggccgaugaaucgaccucgaccgcguacauggaauugagcucgcucaggagcgaggacacggccguguacuuuugcgcgcgcgggagcggguaccauaucucgaccccguucgauaacuggggccagggcacgcucgugaccguaagcucg

SEQ ID NO: 58447 - RNA, 363 nt, Artificial Sequence
  derived and/or modified sequence opt11 from anti-influenza_Chain
gagguccagcucgugcaaucgggcgcggaagugaaaaagcccgggagcucggucaaggucucgugcaaggccucgggcgggaucuuucgcucgaacucgaucucgugggugcgccaggccccgggccagggcuuggaauggaugggcgggauauucgcgcucuuuggaacgaccgauuacgcgcaaaaguuccagggcagggucacgaucacggccgaugaaucgagcacgaccguguacuuggaauugagcucgcucacgagcgaggacacggccguguacuauugcgcgcgcgggagcggguacacgaccaggaacuauuucgauuacuggggccagggcacgcucgugaccgugagcucg

SEQ ID NO: 58448 - RNA, 363 nt, Artificial Sequence
  derived and/or modified sequence opt11 from anti-influenza_Chain
gagguccagcucguggaaucgggcgcggaagugaaaaagcccgggagcucggucaaggucucgugcaaggccucgggcgggaucuuuaacucguacgcgaucucgugggugcgccaggccccgggccagggcuuggaauggaugggcgggauaaucgcgaucuuucacacgcccaaguacgcgcaaaaguuccagggcagggucacgaucacggccgaugaaucgaccaauaccgcguacauggaauugcgcucgcucaagagcgaggacacggccuuguacuauugcgcgcgcgggagcacguacgauuucucgagcgggcucgauuacuggggccagggcacgcucgugaccgugagcuca

SEQ ID NO: 58449 - RNA, 363 nt, Artificial Sequence
  derived and/or modified sequence opt11 from anti-influenza_Chain
cagguccagcuagugcaaucgggcgcggaagugaaaaagcccgggagcucggucaaggucucgugcaagagcucgggcgggaacuuuaacaauuacgcggucucgugggugcgccaggccccgggacagggauuggaauggaugggcgggauaagcccgaucuuuggcucgaccaaucacgcgcaaaaguuccagggcagggucacgaucucggccgauaucuuuaccaauaccgcguacauggaauugagcucgcucaggagcgaugacacggccauauacuauugcgcgcgcgggcgaggguacuauuucuaucacgcgauggaugucuggggccagggcucgaccgugaccgugagcucg

SEQ ID NO: 58450 - RNA, 363 nt, Artificial Sequence
  derived and/or modified sequence opt11 from anti-influenza_Chain
cagguccagcuaguacaaucgggcgcggaagucaaaaagcccgggagcucaguaaaggucucgugcaaggccucgggcgggaccuuuaacaauuacgcgaucaauugggugcgccaggccccgggccagggcuuggaauggaugggcgggauaagcccgaucuuuggcucggucaauuacgcgcaaaagcuccagggcagggucacgaucacggccgaugucuuuaccucgaccgcguacauggaauugagcucacucagaagcgaggacacggccguguacuauugcgcgaaagggagcggguacuacuacuauuacgggcucgaugucuggggccugggcacgaccgugaccgugagcucg

SEQ ID NO: 58451 - RNA, 363 nt, Artificial Sequence
  derived and/or modified sequence opt11 from anti-influenza_Chain
cagguccagcucguggaaucgggcggaggcgugguccagcccgggcgcucgcucaggcucucgugcgcggccucgggcuuuaccuuuaccaauuacgcgaugcauugggugcgccaggccccgggcaagggcuuggaaugggucgcggucaucagcuuugacgaggacaauaaaucguacgcggacuaugucaagggcagguucacgauaucgcgagauaacucgaacaaucgcuuguacuugcaaaugaacucgcuaagggccgaggacacggccguguacuauugcgcgcgcgggcccgagggcgugugggggcgcucgaucgauagcuggggccagggcacgcucgugaccgugagcucg

SEQ ID NO: 58452 - RNA, 363 nt, Artificial Sequence
  derived and/or modified sequence opt11 from anti-influenza_Chain
cagguccagcucgugcaaucgggcggggacuugguccagcccgggggcucgcucaggcucucgugcgcggccucgggcuuuaccuuuagcagguacucgaugaauugggugcgccaggccccgggcaugggcuuggaauggguagcguacauaagcgauaccucgcgcacgaucuauuacgcggacucggucaagggcagguucacgaucucgcgcgauaacgcgaaaaauagcuuguacuugcaaaugaaaucgcucagagacgaggacacggccguguacuauugcgcgcgcgaucccgacaccccguucgugcgcgcguucgauagcuggggccagggcacgcucgugaccgugagcucg

SEQ ID NO: 58453 - RNA, 363 nt, Artificial Sequence
  derived and/or modified sequence opt11 from anti-influenza_Chain
caagugcaacuggucgagagcgggggcgggcucgugcaaccgggcgggagcuugcgcuugagcugugucgcgagcggguucacguucucgcgcuuuagcaugaacugggucaggcaagcgcccgggauggggcucgagugggugagcuauaucucggacacgggcaggaccauauacuaugccgauagcgugaaagggcgcuuuaccauaagcagggacaaugacaagaacacgcucuaucuccagaugaagucguugcgcgaugaagauagcgcguucuauuacugugccagggacccggacacgcccuuugucagggcauuugacagcugggggcaaggggucuuggucacggucucgagc

SEQ ID NO: 58454 - RNA, 363 nt, Artificial Sequence
  derived and/or modified sequence opt11 from anti-influenza_Chain
caagugcaacugcaagagagcgggcccgaucucgugaaaccgggcgcgagcgugaaaaugagcuguaaagcgagcggguacucguucacguacuaucacaugcacugggucaagcaaacgcacgggaaaucgcucgaguggauaggcaggaucuaucccuauaacgggggcacgaacuauagccagcgcuuuaaagggaaagcggucuuuacaguggacaugagcucgagcacggccuauauggagcucaggagcuugaccucggaagauagcgcggucuauuacugugccagggacgcgaacuaugaaggggacugguacuuugacgugugggggcaagggaccacggucacggucucgagc

SEQ ID NO: 58455 - RNA, 366 nt, Artificial Sequence
  derived and/or modified sequence opt11 from anti-influenza_Chain
cagggccagcucgugcaaucgggcgcggaagugaaaaagagcgggagcucggucaaggucucgugcaagaccucaggcgggaccuuuaacucgcacgcgaucucaugggugcgccaggccccgggccagggcuuggaauggaucgggggcauaaucccgauguuuggcacgaccaauuacgcgcaaaagcucaagggcaggaucgcgaucacggccgaucaauugcccacgaccgcguaccuggaauugagcucgcuaaggagcgaggacacggccguguacuauugcgcgcgcgggcaaagauacuauuacgaucgcgauggcauggacgugugggggcaagggaccauggucacggucucgagc

SEQ ID NO: 58456 - RNA, 366 nt, Artificial Sequence
  derived and/or modified sequence opt11 from anti-influenza_Chain
caaguccaccuaguccaauccggcgccgaagucaaaaaacccggcucauccguccgccucuccugcuccgccuccggcggccccuucuccggcuucgccaucuccuggcuccgacaagcccccggccaaggccucgaauggcucggcggcaucuccgccgucuucggcaccgccaccuacgcccaaaaauuccaaggccgcgucacaaucaccgccgaccaauucaccucaaccucccacauggaccucucccgccucaccuacgacgacaccgcagucuacuacugcgcccgcuccggcggcuaccucccccaaaacaacuggaucgaccccuggggccaaggcacccucgucaucgucuccucc

SEQ ID NO: 58457 - RNA, 366 nt, Artificial Sequence
  derived and/or modified sequence opt11 from anti-influenza_Chain
cagguccagcucgugcaaucgggagcggaagugaaaaaggccgggagcucgguaaaggucucgugccagagcucgggcgugaccuuuagcauguacgcggucucgugggugcgccaggccccgggccagggcuuggaauggaugggagggauaaucccgcucuuuggcacgacaacguacgcgcaaaaguucgagggcaggcucacgaucacggcagauaccucgaccaauauggcguacuuggaauugcgcucgcucaggagcgaggacacggccguguacuuuugcgcgcgcgcgggcacgaccgugaccagguucaauugguuugacccgugggggcaagggaccuuggucacggucucgagc

SEQ ID NO: 58458 - RNA, 366 nt, Artificial Sequence
  derived and/or modified sequence opt11 from anti-influenza_Chain
cagguccagcucgugcaaucgggcgcggaagugaaaaagcccgggagcucgcuaaaggucucgugcaaggccucgggcgugaccuuuagcauguacacgaucucgugggugcgccaggccccgggccagggcuuggaauggaugggcgggauaaucccgcucuuuggcacggccaauuacgagcaaaaguuccagggcagggucacgaucacggccgauaccucgaccaauaccgcguacauggaauugagcucgcucaggagcgaggacacggccguguacuauugcgcgcgcgcgggcacgaccuugaccagguucaauugguuugacccgugggggcaagggacccuggucacggucucgagc

SEQ ID NO: 58459 - RNA, 366 nt, Artificial Sequence
  derived and/or modified sequence opt11 from anti-influenza_Chain
auggccgacaacaugaccaccacccaaaucgaauggcgaaugaaaaaaauggccaucggcuccuccacccacuccucauccguccucaugaaagacauccaaucccaauucgaacaacucaaacuccgcugggaauccuaccccaaccucgucaaauccaccgacuaccaccaaaaacgcgaaaccauccgccucgccaccgaagaacucuaccuccuauccaaacgcaucgacgacuccauccucuuccacaaaaccgucaucgccaacuccuccaucaucgccgacaugauagucucccucucccuacucgaaacccucuacgaaaugaaagacgucgucgaagucuacucccgccaaugccuc

SEQ ID NO: 58460 - RNA, 366 nt, Artificial Sequence
  derived and/or modified sequence opt11 from anti-influenza_Chain
gagguccagcucgugcaaucgggcgggggcuugguccagcccgggggcucgcucaggcucgcgugcguggucucgggauuuaccgugaccucgaacuauaucacgugggugcgccaggccccgggcaagggcuuggaaugggucucggucauauacucgcacgggcgcgcguacuauagcgcgagcgugaacgggcgauuuaccauaagcaggcacacgagcaagaacacggucuaucucgagaugaauagcuugcgcccggaagauaccgcggucuauuacugugccgggggcgggcuagugggcggguacgaugaauauuucuuugacuauugggggcaagggaccuuggcaacggucucgagc

SEQ ID NO: 58461 - RNA, 366 nt, Artificial Sequence
  derived and/or modified sequence opt11 from anti-influenza_Chain
caagugcaauugguccagagcggggccgaggucaagaaaccgggcgcgagcgugaaagugagcuguaaagcgagcggguacacguucacgggcuauuacaugcacugggucaggcaagcgcccgggcaagggcucgaguggaugggcuggaucaaucccaauagcggggacacgaacuaugcccagaaauuucaagggcgcgugaccaugaccagggacacgagcauaaccacggccuauauggagcucucgagcuuacgcucggacgauaccgcggucuauuacugugccagggacucgcccuauagcucgagcuggagcuuuuucgauuacuggggccagggcccgcucgugaccgugagcucg

SEQ ID NO: 58462 - RNA, 366 nt, Artificial Sequence
  derived and/or modified sequence opt11 from anti-influenza_Chain
gaggugcaguugguggagagcggggggggguuggugcagccgggggggagccugagguugaguugugcggcgagcggguuuauauuuaggaauuauuggaugagcugggugaggcaggcgccggggaagggguuggaguggguggcgaauauaaagcaggaugggagggagaaguauuauguggauagucugagggggagggugaauauaaguagggauaaugcggagaauaguuuguauuugcauaugaauaguuugaggguggaggauacggcgguguauuuuugugcgagggcgaggauggugguggugacgggggauggguuugaugugugggggcaugggacgauggugacggugaguagu

SEQ ID NO: 58463 - RNA, 366 nt, Artificial Sequence
  derived and/or modified sequence opt11 from anti-influenza_Chain
gaagugcaauugcucgagagcgggggcgggcucgugcaaccgggcgggagcuugcgcuugagcugugccgcgagcggguucgcguucucgagcuauggcaugagcugggucaggcaagcgcccgggaaagggcucgagugggugagcgcguucucgggcucgggcacgagcacguacuaugccgauagcgugaaagggcgcuuuaccauaagcagggacaagagcaagaacacgcuauaucuccagaugaauagcuugcgcgcggaagauaccgcgaucuauuacugugccaagcccccgggcccguacauagucguggccgggcucuuugaaaauugggggcgagggacccuggucacggucucg

SEQ ID NO: 58464 - RNA, 366 nt, Artificial Sequence
  derived and/or modified sequence opt11 from anti-influenza_Chain
gagguccagcucguggaaucgggcgggggcgugguacagcccgggcgcucgcucaggcucucgugcgcggccucgggcuuuagcuuuagcaauuacgcgaugcauugggugcgccaggccccgggcaagggccuggaaugggucgcgcucauaucauuugacgggagcgauaaauauuacgcggacucggucaagggcagguucacgaugucgcgcgauaacagcaaaaauaccuuguacuugcaaaugaacucacucagggccgaggacacggccguguacuauugcgcgcgcgaugaaccguacuguggcggggacuguuucgcguucgaugucuggggccagggcacgauggugacagugagc

SEQ ID NO: 58465 - RNA, 366 nt, Artificial Sequence
  derived and/or modified sequence opt11 from anti-influenza_Chain
cagguccagcuccagcaaucgggcccgggcuuggucaagcccucgcaaacgcucucgcucacgugcacagucucgggcgggcccgugagcgggggcggguacucguggaauuggauacgccagcgcccgggccagggcuuggaaugggucggguucauguuccauagcggaagcccgcgcuauaacccgaccuugaaaucgcgcauaaccauaagcguggacacgagcaagaacuuggucucgcucaagcucucgagcgugaccgcggccgauaccgcggucuauuucugugccagggucgggcaaauggacaaguacuaugccauggacgugugggggcaagggaccacggucacggucucgagc

SEQ ID NO: 58466 - RNA, 366 nt, Artificial Sequence
  derived and/or modified sequence opt11 from anti-influenza_Chain
cagguccagcucgugcaaucgggcgggggcuuggucaagcccgggggcucgcucaggcucucgugcgcggccucgggcuuuaccuuuagcucguacucgaugaauugggugcgccaggccccaggcaagggccuggaaugggucucgagcauaagcucgagcucgagcuauaucuauuacguggacucggucaagggcagguucacgaucucgcgcgauaacgcgaaaaauagcuuguacuugcaaaugaacucgcucagggccgaggacacggccguguacuauugcgcgcgcgggggcgggagcuauggcgcguacgagggcuuugacuauugggggcaagggaccuuggucacggucucgagc

SEQ ID NO: 58467 - RNA, 366 nt, Artificial Sequence
  derived and/or modified sequence opt11 from anti-influenza_Chain
cagguccagcucgugcaaucaggcgggggcgugguccagcccgggcgcucgcucaggcucucgugcgcggccucgggcuuuaacuuuagcucguacgggaugcauuggguacgccaggccccgggcaagggcuuggaauggcucucggucauauggucgggcgggagcaauaaauauuacgcggacucggucaagggcagguucacgaucucgcgcgaugacucgaaaaauaccguguacuugcaaaugaacucgcucagggacgaggacacggccguguacuauugcgcgcgcgcgcacacggccuugaccagauucaggugguuggacccgugggggcaagggauccuggucacggucucgagc

SEQ ID NO: 58468 - RNA, 366 nt, Artificial Sequence
  derived and/or modified sequence opt11 from anti-influenza_Chain
caaguccaacucguccaauccggcggcggcgucguacaacgcggccgaucccuccgccucuccugcgccgccuccggcuucaccuuccgcaccuacggcaugcacuggguccgccaagcccccggcaaaggccucgaaugcgucgcccucaucuccuacgacggcaccaacaaauacuacgccgacuccgucaaaggccgcuucaccaucucccgcgacaacuccaaagacacccucuaccuccaaaugaacucccuccgcgccgaagacaccggcgucuacuacugcgccucccucgacuacgacuucuccuacuacuaccaccgcgacgucuggggccccggcaccaccgucaccgucuccucc

SEQ ID NO: 58469 - RNA, 366 nt, Artificial Sequence
  derived and/or modified sequence opt11 from anti-influenza_Chain
caagugcaauuggucgagagcgggggcgggcucgugcaaccgggcgggagcuugcgccugagcugugccgcgagcggguucacguucucggacuauuggauggucugggucaggcaagcgcccgggaaagggcucgugugggugagcaggaucucgagcgauggcucgacaacgagcuaugccgauagcgugaaagggcccuuuaccauaagcagagacaaugccaagaacacgcucuaucuccagaugaauagcuugcgcgcggaagauaccgcggucuauuacugugccagggucgcgaccccguacuauuacgagagcggguucgauuacuggggccagggcgcgcucgugaccgugagcucg

SEQ ID NO: 58470 - RNA, 369 nt, Artificial Sequence
  derived and/or modified sequence opt11 from anti-influenza_Chain
caauuccaacucguccaauccggccccgaagucaaaaaacccggcaccuccgucaaagucuccugcaaagccuccggcuacaccuccaccaccuacggcaucuccuggguccgccaaguccccggccaaggacucgaauggaugggcuggaucaaccccuacaacggcaacccccacuacggccaaaaauuccaaggccgcgucacccuaacccgcgacaccuccaccaacaccgccuaccucgaaauccucucccuccgcuccgacgacaccgccgucuacuacugcgcccgcgacggcuggggccaacaacucguccccuacuacuucgacuacuggggccaaggcacccucgucaccgucuccucc

SEQ ID NO: 58471 - RNA, 369 nt, Artificial Sequence
  derived and/or modified sequence opt11 from anti-influenza_Chain
caaguccaacucgcccaauccggcgccgaagucaaacgccccggcuccuccgucaaagucuccugcaccgccuccggcggcaucuuccgcaaaaacgccaucuccuggguccgccaagcccccggccaaggccucgaauggaugggcggcaucaucgccgucuucaacaccgccaacuacgcccaaaaauuccaaggccgcgucaaaaucaccgccgacgaauccggcaacaccgccuacauggaacucuccucccuccgcuccgacgacaccgccgucuacuacugcgccucccaccccaaauacuucuacggcuccggauccuaccccgacuucuggggccaaggcacccucgucaccgucucauca

SEQ ID NO: 58472 - RNA, 369 nt, Artificial Sequence
  derived and/or modified sequence opt11 from anti-influenza_Chain
caaguccaacuccaagaauccggccccggccucgucaaacccuccgaaacccucucccucaccugcaccgucucccgaggcuccaucggccacuacuucugguccuggauccgccaaccccccggcaaaggccucgaauggaucggauacaucuccuacuccggcuccaccaaauacaaccccucccuccgcucccgcgucaccaucuccgucgacaccuccaaaaaccaauucucccucaaccucaacuccgucaccgccaccgacaccgcccucuacuacugcgcccgcgaagacuacgacauccucaccggcgccggccccggcauggaagucuggggccaaggcaccaccgucaccgucuccucc

SEQ ID NO: 58473 - RNA, 369 nt, Artificial Sequence
  derived and/or modified sequence opt11 from anti-influenza_Chain
caaguccaacuccaagaauccggccccggccucgucaaacccuccgaaacccucucccucaccugcaccgucuccggcgccuccaucaacucccacuacugguccuggauccgccaaccccccggcaaaggccucgaauggaucggcuacgucuacuacuccggcuccaccaccuacaaccccucccucaaaucacgcgucacccuauccgucgacaccuccaaaaaccaauucucccuaaaccucuccucagucaccgccgccgacaccgccuucuacuacugcgcccgacaccccuacgacguccucaccggcucaggcgacugguucgaccccuggggccaaggcacccucgucaccgucuccucc

SEQ ID NO: 58474 - RNA, 369 nt, Artificial Sequence
  derived and/or modified sequence opt11 from anti-influenza_Chain
cagguccagcucgugcaaucgggcgcggaagugaaaaggcccgggagcucggucaagguaucgugcacggccucaggcgggaucuuucgcaagaacgcgaucucgugggugcgccaggccccgggccagggcuuggaauggaugggcgggauaaucgcggucuuuaacacggccaauuacgcgcaaaaguuccagaacagggucaagaucacggccgaugaaucgggcaauaccgcguacauggaauugagcucgcucacgagcgaugacacggccguguacuauugcgcgagccaucccaaguacuuuuacgggagcgggagcuaucccgauuucuggggccagggcacgcucgugaccgugagcucg

SEQ ID NO: 58475 - RNA, 369 nt, Artificial Sequence
  derived and/or modified sequence opt11 from anti-influenza_Chain
gaagugcaauuggucgagagcggggccgaggucaagaaaccgggcucgagcgugaaagugagcuguaaagcgagcgggggcacguucaggagcuaugccgugagcugggucagacaagcgcccgggcaagggcucgaguggaugggcgggaucauagccauauucgggaccacgaacuaugcccagaaauuucaagaucgcgugaccauaaccgcggacgaucuaccgagcacggccuauauggagcucacgagcuugcgcucggaagauaccgcggucuauuucuguguaaggggcaggggcuauuacuugggcggggacuauggcucgcucgauagcuggggccagggcacgcuagugaccgugagc

SEQ ID NO: 58476 - RNA, 369 nt, Artificial Sequence
  derived and/or modified sequence opt11 from anti-influenza_Chain
gaagugcaauuggucgagagcgggggcgggcucgugcaaccgggcaggagcuugcgccugagcugugucgggagcggguucaauuucgauggcuaugccaugcaaugggucaggcaagugcccgggaaagggcuagagugggugagcgggaucucguggcauagcgauagcacgggcuaugccgauagcgugcgcgggcgcuuuaccauaagcagggacaaugccaagaacucgcucuaucuccagauggauagcuugcgcccggaagauaccgcguucuauuacuguggcaagagcauaggccaugucgggggcucguacagacacccgaucgauuacuggggccagggcacgcucgugaccgugagc

SEQ ID NO: 58477 - RNA, 369 nt, Artificial Sequence
  derived and/or modified sequence opt11 from anti-influenza_Chain
caaguccaacuccaagccuccggccccggccucgucaaacccuccgaaacacucucccucacaugcaccgucuccggcgacuccaucaccuccggcgccuacuacuggaccuggauccgccaacaccccggcaaaggacucgaauggaucggcuacaucuacuacuccggcaacaccuacuacaaccccucccucaaaucccgcgucaccaucucccucgacaccuccaaaaaccaauucucccucaaagucaacuccgucaccgccgccgacaccgccgucuacuacugcgcccgagccgccuccaccuccguccucggcuacggcauggacgucuggggccaaggcaccaccgucaccgucuccucc

SEQ ID NO: 58478 - RNA, 369 nt, Artificial Sequence
  derived and/or modified sequence opt11 from anti-influenza_Chain
cagguccagcucgugcaaucgggcgcggaagugaaaaagcccgggagcucggucagggucucgugcaaggccucgggcucgaucuuucgcaauuacgcgaugucgugggugcgccaggccccgggccagggcuuggaauggaugggcgggauaaucgcgaucuuuggcacgcccaaguacgcgcaaaaguuccagggcagggucacgaucacggccgaugaaucgaccucgaccguguacauggaauugagcgggcucaggagcgaggacacggccauguacuauugcgcgcgcauaccccauuacaauuucgggagcgggagcuauuucgauuacuggggccagggcacgcucgugaccgugagcuca

SEQ ID NO: 58479 - RNA, 369 nt, Artificial Sequence
  derived and/or modified sequence opt11 from anti-influenza_Chain
caacuccaacuccaagaauccggcccccgacucgucaaacccuccgaaacccucucccucaccugcucugucuccggcgucuccaucuccuccuccaacuacuacuggggcuggauccgccaaccccccggcaaaggccucgaauggaucggcaccaucuaccacuccggcuccaccuacuacaaccccucccucaaaucccgccucaucaucuccgucgacacauccaaaaaccaauucuaccuccaacucaccucccucaccgccgccgacuccgccgucuacuacugcgccaccggcggcggcuucggcuggucccaaaccuacuucggcuacuggggccaaggcacccucgucaccgccuccucc

SEQ ID NO: 58480 - RNA, 369 nt, Artificial Sequence
  derived and/or modified sequence opt11 from anti-influenza_Chain
gaaguccaacuccaacaauccggccccgaacucgucaaacccggcgccuccgucaaaauguccugcaaagcauccggcuacaccuucaccuccuucaucauguacugggucaaacaaaaacccggccaaggccucgaauggcucggcuacaucgaccccuacaacgacggcaccaaauacaacgaaaaauucgaaggcaaagccacccucaccuccgacaaaucauccuccaccgccuacauggaacucuccucccucaccuccgaagacuccgccgucuacuacugcgccaaacgcggcaacuacggcaacggcuucgccuacuggggccaaggcacccuagucaccgucucagccgccaaaaccucc

SEQ ID NO: 58481 - RNA, 369 nt, Artificial Sequence
  derived and/or modified sequence opt11 from anti-influenza_Chain
cagguccagcucuuggaaucgggcggggacgugguccagcccgggaccucgcucaggcuaucgugcgcggccucgggcuuuagcuuguggacgagcgggaugcauugggugcgccaggccccgggcaagggcuuggaaugggucgcggucaugagcuaugacgagacaaagaaauauuacgcggacucggucaggggcagguucucgaucucgcgcgauaacucgcgcaauacauuguacuugcaaaugaacucgcuaagggucgaggacacggccguguacuuuugcgcgaaaccgcgcuuggacuaucuagauuacuuucacgcggccgauagcuggggccagggcacgcucgugagcgugagcucg

SEQ ID NO: 58482 - RNA, 369 nt, Artificial Sequence
  derived and/or modified sequence opt11 from anti-influenza_Chain
caaguccaacucgucgaauccggcgccgaaguccgcaaacccggcgaaucccuccgcaucuccugcaaagcccacggagacuccuucaccuccuacuggaucggcuggguccgccaacuccccggcaaaggccucgaauggauggccgucaucuacccccgagacuccgaaaccaaauucucccccgccuuccacggccaagucuccaucuccgucgacaaauccaccucaaccguccaccuccaauggaacucccucaaagccucugacaccgccgucuacuacugcgcccgcucccccggcuacuccggcuaccucuacggcugguucgaccccuggggccaaggcacccccgucaccgucuccucc

SEQ ID NO: 58483 - RNA, 369 nt, Artificial Sequence
  derived and/or modified sequence opt11 from anti-influenza_Chain
caaguccaacuagucgaauccggccccggccucgucaaacccuccgaaacccucucccucaccugcaccgucuccggcgacuccgucaucaacuccgccuacuacugggacuggauccgccaaccccccggcaaaggccucgaaugggucggcuccgucuacuacuccggcaucaccuacuacaaccccucccucaaaucccgcgucaccaucuccgucgacaccuccaaaaaccaauucucccuccgccucuccuacgucaccgccgccgacaccgcccucuacuacugcgcccgccgaggcggcggcuggcaauacuacuacggcauggacgucuggggccaaggcaccaccgucaccgucuccucc

SEQ ID NO: 58484 - RNA, 369 nt, Artificial Sequence
  derived and/or modified sequence opt11 from anti-influenza_Chain
caaguccaacucguccaauccggcgccgaagucaaaaaacccggcgccucagucaaagucuccugcaaagccuccggcuacaucuucaccggcuacuacauccacuggguccgccaagcccccggccaaggccucgaauggaugggccgcaucgaccccaacggcuccggcaccaccuacgcccaaaaauuccaaggccgagucacccucaccauggacaccucaaucaccaccgccuacauggaacucucccgccuccgcuucgacgacaccgccaucuacuacugcgcccgcugggacuggaacuucgaccucuaccucggcugguucgaccccuggggccaaggcaccccagucaccgucgccucc

SEQ ID NO: 58485 - RNA, 369 nt, Artificial Sequence
  derived and/or modified sequence opt11 from anti-influenza_Chain
gaagugcaauugguccagagcggggccgaggucaagaaaccgggcgcgagcgugaaagugagcuguaaagcgagcggguacauauucacgggcuauuacauacacugggucaggcaagcgcccgggcaagggcucgaguggaugggcaggaucgaucccaauggcgcgggcacgaccuaugcccagaaauuucaagggcgcgugaccuugaccauggacacgagcauaaccacggccuauauggagcucucgcgccugcgcuuugacgauaccgcgaucuauuacugugccaggugggauuggaauuucgaucucuaucucgggugguuugacccgugggggcaagggaccccggucacggucgcgagc

SEQ ID NO: 58486 - RNA, 369 nt, Artificial Sequence
  derived and/or modified sequence opt11 from anti-influenza_Chain
caagugcaauugguacagagcggggccgaggucaagaaaccgggcgcgagcgugaaagugagcuguaaagcgagcggguacacguucaaugcccaucacaugcacugggucaggcaagcgcccgggcaagggcucggguggaugggcuggaucgaucccaauaacgauggcacgaucuaugcccagaaauuucaagggcgcgugaccuugaccauggacacgagcauacacacggccuauauggagcucucgggcuugcgcuaugacgauaccgcgaucuauuacugugucaggugggcguggaauuucgauuucuuucucgggugguuugacccgugggggcaagggaccuuggucacggucgcgagc

SEQ ID NO: 58487 - RNA, 369 nt, Artificial Sequence
  derived and/or modified sequence opt11 from anti-influenza_Chain
gagguccagcucgugcaaucgggcgcggaagugaaaaagcccggcgaaucgcucaagaucucgugcaaggucucgggcuauagcuuuaccucgcaauggaucgggugggugcgccaaaugccgggcaagggcuuggaauggaucgggaugauguacccgggcgauagcgauaccauauacucgcccucguuccagggccaggucacgaucucggccgauaacucgaucucgaccgcguaccugcaauggagcucgcucaaggccucggacacggccauauacuauugcgcgagcgggcccggguacucgggcuaucacuauggcugguucgauaccuggggccagggcacgcucgugaccguaagcuca

SEQ ID NO: 58488 - RNA, 369 nt, Artificial Sequence
  derived and/or modified sequence opt11 from anti-influenza_Chain
gagguccagcucgugcaaucgggcgcggaagugaaaaagcccggggaaucgcucaagaucucgugcaaggucucgggcuauagcuuuaccucgcaauggaucgggugggugcgccagaugccgggcaagggcuuggaauggaucgggaugauguacccgggcgaugcagaugccauauacucgcccucguuccagggccaggucacaaucucggccgauaacucgaucucgaccgcguacuugcaauggagcucgcucaaggccucggacacggccauauacuauugcgcgagcgggcccggguacucgggcuaucacuauggcugguucgauaccuggggccagggcacgcucgugaccgugagcucg

SEQ ID NO: 58489 - RNA, 369 nt, Artificial Sequence
  derived and/or modified sequence opt11 from anti-influenza_Chain
gagguccagcucgugcaaucaggcgcggaagugaaaaagcccggggaaucgcucaagaucucgugcaaggucucaggcuauagcuuuaccucgcaauggaucgggugggugcgccagaugccgggcaagggcuuggaauggaucgggaugauguacccgggcgagagcgagaccauauacucgcccucguuccagggccaggucacgaucucggccgauaacucgaucucgaccgcguacuugcaauggagcucgcucaaggccucggacacggccauauacuauugcgcgagcgggcccggguacucgggcuaucacuauggcugguucgauaccuggggacagggcacgcucgugaccgugagcucg

SEQ ID NO: 58490 - RNA, 369 nt, Artificial Sequence
  derived and/or modified sequence opt11 from anti-influenza_Chain
gaagugcaauugguccagagcggggccgaggucaagaaaccgggcgagagccugaaaauaagcuguaaagugagcggguacucguucacgagccaguggauaggcugggucaggcaaaugcccgggaaagggcucgaguggauaggcaugauguaucccggggacgcggacacgaucuauagcccgagcuuucaagggcaagugaccauaagcgcggacaauagcauaagcacggccuaucuccaguggucgagcuugaaagcgagcgauaccgcgaucuauuacugugccucgggcccgggcuauagcggguaccauuacgggugguuugacacgugggggcaagggaccuuggucacggucucgagc

SEQ ID NO: 58491 - RNA, 369 nt, Artificial Sequence
  derived and/or modified sequence opt11 from anti-influenza_Chain
gaaguccaacucguccaauccggcgccgaagucaaaaaacccggcgaaucccucaaaaucuccugcaaagucuccggcuacuccuucaccucacaauggaucggcuggguccgacaaaugcccggcaaaggccucgaauggaucggcaugauguaccccggcuccuccgacaccaucuacucccccuccuuccaaggccaagucaccaucucagccgacaacuccaucuccaccgccuaccuccaauggucaucccucaaagccuccgacaccgccaucuacuacugcgccuccggccccggcuacuccggcuaccacuacggcugguucgacaccuggggccaaggcacccucgucaccgucuccucc

SEQ ID NO: 58492 - RNA, 369 nt, Artificial Sequence
  derived and/or modified sequence opt11 from anti-influenza_Chain
gaagugcaauugguccagagcggggccgaggucaagaaaccgggcgagagcuugaaaauaagcuguaaagugagcggguacucguucacgagccaguggauaggcugggucagacaaaugcccgggaaagggcucgaguggauaggcaugauguaucccggggacucggacgcgaucuauagcccgagcuuucaagggcaagugaccauaagcgcggacaauagcauaagcacggccuaucuccaguggucgagccugaaagcaagcgauaccgcgaucuauuacugugccucgggcccgggcuauagcggauaccauuacgggugguuugacacgugggggcaagggaccuuggucacggucucgagc

SEQ ID NO: 58493 - RNA, 369 nt, Artificial Sequence
  derived and/or modified sequence opt11 from anti-influenza_Chain
gagguccagcucgugcaaucgggcgcggaagugaaaaagcccggggaaucgcucaagaucucgugcaaggucucgggcuauagcuuuaccucgcaauggaucgggugggugcgccagaugccgggcaagggcuuggaauggaucgggaugauguacccgggcgauaccgauaccauauacucgcccucguuccagggccaggucacgaucucggccgauaacucgaucucgaccgcguacuugcaauggagcucgcucaaggccucggacacggccauauacuauugcgcgagcgggcccggguacucgggcuaucacuauggcugguucgauaccuggggccagggcacgcucgugaccgugagcucg

SEQ ID NO: 58494 - RNA, 369 nt, Artificial Sequence
  derived and/or modified sequence opt11 from anti-influenza_Chain
gagguccagcucgugcaaucaggcgcggaagugaaaaagcccggggaaucgcucaagaucucgugcaaggucucgggcuauagcuuuaccucgcaauggaucgggugggugcgccagaugccgggcaagggcuuggaauggaucgggaugauguacccgggcgagagcgauaccauauacucgcccucguuccagggccaggucacgaucucggccgauaacucgaucucgaccgcguaccugcaauggagcucgcucaaggccucggacacggccauauacuauugcgcgagcgggcccggguacucuggcuaucacuacggcugguucgauaccuggggccagggcacgcucgugaccgugagcucg

SEQ ID NO: 58495 - RNA, 372 nt, Artificial Sequence
  derived and/or modified sequence opt11 from anti-influenza_Chain
cagguccagcuagugcaaucgggcgcggaagugaaaaagcccgggagcucggucaaggucucgugcaaggccucgggcgggaucuuuaucucgcaagcgaucucgugggugcgccaggccccgggccagggcuuggaauggaugggcgggauaaucccgauguuuggcgcgaccaauuacgcgcaaaaguuccagggcagggucacgaucacggccgauaaaucaaccaauaccguguacauggaauugagcucgcuaacgagcgaggacacggccguguacuauugcgcgcgcuugggcucgggcucguaccauaacggacccaauugguuugacccgugggggcaagggaccuuggucacggucucgagc

SEQ ID NO: 58496 - RNA, 372 nt, Artificial Sequence
  derived and/or modified sequence opt11 from anti-influenza_Chain
caaguccaacuacaagaauccggccccggccucgucaaacccuccgaaacccucucccucaacugcgccgucuccggcggcuccaucuccaacuacuacugguccuggauccgacaaccacccggcaaaggccucgaauggaucggcuacaucuccuacaacggccgccccaaauacaaccccucccucaccucacgcgucaccaucuccgucgacaccuccaaagaccaauucucccucgaacuccgcuccgucaccgccgccgacaccgcccucuacuacugcgcccgcgaaacccgcuucggcgaacuccucucccccuacgacgccuucgaaaucuggggccaaggcaccauggucaccgucuccucc

SEQ ID NO: 58497 - RNA, 372 nt, Artificial Sequence
  derived and/or modified sequence opt11 from anti-influenza_Chain
caaguccaacuccaagaauccggccccggccuagucaaacccuccgaaacccucucccucaccugcaccgucuccggcggcuccgucuccuccgaaaccuacuacugguccuggauccgccaaccccccggcaaaggccucgaauggaucggcuacaucuacuacaucggcaacaccgacuaccgccccucccucaaaucccgcgucaccaucucccucgacaccuccaaaaaccaauucucccucaaacucuccuccgucaccgccgccgacaccgccgucuacuacugcgcccgcggcgccuacuacgacuccuccggcuaccccgccuucuacaucuggggccaaggcaccauggucaccgucuccucc

SEQ ID NO: 58498 - RNA, 372 nt, Artificial Sequence
  derived and/or modified sequence opt11 from anti-influenza_Chain
caaguccaacuccaagaauccggccccggccucgucaaacccucugaaacccucucccucaccugcgccgucuccggcgucuccaucuccaacaucgacuucuacuggggcuggauccgccaaccccccggcaaaggccucgaauggaucggcaacaucuacuacaccggcaucaccuucuacaaccccucccucuccucccgcgucgccaucuccaucgacaccuccaaaaaccaauucucucucacccucaccuccgucacagccgccgacaccgccauguacuacugcgcccgccacuacggcgacuccgaagccaucaacgacgccuucgacaucuggggccaaggcaccaugcucaccgucuccucc

SEQ ID NO: 58499 - RNA, 372 nt, Artificial Sequence
  derived and/or modified sequence opt11 from anti-influenza_Chain
caagugcaauuggucgagagcggggccgaggucaagaaauuuggcgcgagcgugaaagugagcuguaaagcgagcggguacacgcucauagacuauuacaugcacugggucagggucgcgcccgggcaagggcucgaguggaugggcuggaucaaucccauaaacgggggcacgaacuaugcccagaaauuucaagggcgcgugaccaugaccagggacacgagcauaaacacggcauauauggaucucucgagcuugcgcucggacgauaccgcgauguauuacuguaccaggggcaggcccauaggcaggaacugggaaccgcgcgauaaagauuacuggggccagggcacgcccgugaccgugaguucg

SEQ ID NO: 58500 - RNA, 372 nt, Artificial Sequence
  derived and/or modified sequence opt11 from anti-influenza_Chain
caaguccaacucguccaauccggcgccgaagucaaaaaacccggcuccuccgucaccgucuccugcaaaaccuccggccacaccuucaucucauacgccaucuccuggcuccgccaagcccccggccaaggccucgaauggaugggcggcaucguccccaucuucggcaccgucaacuacacacaaaaauuccaaggccgccucaccaucaccgccgacgaauccaccuccaccgccuacauggaccucucccgccucaccuucgaagacaccgccaucuacuucugcgcccgcgaagccggcuaccacuccuccuucuccggcgucuacuucgacuacuggggccaaggcacccuccuuaccgucuccucc

SEQ ID NO: 58501 - RNA, 372 nt, Artificial Sequence
  derived and/or modified sequence opt11 from anti-influenza_Chain
gaaguccaacuccaacaauccggccccgaacucgucaaacccggcgccuccgucaaaaucuccugcaaagccuccggcuacaccuucaccgacuacaacaugcacugggucaaacaaucccucggcaaaucccucgaauggaucggcuacaucuaccccaacaacggcggcaccggcuacaaccaaaaauucgaauccaaagccacccucaccgucgacaacuccuccuccaccgccuacauggaacuccgcacccucaccuccgaagacuccgccgucuacuacugcguccgcuccggcgccuacuacuucaacuaccucguccccuacuucgacuacuggggccaaggcaccacccucaccgucuccucc

SEQ ID NO: 58502 - RNA, 372 nt, Artificial Sequence
  derived and/or modified sequence opt11 from anti-influenza_Chain
gaaguccaacuccaacaauccggccccgaacucguaaaacccggcgccuccgucaaaaucuccugcaaagccuccggcuacaccuucaccggcuacaacaugcacugggucaaacaaucacacggcaaaucacucgaauggaucggcaaaaucuaccccaacaacggcgucaccggcuacaaccaagaauuccgcucaaaagccacccucaccgucgacaacuccuccuccaccgccuacauggaacuccgaucccucaccuccgaagacuccgccaucuacuucugcguccgcuccggcgccuacuacgucaacuaccucguccccuacuucgacuacuggggccaaggcaccacccucaccgucuccucc

SEQ ID NO: 58503 - RNA, 375 nt, Artificial Sequence
  derived and/or modified sequence opt11 from anti-influenza_Chain
caagugcagcuaguacaaagcggggcagagguaaagaaaccgggaagcagcgugaaagugagcugcaaagcaagcgggguaacgagcagcaacuacccaauaacauggguaaggcaggcgccagggcaagggcuagaguggaugggagggguacugccacuguucgggguaacgaacuacgcacagaaauuccaagggagagugacaauaagcgcagacaaaagcacaaacacggcauacauggagcuaagcagccugagaagcgaagacacagcgguauacuacugcgcaagaggaaagagaccgggauacugcagcggagggguaugcagcagcgacuacugggggcaagggacacugguaacaguaagcagc

SEQ ID NO: 58504 - RNA, 375 nt, Artificial Sequence
  derived and/or modified sequence opt11 from anti-influenza_Chain
caaguccaacuccaagaauccggccccggccucgucaaacccucccaaacccucucccucaccugcaccgucuccggcggcuccaucuccuccggcaccuacuacugguccuggauccgccaccaccccggcaaaggccucgaauggaucggcuacaucuaccacucaggcuccgccuacuacaaccccucccucgaaucccgcguaaccauguccgucgacaccucaaaaaaccaauucucccucaaacucuccuccgucaccgccgccgacaccgccaucuacuacugcgcccgcgccgaaaaccuccucucccccuaccucgccgaaggauucgaccccuggggccaaggcacccucgucaccgucuccucc

SEQ ID NO: 58505 - RNA, 375 nt, Artificial Sequence
  derived and/or modified sequence opt11 from anti-influenza_Chain
gagguccagcucgugcaaucgggcgcggaagugaaaaagcccggggaaucgcucaagaucucgugccaggccucgggcuauagcuuuaccucgcgauggaucgggugggugcgccagaugccgggcaagggcuuggaaugggucggguucauauacccgagcgauagugaugucagguacucgcccucguucaggggccaggucacgaucucggccgauaaaucgaucucgaccgcguacuugcaauggagcucgcucaaggccucggacacggccauguacuuuugcgcgcgcuugggcgggaacaaggacuauggcgauuacuugugguauuucgaucucuggggcaggggcgcgcucgugaccgugagcuca

SEQ ID NO: 58506 - RNA, 375 nt, Artificial Sequence
  derived and/or modified sequence opt11 from anti-influenza_Chain
caagugcaauuggucgagagcgggggcggggucgugcaaccgggcaggaguuugcgcuugagcugugccgcgagcggguucacguucucgagcuauggcaugcacugggucaggcaagcgcccgggaaagggcucgaguggguggccgugaucugguacgauggcgauaacaaguacuauggcgauagcgugaaagggcgcuuuaccauaagcagggacaauagcaagaacacgcucuuucuccagaugaauagcuugcgcgcggaagauaccgcggucuauuacugugccaaggacacggccgaucacggggacuaugucgaucucggguucuuugacgcgugggggcaagggacauugguaacggucucgagc

SEQ ID NO: 58507 - RNA, 375 nt, Artificial Sequence
  derived and/or modified sequence opt11 from anti-influenza_Chain
gaagugcaauugguccagagcggggccgagcucaagaugccgggcgagagcuugaaaauaagcuguaaagcgagcggguacacguucacgaacuauuggauaggcugggucaggcaaacgcccgggaaagggcucgaguggaugggcauaaucuuucccccggacucgcaaacgagcuauagcccgagcuuucaagggcaagugaccuuuagcguggacaauagcauaagcguggccuauauccaguggucgagccugaaagcgagcgauaccgcgaucuauuacugugccaggagcgggaucuuugacuggagcgcgcccuuggucgaggccuuugacauaugggggcaagggaccguggucacggucucgagc

SEQ ID NO: 58508 - RNA, 375 nt, Artificial Sequence
  derived and/or modified sequence opt11 from anti-influenza_Chain
gaaguccaacucguccaaucaggcgccgaagucaaaaaacccggcgaaucccucaaaaucuccugcaaaggcuccggcuacuccuucuccgacuacuggaucggcugggucagacaaaugcccggcgaaggccucgaauggaugggcaucaucuaccccgccuccuccgaaauccgcuacucccccuccuuccaaggccucgucaccaucuccgccgacaaauccaucaacaccgccucccuccaaugguccucccucaaagccuccgacaccgccaucuacuacugcgcccgccacgccuccugcuccgcccgcucaugcuacuggggccccgucgacuacuggggccaaggcacccucgucaccgucucuucc

SEQ ID NO: 58509 - RNA, 375 nt, Artificial Sequence
  derived and/or modified sequence opt11 from anti-influenza_Chain
cagguccagcuaguggaaucaggcgggggcgugguccagcccgggcgcucacucaggcucucgugcgcggccucggaaauaaccuucaucacguacgcgaugcacugggugcgccaggccccgggcaagggccuggaaugggucgcgcucauaagcgaugacgggagcaauaaauuuuacgcggacucggucaagggcagguucacgaucucgcgcgauaacucgaaaaauaccuuguacuugcaaaugaacucgcucagggccgaggacacggccgcguacuauugcgcgcgcgagggcguguacuuugacucgggcacguacaggggauauuucgauuacuggggccaggaaacacucgugaccgugagcucg

SEQ ID NO: 58510 - RNA, 375 nt, Artificial Sequence
  derived and/or modified sequence opt11 from anti-influenza_Chain
caaguccaacuccaagaauccggccccggccucgucaaacccucccaaacucucucccuaaccugcaccgucuccggcggcuccaucuccuccggcaacuacuacuggaacuggguccgccaacaccccggcaaaggccucgaauggaucggcuacaucuacuaccgcggcuccaccuucuacaaccccucccucaaaucccgcgucaccaucuccaucgacaccuccaaaaaccaauucucccuccgccucuccuccgucaccgccgccgacaccgccgucuacuacugcgccaaagacacacgcuccucccucgacaacuaccaauacggcauggacgucuggggccaaggcaccaccgucaccgucuccucc

SEQ ID NO: 58511 - RNA, 375 nt, Artificial Sequence
  derived and/or modified sequence opt11 from anti-influenza_Chain
gagguccagcucuuggaaucgggcgggggcuugguccagcccgggggcucgcucaggcucucgugcgcggccucaggauuuagcuuuagcacguacgcgaugucaugggugcgccaggccccgggcaagggcuuggaaugggucucaggcauaagcgggagcggggaaucgaccuauuacgcggacucggucaagggcagguucacggucucgcgcgauaacucgaaaaauaccuuguacuugcaaaugaacucgcucagggccgaggacacggccguguacuauugcgcgaaacagggcgaucacauagccuggcucuugcgcgggaucaauuucgauuacuggggccagggcgugcuagugaccgugagcucg

SEQ ID NO: 58512 - RNA, 375 nt, Artificial Sequence
  derived and/or modified sequence opt11 from anti-influenza_Chain
caaguccaacucgucgaauccggcggcggcgucguccaacccggccgcucccuccgccucuccugcgccgccuccggcuucgccuuccacaaccgcgccaugcacuggguccgccaagcccccggcaaaggccucgaaugggucgcccucaucuacuucgacggcuccaaacaauacuacgccgacuccgucaaaggccgcuucaccaucucccgcgacaacuccaaaaacaccgucuuccuacaaaugaacucacuccgccccgaagacaccgccgucuacuacugcgccguccccggccccaucuucggcaucuucccacccugguccuacuucgaccacuggggccaaggcauccucgucaccgucuccucc

SEQ ID NO: 58513 - RNA, 375 nt, Artificial Sequence
  derived and/or modified sequence opt11 from anti-influenza_Chain
gaaguccaacucguagaaucaggcggaggcgucguccaacccggccgcucccuacgccucuccugcgccgccuccggcuucgccuuccacaaccgcgccaugcacuggguccgccaagcccccggcaaaggccuagaaugggucgcccucaucuacuucgacggcuccaaacaauacuacgccgacuccgucaaaggccgcuucaccaucucacgcgacaacuccaaaaacaccgucuuccuccaaaugaacucccuccgccccgaagacaccgccgucuacuacugcgccguccccggccccaucuucggcaucuucccacccugguccuacuucgaccacuggggccaaggcauccucgucaccgucuccucc

SEQ ID NO: 58514 - RNA, 375 nt, Artificial Sequence
  derived and/or modified sequence opt11 from anti-influenza_Chain
gaaguccaacucguccaauccggcggcggcgucguccaacccggcaaaucccuccgccucuccugcgccgccuccggccucaccuucuccuccuacgccguccacuggguccgccaagcccccggcaaaggccuugaaugggucacccucaucuccuacgacggcgccaaccaauacuacgccgacuccgucaaaggccgcuucaccaucucccgcgacaacuccaaaaacaccgucuaccuccaaaugaacucccuccgccccgaagacacagccgucuacuacugcgccguccccggccccgucuucggcaucuucccccccugguccuacuucgacaacuggggccaaggcauccucgucaccgucuccuca

SEQ ID NO: 58515 - RNA, 375 nt, Artificial Sequence
  derived and/or modified sequence opt11 from anti-influenza_Chain
caaguccaacucgucgaauccggcggcggcgucguccaacccggcaaaucccuacgccucuccugcgccgccuccggccucaccuucuccuccuacgccguccacuggguccgccaagcccccggcaaaggccucgaaugggucacccucaucuccuacgacggcgccaaccaauacuacgccgacuccgucaaaggccgcuucaccaucucccgcgacaacuccaaaaacaccgucuaccuccaaaugaacucccuccgccccgaagacaccgccgucuacuacugcgccguccccggccccgucuucggcaucuucccccccugguccuacuucgacaacuggggccaaggcauccucgucaccgucuccucc

SEQ ID NO: 58516 - RNA, 375 nt, Artificial Sequence
  derived and/or modified sequence opt11 from anti-influenza_Chain
caaguccaacucgucgaauccggcggcggcgucguccaacccggcaaauccccccgccucuccugcgccgccuccggccccaccuucuccuccuacgccguccacuggguccgccaagcccccggcaaaggccucgaaugggucacccucaucuccuacgacggcgccaaccaauacuacgccgacuccgucaaaggccgcuucaccaucucccgcgacaacuccaaaaacaccgucuaccuccaaaugaacucccuccgccccgaagacaccgccgucuacuacugcgccguccccggccccgucuucggaaucuucccccccugguccuacuucgacaacuggggccaaggcauccucgucaccgucuccucc

SEQ ID NO: 58517 - RNA, 375 nt, Artificial Sequence
  derived and/or modified sequence opt11 from anti-influenza_Chain
gaaguccaacucgucgaauccggcggcggcgucguccaacccggcaaaucccuccgccucuccugcgccgccuccggccucaccuucuccuccuacgccguacacuggguccgccaagcccccggcaaaggccucgaaugggucacccucaucuccuacgacggcgccaaccaauacuacgccgacuccgucaaaggccgcuucaccaucucccgcgacaacuccaaaaacaccgucuaccuccaaaugaacucccuacgccccgaagacaccgccgucuacuacugcgccguccccggccccgucuucggcaucuucccccccugguccuacuucgacaacuggggccaaggcauccucgucaccgucuccuca

SEQ ID NO: 58518 - RNA, 375 nt, Artificial Sequence
  derived and/or modified sequence opt11 from anti-influenza_Chain
caaguccaacucguccaauccggcgccgaacucaaacgacccggcgccucagucaaagucuccugcaaaaccuccggcuacuccuucaacaacuacggcaucaacuggguccgccaagcccccggacaaggccucgaauggaugggcuggaucuccgccuacaccggcaacacccacuacgccaaaaacuucgaaggccgcgucacccucaccaccgacaccuccaccuccaccgccuacauggaaguccgcucccuccgcuccgacgacuccgccgucuacuucugcgcccgcgccaugauccaaggcgucgucacccucuaccuccgccccggcgacuacuggggccaaggcacccucgucaccgucucaucc

SEQ ID NO: 58519 - RNA, 375 nt, Artificial Sequence
  derived and/or modified sequence opt11 from anti-influenza_Chain
caaguccaacucguccaauccggcgccgaagucaaacaacccggcgccuccgucaaagucuccugcaaagccuccggcuacaccuucaacgccuacuacauccacuggguccgccaagcccccggccaaggccucgaauggaugggcuggaucaaccccaacuucggcggaacccacuacgcccgcaaauuccaaggccgcgucaccaugacccgcgacgccuccaucaacacagcauacauggaacuagaccgccucaucuccgacgacaccgccgucuacuacugcguccgcuggcgcgccgccgccgucaucauggaccaauucuacaaaauggacgucuggggccaaggcacccucgucaccgucuccucc

SEQ ID NO: 58520 - RNA, 375 nt, Artificial Sequence
  derived and/or modified sequence opt11 from anti-influenza_Chain
caaguccaacucguccaauccggccccgaacucaaaaaacccggcuccuccgucaaacucuccugcauggccaccggcggcaccuucaucaacuacgcauucucauggguccgccaagcccccggccaaggccuagaauggcucggcggcaucaucccagucuacggcaccucaaaccacgucgaaaaacuccaaggccgcgucaccaucaccgccgacgccuccaccaacaccgccuacauggaacucuccggccuccgcuucgacgacaccgccgucuacuucugcgccgccuccaccgccaccuccggcaccuacuacgccaugcgacccuucgacuucuggggccaaggcacccucgucuccgucuccucc

SEQ ID NO: 58521 - RNA, 378 nt, Artificial Sequence
  derived and/or modified sequence opt11 from anti-influenza_Chain
gaaguccaacucgucgaauccggcggcggcgucguccaacccggcggcucccuccgccucucaugcaucgccuccgccuucaaccucggcaucuucggcaugcacuggguccgccaagcccccggcaaaggccucgaaugggucgcauucauccgcuacgacggcggcaaaaccuucuacgccgacuccgucaaaggccgcuucaccaucucccgcgacaacuccaaaaacacccucuaccuccaaaugaacucacuccgcaccgaagacaccgcccucuacuacugcgcccgcgacgccaccgccgacuacuacggccccggcuccuaccccaacuggcucgaccccuggggccaaggcacccucgucaccgucucc

SEQ ID NO: 58522 - RNA, 378 nt, Artificial Sequence
  derived and/or modified sequence opt11 from anti-influenza_Chain
gaaguccaacuagucgaauccggccccgcccucgucaaacccacccaaacccucacccucaccugcuccuucuccggcuucucccucuccaccuccggcauguccgucucauggauucgccaaccccccggcaaagcccucgaauggcucgcccucaucgacugggacgacgacaccuacuacaucaccuacuccuccucccucaaaacccgccucaccaucuccaaagacaccuccaaaucccaagucguccucaccaugaccaacauggaccccgucgacaccgccaccuacuacugcgcucgcacccuccgcgucuccggcgacuacguccgcgacuucgaccucuggggccgcggcacccucgucaccgucucc

SEQ ID NO: 58523 - RNA, 378 nt, Artificial Sequence
  derived and/or modified sequence opt11 from anti-influenza_Chain
caaguccaacuacaagaauccggccccggccucgucaaacccuccgaaacccucucccucaccugcaccgucuccggcggcuccaucaacuccuacuacuggaacuggauccgccaaccccccggcaaaggccucgaauggaucggcuacaucuaccacuccggcucaaccaacuacaaccccucacucaaaucccgagucaccaucuccgucgacaccucaaaaaaccaauucucccuccaacucuccuccgucaccgccgccgacaccgccgucuacuacugcgcccgccuccgcaccgacuacggcgaccccgacuccgucuacuacuacggcauggacgucuggggccaaggcaccacagucaccgucuccucc

SEQ ID NO: 58524 - RNA, 378 nt, Artificial Sequence
  derived and/or modified sequence opt11 from anti-influenza_Chain
caaguccaccucguccaauccggcgccgaaguccgcaaacccggcgacuccgucaaaguauccugcaaaaccuccggcuacaccuucuccaccuaccccgucgccuggguccgccaaguccccggccaaggccucgaauggaugggcuggaucuccaccuacaacggcaacaccaacuucgcccaaaacuuccaaggccgcgucacccucaccaccgacaccaccaccaacaccgccuacauggaaguccgcucccucaaauucgacgacaccgcagucuacuacugcgcccgcgucgaaggcuccuaccgcgacuucuggaacaaccaaaaccgcuucgaccccuggggccaaggcacccucgucaccgucuccucc

SEQ ID NO: 58525 - RNA, 378 nt, Artificial Sequence
  derived and/or modified sequence opt11 from anti-influenza_Chain
gagguccagcucguggaaucaggcgcggaagugaaaaagcccggggccucggucaaggucucaugcaaggccucgggcuauaccuuuaccucguucgauaucaauugggugcgccaggccccgggccagggcuuggaauggaugggguggaugaccccgaccucgggcaagaccggguacgcgcaaaaguuccagggcagaaucacgaugacgcgcaauaccucgaucaauaccgcguacauggaauugagcucgcucaggagcgaggacacggccguguacuuuugcgcgcgcgggcccgagcgcaggaccacgaucuuugacgugaucuuggacugguucgaccccuggggccagggcacgcucgugaccgugagc

SEQ ID NO: 58526 - RNA, 378 nt, Artificial Sequence
  derived and/or modified sequence opt11 from anti-influenza_Chain
caaguccaacucguccaauccggcgccgaagucaaaaaacccggcucauccgucaaagucuccugcaaagccuccggcggcuucuucuccuccuacgccaucuccuggguccgccaagcccccggccaaggccucgaauggaugggcggcgucauccccaucuuccgcaccgccaacuacgcccaaaacuuccaaggccgcgucaccaucaccgccgacgaauucaccuccuacauggaacuauccucccuccgcuccgacgacaccgccgucuacuacugcgcccgccucaacuaccacgacuccggcaccuacuacaacgccccccgcggcugguucgaccccuggggccaaggcacccuagucacagucuccucc

SEQ ID NO: 58527 - RNA, 378 nt, Artificial Sequence
  derived and/or modified sequence opt11 from anti-influenza_Chain
caagugcaacugguccagagcggggccgaggucaagaaaccaggcucaagcgugaaaguaagcuguaaagcgagcggaggcgcauucucgaacuacgccauaagcugggucaggcaagcacccgggcaaggacucgaguggaugggcgggaucauacccauauucgggaccacgaacuacgcccagaaauuccaagggcgcgugacaauaaccgcggacaaguucacgaccauagccuauauggagcucagaagccugcgcucagaagauaccgcggucuauuacugugccagacacgggggcguguacuauuacgggagcgcgagcucgggcugguucgaucccuggggccagggcacgcucgugaccgugagcucg

SEQ ID NO: 58528 - RNA, 378 nt, Artificial Sequence
  derived and/or modified sequence opt11 from anti-influenza_Chain
cagguccagcuccuggaaucgggcgggggcguggucaggcccgggcgcucgcucaggcucgcgugcgcgggcucgggcuuuaccuuuagcgcguacgcgaugcauugggugcgacaggccccgggcaagggcuuggaaugggucgcgcacacgagcuaugacgggcgcgauagcuauuacguggacucggucaagggcagguucacgaucucgcgcgaugacucgaaaaauaccuuguacuugcaaaugaacucgcucaggcccgaggacacggccguguacuauugcgcgaaagugggcccguacacgggcuaugacgauuacaauuacuauggcauggacgugugggggcacgggaccacggucacggucucgagc

SEQ ID NO: 58529 - RNA, 378 nt, Artificial Sequence
  derived and/or modified sequence opt11 from anti-influenza_Chain
caagugcaauuggucgagagcgggggcggggucgugcaaccgggagggagcuugcgcuugagcugugccgcgagcggguucaauuucgaugaauaugucauguacugggucaggcaaucgcccgggaaagggcucgagugggugagcuugaucggggccgauggaagaggaacguacaauagcgauagcgugaaagggcgauuuaccauaagcagggacaaucgcaagaacucgcuauaucuccagaugaauagcuugcgcucggacgauaccgcgcucuauuacugugccaaggucgagcgcucauucuaugacgggagcggguacggggacgcgcucgagaucuggggccagggcacgauggugaccgugagcucg

SEQ ID NO: 58530 - RNA, 381 nt, Artificial Sequence
  derived and/or modified sequence opt11 from anti-influenza_Chain
gagguccagcucuuggaaucgggcgggggcuugguccaucccgggggcucgcucaggcucucgugcgcggccucgggcuuuaccuuuagcaauuacgcgaugucgugggugcgccaggccccgggcaagggcuuggaaugggucucgagcauaaacucgggcgggggcgcgaccuauuacgcggacucggucaagggcagguucacgaucucgcgcgauaacucgaaaaauaccuugagcuugcaaaugaacucgcuaagggccgaggacacggccguguacuauugcgcgaaagagggcgggaacacgaucuuuggcuuggucacaauggcguacuauuucgauagcuggggccagggcacgcucgugaccgugagcucg

SEQ ID NO: 58531 - RNA, 381 nt, Artificial Sequence
  derived and/or modified sequence opt11 from anti-influenza_Chain
caaccccaacuccaagaauccggccccggccucguccgccccuccgaaacccucucucucaccugcaccgucuccggcgacuccgucacccgcggcggcuucuacuggggcuggauccgccaaccccccggcaaaggccucgaauggaucggcuccaucuacuacaacuacaacaucuaccacucccccucccucaaaucacgcgucucccuauccgucgacaccuccaaaaaccaagucucccucaaacucgccucagucaccgccgccgacaccgccgucuacuacugcgcccgccacuaccccuacuacgaccuccccaccggcuucuacucccaauucgacuucuggggccaaggcacccccgucaccgucuccucc

SEQ ID NO: 58532 - RNA, 381 nt, Artificial Sequence
  derived and/or modified sequence opt11 from anti-influenza_Chain
ugguggcagcuagugcaaucgggcgcggaagugaaaaagccagggagcucggucaaggucucgugcaaggccucgggcgggaccuuuagcucguacgauaucucgugggugcgccaggccccgggccagggcuuggaauggaugggcgggauaaucccgaucuauggcacggccaauuacgcgcaaaaguuccagggaagggucacgaucacggccgaugaaucgaccucgaccgcguacauggaauugagcucgcucaggagcgaggacacggccguguacuauugcgcgcgcgcgggcggggacucgagcggguacuauggcgcgcucgggcgauuuuuccagcacuggggccagggaacgcucgugaccgugagcucg

SEQ ID NO: 58533 - RNA, 381 nt, Artificial Sequence
  derived and/or modified sequence opt11 from anti-influenza_Chain
gaaguccaacucguccaauccggcggcgccgucguccaacccggccgaucccuccgccucuccugcgccgccuccggcuucaccuucuccaucuacgccaugcacuggguacgccaaacccccggcaaaggccucgaaugggucgcccucaucucauacgacggcaacaacaaauacuacgccgacuccgucaaaggccgcuucaccaucucccgcgacaacuacaaaaacacccucuaccuccaaaugaaaggccuccgcgccgaagacaccgcccucuacuacugcgcccgccgcaucaccgaaaaaggauacuacaacgacuccggccgccccaacugguucgaccccuggggccaaggcacccucgucaccguaucc

SEQ ID NO: 58534 - RNA, 381 nt, Artificial Sequence
  derived and/or modified sequence opt11 from anti-influenza_Chain
cagguccagcuccagcaaucgggcccgcgcuuggucaagcccucacaaacgcucucgcucacgugcgcgaucucgggcgauagcgugagcggggacucgggcacguggaauuggauacgccagagcccgagcaggggcuuggaauggcucgggcgcacguacuaucgcucgaaaugguacaaugacuaugccgagagcgugaaaucgcgaauagucauaaaagcggacacgagcaagaacgaguucucgcuccagcucaauagcgugaccccggaagauaccgcgaucuauuacugugccagggccggggucaagaucuuuggcuugaucgugggcgcgcucgauaacuggggcaggggcacgcucgugaccgugagcuca

SEQ ID NO: 58535 - RNA, 381 nt, Artificial Sequence
  derived and/or modified sequence opt11 from anti-influenza_Chain
caaguccaacuccaacaauggggcgccggccuccucaaacccuccgaaacccucucacucaccugcaccgucuccggcggcucccucaccgacuacuccuggaacuggauccgacaaccccccggcaaaggccucgaauggaucggcgacacccuccacaacggcuacaccaacuacaaccccucccuccgcggccgcgucuccaucuccaucgacaccuccaaaaaccaagucucccuacgccucaccuccgucaccgccgccgacaccgcccucuacuacugcgcccgcggcuccggcggcuacggaggcuucgacuacuucggcaaacuccgcaccugggacuucuggggccaaggcacccucgucacagucuccucc

SEQ ID NO: 58536 - RNA, 381 nt, Artificial Sequence
  derived and/or modified sequence opt11 from anti-influenza_Chain
caagugcaauugguccagagcggggccgaggucaggaaaccgggcgagagcuugcgcauaagcugucgcgggagcggguacaauuucccgaaauauuggauaggcugggucaggcaaaugcccgggaaagggcucgaguggaugggcaugaucuaucccggggacucggacgugcgcuauaacccgagcuuucaagggcaagugaccauaagcgcagacgagagcauaaacacggccuaucuacaguggucgagcuugcgcacgagcgauaccgcgcgcuauuacugugccaggcacuugggccagcaauuggucucgaacacguacuauuacuauggcauggacgugugggggcaagggaccacggucacggucucaagc

SEQ ID NO: 58537 - RNA, 384 nt, Artificial Sequence
  derived and/or modified sequence opt11 from anti-influenza_Chain
caaauccaacuccaagaauccggccccggccucgucaaacccucccaaacccucucccuaaccugcgccaucuccggcgacuccguauccuccaacaacgccgucuggaacuggauccgacaaucccccucccgcggacucgaauggcucggccgcaccuacuaccgcuccaaaugguacaacgacuacgccgaauccgucaaaucccgcaucaccgucaaccccgacaccuccaaaaaccaauucucccuccaccucaaauccgucacccccgaagacaccgccgucuucuacugcguccgcuccggccacaucaccgucuucggcgucaacgucgacgccuucgacauguggggccaaggcaccauggucaccgucucaucc

SEQ ID NO: 58538 - RNA, 384 nt, Artificial Sequence
  derived and/or modified sequence opt11 from anti-influenza_Chain
caaguccaacuccaagaaucaggccccggccucgucaaacccucccaaacccucucccucacaugcgccaucuccggcgacuccgucuccuccaacaacgccgucuggaacuggauccgccaaucccccucccgcggccucgaauggcucggccgcaccuacuaccgcuccaaaugguacaacgacuacgccgaauccgucaaaucccgcaucaccgucaaccccgacaccuccaaaaaccaauucucccuccaccucaaauccgucacccccgaagacaccgccgucuucuacugcguccgcuccggccacaucaccgucuucggcgucaacgucgacgccuucgacauguggggccaaggcaccauggucaccgucuccucc

SEQ ID NO: 58539 - RNA, 384 nt, Artificial Sequence
  derived and/or modified sequence opt11 from anti-influenza_Chain
caaguccaacuccaacaauccggccccggccucgucaaacccucccaaacccucucccucaccugcgccaucuccggcgaccgcgucuccuccaacuccgccgucuggaacuggauccgccaaucccccucccgcggccucgaauggcucggccgcaccuacuaccgauccaaaugguacuacgacuacgccgaauccgucaaaucccgcaucgucaucgaccccgacaccuccaaaaaccaagucucccuccaacucaacuccgucacccccgaagacuccgccaucuacuacugcgcccgcggcggccacaucaccgucuucggccucaacaucgacgccuacgacaucuggggacaaggcgccaaagucaccguauccucc

SEQ ID NO: 58540 - RNA, 384 nt, Artificial Sequence
  derived and/or modified sequence opt11 from anti-influenza_Chain
caaguccaacuccaacaaucuggacccggccucguaaaacccucccaaacccucucccuaaccugcgccauauccggcgaccgcgucucauccaacuccgccgucuggaacuggauccgccaaucccccucccgcggccucgaauggcucggccgcaccuacuaccgcuccaaaugguacuacgacuacgccgaaucagucaaaucccgaaucgucaucgaccccgacaccuccaaaaaccaagucucccuccaacucaacuccgucacccccgaagacuccgccaucuacuacugcgcccgcggcggccacaucaccgucuucggccucaacaucgacgccuacgacaucuggggccaaggcgccauggucacagucuccucc

SEQ ID NO: 58541 - RNA, 384 nt, Artificial Sequence
  derived and/or modified sequence opt11 from anti-influenza_Chain
caaguccaacuccaacaauccggccccggccucgucaaacccucccaaacccucucccucacaugcgccaucuccggcgaccgcgucuccuccaacuccgccgucuggaacuggauccgccaaucccccucccgcggccuagaauggcucggccgcaccuacuaccgcuccaaaugguacuacgauuacgccgaauccgucaaaucccgcaucgucaucgaccccgacaccucaaaaaaccaagucucccuccaacucaacuccgucacccccgaagacuccgccaucuacuacugcgcccgcggcggccacaucaccgaauucggccucaacaucgacgccuacgacaucuggggccaaggcgccauggucaccgucuccucc

SEQ ID NO: 58542 - RNA, 384 nt, Artificial Sequence
  derived and/or modified sequence opt11 from anti-influenza_Chain
caaguccaacuccaacaauccggccccggccucguaaaaccaucccaaacccucucacuaaccugcgucaucuccggcgacaccgucuccuccaaccgcgccaccuggaacuggaugcgccaaucaccccuccgcggccucgaauggcucggccgcaccuacuaccgcuccaaaugguacaacgacuacgccgucuccgucaaauccagagucgucaucaaccccgacaccuccaaaaaccaagucucccuccaacucaacaccgucacccccgacgacuccggcgucuacuucugcgcccgcggcggccacaucaccgucuucggcgucaacaucgacgccuucgacaucuggggccucggcaccaaagucaccgucuccucc

SEQ ID NO: 58543 - RNA, 384 nt, Artificial Sequence
  derived and/or modified sequence opt11 from anti-influenza_Chain
caagucgaacuccaacaauccggccccggccucgucaaacccucccaaacccucucccucaccugcgccaucuccggcgacucagucucauccaacuccgccaccuggaacuggauccgccaaucccccucccgcggccucgaauggcucggccgcaccuacuaccgcuccaaaugguacaacgacuacgccgacuuccucaaacgccgaaucaccaucaaccccgacaccuccaacaacgaagucucccuccgccucaccuccgucacccccgacgacaccgcccucuacuacugcgcccgcggcggccacaucaccgucuucggcgucaacaucgacgcauucgacgucuggggccaaggcaccauggccaccgucuccucc

SEQ ID NO: 58544 - RNA, 384 nt, Artificial Sequence
  derived and/or modified sequence opt11 from anti-influenza_Chain
caaguccaacuccaacaauccggccccggccuagucaaacccucccaaacccuaucccucacaugcgccaucuccggcgacuccgucuccuccaacuccgccaccuggaacuggauccgccaaucccccucccgcggccucgaauggcucggccgcaccuacuaccgauccaaaugguacaacgacuacgccgacuuccucaaacgccgcaucaccaucaaccccgacaccuccaacaacgaagucucccuccgccucaccuccgucacccccgacgacaccgcccucuacuacugcgcccgaggcggccacaucaccgucuucggcgucaacaucgacgccuucgacgucuggggccaaggcaccauggucaccgucuccucc

SEQ ID NO: 58545 - RNA, 384 nt, Artificial Sequence
  derived and/or modified sequence opt11 from anti-influenza_Chain
caaguccaacuccaacaauccggccccggccucgucaaacccucccaaacccucucacucaccugcgccaucuccggcgacuccgucuccuccuacaacgccgucuggaacuggauccgccaaucccccucccgcggccucgaauggcucggccgcaccuacuaccgcuccggcugguacaacgacuacgccgaauccgucaaaucccgcaucaccaucaaccccgacaccucaaaaaaccaauucucccuccaacucaacucagucacccccgaagacaccgccgucuacuacugcgcccgcuccggccacaucaccgucuucggcgucaacgucgacgccuucgacauguggggccaaggcaccauggucaccgucuccucc

SEQ ID NO: 58546 - RNA, 384 nt, Artificial Sequence
  derived and/or modified sequence opt11 from anti-influenza_Chain
caaguccaacuccaacaauccggccccggccucgucaaacccucccaaacccucucccuaaccugcgccaucuccggcgacuccgucuccuccaacaacgccgucuggaacuggauccgccaaucccccucccgaggccucgaauggcucggccgcaccuacuaccgcuccaaaugguacaacgacuacgccgaauccgucaaaucccgaaucacaaucaaccccgacaccuccaaaaaccaauucucccuccaacucaacuccgucacccccgaagacaccgccgucuacuacugcgcccgcuccggccacaucaccgucuucggcgucaacgucgacgccuucgacauguggggccaaggcaccaccgucaccgucuccucc

SEQ ID NO: 58547 - RNA, 384 nt, Artificial Sequence
  derived and/or modified sequence opt11 from anti-influenza_Chain
aggggccagcucgugcaaucgggcgggggcgugguccagcccgggcgcucgcucaggcucucgugcgcggccucgggcuuugucuuuaacguguucgggauccauugggugcgccaggccccgggcaagggcuuggaauggcucgcgaccauaagcuaugacgggcucaauaaauauuacgcggacucggucaagggcaggaucacgaucucgcgcgauaacucgaaaaauacccuguaccugcaaaugaacucgcucagggccgaggacacggccguguacuauugcgugcgcgauagcgaggaaucgaccuauuacggggacuauaugugggucuauaacugguucgaucuauggggccagggcacgcucgugaccgugagc

SEQ ID NO: 58548 - RNA, 384 nt, Artificial Sequence
  derived and/or modified sequence opt11 from anti-influenza_Chain
caaguccaacuccaacaauggggcuccggccuccucaaacccuccgaaacccuaucccucaccugcgccgucuacggcggcuccuuccgcgacgacuacuggaccuggauccgccaaccccccggcaaaggccucgaauggaucggcgaaaucaaccacuccggccgcaccaacuacaaccccucccucaaaucccgcgucaccaucuccgucgacaccucccucaaacaauucucccucaaagucaucuccgucaccgccgccgacaccgccgucuacuacugcgcccgcggcaccucccacgucucccgcuacuucgacuggcucccccccaccaacugguucgaccccuggggccaaggcacccaagucaccgucuccucc

SEQ ID NO: 58549 - RNA, 384 nt, Artificial Sequence
  derived and/or modified sequence opt11 from anti-influenza_Chain
caaguccaacuccaacaauggggcgccggccuccucaaacccuccgaaacccucucccucuccugcgccgucuucggcggcuccuucuccgacuacuacuggaccuggauccgccaaccccccggcaaaggccucgaauggaucggcgaaaucaaacacucaggccgcaccaacuacaaccccucccucgaaucccgagucaccaucuccgucgacaccuccaaaaaccaauucucccucaaacucuccuccgucaccgccgccgacaccgccaucuacuacugcgcccgcggcaccgaccccgacaccgagggcuacugccgcuccggauccugcuccgccuucgacuucuggggccaaggcacccucgucaccgucuccucc

SEQ ID NO: 58550 - RNA, 384 nt, Artificial Sequence
  derived and/or modified sequence opt11 from anti-influenza_Chain
caagugcaacugcaacaguggggcgccgggcucuugaaaccgagcgagaccuugagcuugaccugugggguguacgggggcucacucucggacuauuacuggagcuggaucaggcaaccgcccgggaaagggcuagaguggauaggcgagaucaaucacucgggcgggaccaauuacaaucccucgcucaagcgcagggucacgaucucggucgauaccucgaaaaagcaauuuagccugaaaaugaacucggucacggccgcggacacggccguguacuauugcgcgcgcgggaccgaucccgauaccgaggucuauugcagggccgggaacugugccgcguucgauuucuggggccagggcacgcuagugaccgugagcucg

SEQ ID NO: 58551 - RNA, 384 nt, Artificial Sequence
  derived and/or modified sequence opt11 from anti-influenza_Chain
cagguacagcuccaggaaucgggcccgggccuggucaagcccucgcaaacgcucucgcucacgugcacagucucgggcgauagcauaagcucggucgaucacuacuggucauggauacgccagcacccggucaagggcuuggaauggaucggguucauguacuacagcgcgagcacguacuauaacccgagccugaaaucgcgcgugaccauaagcacggacacgagcaagaaccaguucucgcucaggcucucgagcgugaccgcggccgacaccgcggucuacuacugugccaggggcacaugcgcgggcgauugcucgcuccauuacuauuacuacggccuggacgugugggggcaagggcgcacggucacggucucgagc

SEQ ID NO: 58552 - RNA, 384 nt, Artificial Sequence
  derived and/or modified sequence opt11 from anti-influenza_Chain
gaggucgcgcucguggaaucaggcgcggaagugaaaaagccagggagcucggucaaggucucgugcaaggccucgggccauaucuuuagcggguacgcgaucucgugggugcgccaggccccgggccagggccuggaauggaugggcgggauaaucccgaucuuuggcacgaccaauuacgcgcaaaaguuccagggcagggucacgaucacggccgaucaaucgacaucgaccgcguacauggacuugagcaaucucaggagcgaggacacggccguguacuauugcgcgcgcgugaaagauggcuauugcacacuaacgagcugucccgugggaugguacuuugacuugugggggcgcgggacauuggucacggucucgagc

SEQ ID NO: 58553 - RNA, 384 nt, Artificial Sequence
  derived and/or modified sequence opt11 from anti-influenza_Chain
gagguccagcucguggaaucgggcgcagaagugaaaaagcccgggagcucggucaaggucucgugcaaggccucgggccauauauuuagcggguacgcgaucucgugggugcgccaggcaccaggccagggcuuggaauggaugggcgggauaaucccgaucuuuggcacgaccaauuacgcgcaaaaguuccagggcagggucacgaucacggccgaucaaucgaccucgaccgcguacauggacuugagcaaucucaggagcgaggacacggccguguacuauugcgcgcgagugaaagauggcuauugcacgcucacgagcugucccgugggcugguacuuugacuugugggggcgcgggaccuuggucacggucucgagc

SEQ ID NO: 58554 - RNA, 384 nt, Artificial Sequence
  derived and/or modified sequence opt11 from anti-influenza_Chain
caagugcaauugguccagagcggggccgaggucaggaaaccgggcgcgagcgugaaagugagcuguaaagcgagcggguacacguucacgcgccauggcauaagcugggucaggcaagcgcccgggcaagggcuagaguggaugggcuggaucucggccuauaccggggacacggacuaugcccagaaauuucaagggcgagugaccaugaccacggacacgagcacgaacacggccuauauggagcucaggagccugcgcucggacgaugccgcggucuauuacugugccaggcucaggcuccagggcgaggucguggucccgcccucgcaaucgaacugguucgaucccuggggccagggcacgcuagugaccgugagcucg

SEQ ID NO: 58555 - RNA, 384 nt, Artificial Sequence
  derived and/or modified sequence opt11 from anti-influenza_Chain
caaguccaacucgucgaauccggccccggccucaugaaacccuccgaaacccuaucccucaccugcaccgucuccggcggcuccgucuccaacuacuacugguccuggauccgccaaccccccggcaaaggccucgaauggaucggcuacgucuucuacuccggcucauccaacuacaaccccucccucaacaaccccucccucaaaucccgcgucaccaucuccaucgacacauccaacaaccaauucucccucaaacucuccuccgucaccgccgccgacaccgccgucuacuacugcgcccgcggccgcgucaacuccggcuacgacuggggccccaacuucgacuccuggggccaaggcgcccucgucaccgucuccucc

SEQ ID NO: 58556 - RNA, 384 nt, Artificial Sequence
  derived and/or modified sequence opt11 from anti-influenza_Chain
caagugcaauugguccagagcggggccgaggucaagaaaccgggcucgagcgugaaagugagcuguaaagcgagcgggggcacguucucguacuaugccauaagcugggucaggcaagcgcccgggcaagggcucgaguggaugggcgggaucauacccauagucgggaccgcgcacuauacccagaaauuccaagggcgcgugaccauaacagcggacgagagcacgagcacggccuauauggagcucucgagcuugcgcucggaagauaccgcggucuauuucugugccagggccgcggacgagagcguggaaucgcucacgaucaaggccuuucgcacgaacuaucacuggggccagggcacgcucgugaccgugagcucg

SEQ ID NO: 58557 - RNA, 387 nt, Artificial Sequence
  derived and/or modified sequence opt11 from anti-influenza_Chain
gaaguccaacucgucgaauccggcggcggcgccguccaacccggcgaaucccucaaacuccccugcgccgccuccggcuucaccuucuccaacuacggcaugcacuggguccgccaagcccccggcaaaggccuagaaugggucgccgucaucuccuacgacggcuccaacaaauacuacgccgacuccgucaaaggccgcuucaccaucucccgcgacaacuccaaagacacccucuaccuccaaaugaacucccuccgcgccgaagacaccgcccucuucuacugcgccaaagaacgcccccuccgccuccuccgcuacuucgacuggcucuccggcggcgccaacgacuacuggggccaaggcacccucgucaccgucuccucc

SEQ ID NO: 58558 - RNA, 387 nt, Artificial Sequence
  derived and/or modified sequence opt11 from anti-influenza_Chain
gaagugcaauuggucgagagcgggggcggggccgugcaaccgggcgagagcuugaaauugagcugugccgcgagcggguucacguucucgaacuauggcaugcacugggucaggcaagcgcccgggaaagggcucgaguggguggccgugaucucguacgauggcucgaacaaguacuaugccgauagcgugaaagggcgauuuaccauaagcagggacaauagcaaggacacgcucuaucuccagaugaauagcuugcgcgcggaagauaccgcgcucuuuuacugugccaaggaaaggcccuugcgacugcucagguacuuugacuggcucucgggcggggccaaugacuauugggggcaagggaccuuggucacggucucgagc

SEQ ID NO: 58559 - RNA, 387 nt, Artificial Sequence
  derived and/or modified sequence opt11 from anti-influenza_Chain
caaguccaacucgucgaauccggcggcggcgucguccaacccggccgcucccuccgccucuccugcgccgucuccggcuucaccuucuccuccuacgccaugcacuggguccgccaagcccccggcaaaggccucgaaugggucgccgucaucuccuacgacggcuccaaccaauacuacgccgacuccgucaaaggccgcuucaccaucucccgcgacaacuccaaaaacacccucuaccuccaaaugaacucacuccgcgccgaagacaccgcccucuacuacugcgccaaagacccccgccuccgccaccuccucuacuuccccuucaccuccaugaucuacuucgacuacuggggccaaggcacccucgucaccgucuccucc

SEQ ID NO: 58560 - RNA, 387 nt, Artificial Sequence
  derived and/or modified sequence opt11 from anti-influenza_Chain
caaguccaacucguccaauccggcggcggcgucguccaacccggccgcucccuacgccucuccugcguagccuccggcuucaccuucuccaccuacgccaugcacuggguccgccaagcccccggccgcggccucgaaugggucgccgucaucuccuacgacgccaacuacaaauacuacgccgacuccgucaaaggccgcuucuccaucucccgcgacaacucccaaaacacccuccaccucgaaaugaacacccuccgcaccgaagacacagcccucuacuacugcgccaaagacucccaacuccgcucccuccucuacuucgaauggcucucccaaggcuacuucgaacccuggggccaaggcacccucgucaccgucaccucc

SEQ ID NO: 58561 - RNA, 387 nt, Artificial Sequence
  derived and/or modified sequence opt11 from anti-influenza_Chain
caaguccaacucguccaauccggcggcggcgucguccaacccggccgcucccuccgccucuccugcgucgccuccggcuucaccuucuccaccuacgccaugcacuggguccgccaagcccccggccgcggccucgaaugggucgccgucaucuccuacgacggcaacuacaaauacuacgccgacuccgucaaaggccgcuucuccaucucccgcgacaacuccaacuccacccuccaccucgaaaugaacacccuccgcaccgaagacaccgcccucuacuacugcgccaaagacucccaacuccgcucccuccucuacuucgaauggcucucccaaggcuacuucgaccccuggggccaaggcacccucgucaccgucaccucc

SEQ ID NO: 58562 - RNA, 387 nt, Artificial Sequence
  derived and/or modified sequence opt11 from anti-influenza_Chain
caaguccaacucguccaauccggcgccgaagucaaaaaacccggcuccucagucaccgucuccugcaaagccuccggcggcaccuucucaaacuacggcaucuccuggguccgccaagcccccggccaaggccucgacuggaugggcggcaucaucccccucuucggaaccgccaacuacgcccaaaaauuccaaggccgcgucaccaucaccgccgacgaaucaaccuccuccuccaacauggaacucuccucccuccgcuccgaagacaccgccgucuacuacugcgcccgcgacguccacaacuacgacuuccucaccggcuacccccuccaccucuacggcauggacgucuggggccaaggaaccacagucaccgucuccucc

SEQ ID NO: 58563 - RNA, 387 nt, Artificial Sequence
  derived and/or modified sequence opt11 from anti-influenza_Chain
caaguccaacuccaagaauccggccccggccucgucaaacccuccgaaacccucucacucaucugcgccgucuccggcgccuccaucucauccuccuacugguccuggauccgccaacccccaggcaaaggccucgaauggaucggcuacaucuacuacuccggcgucaccaaauacaaccccucccuaaaaucccgcgucacccucuccgucgacaccuccaaaaaccacuucucccucaaacucuccuacgucaccgccgccgacaccgccgucuacuacugcgcccgcaaccuccccgacaucgccgucgucaccgccguccaagacgccacccccgucugguucgaccccuggggccccggcacccucguauccgucuccucc

SEQ ID NO: 58564 - RNA, 387 nt, Artificial Sequence
  derived and/or modified sequence opt11 from anti-influenza_Chain
gagguccagcucguggaaucgggcgggggcuugguccagcccgggcgcucgcucaggcucucgugcgcggccucgggcuuuaccuuuagcgauuucuggaugucgugggugcgccaggccccgggcaagggcuuggaaugggucgcgaacauagaccaggacgggaacgagcgcuuuuacgcggacucggucaagggcagguucacgaucucgcgcgauaacgcgaaaaauagcuuguacuugcaaaugaccucgcucagagccgaugacacggccguguacuauugcgcgcgcgauggcagggaaggguacuuuuacgggagcgggagcuuuuacaaucucaagggcuugaacuggggacagggcacgcucuugaccgugagcucg

SEQ ID NO: 58565 - RNA, 387 nt, Artificial Sequence
  derived and/or modified sequence opt11 from anti-influenza_Chain
gagguacugaugguggagagcggggggggguuggugcagccgggggggagugugagguugaguuguguggcgagcggguuuaguuuuagcagccauuggaugacgugggugaggcaggcgccggggaagggguuggaguggguggcgaauauagaggaugaugggggggauaaguauuauguggauagcgugaaggggagguuuauaauaaguagggauaaugcgaagaauaguguguauuugcagaugaauaguuugagagcggaggauacggcgguguauuuuugugcgagggggagugggaguagcgauaggagugauuaugauccgcauuauuauuauuauuuggacgugugggggaagggggcgacggugacggugaguagu

SEQ ID NO: 58566 - RNA, 387 nt, Artificial Sequence
  derived and/or modified sequence opt11 from anti-influenza_Chain
gaagugcaacuggucgagagcgggggcgaucuagugcaaccgggaaggagcuugaaauugagcuguaccgggagcggguucacguucggggacuauggcgugaccugggucaggcaagcgcccgggaaagggcucgagugggugggcuuuaucaggaccaggccauggggcgggacagcggacacggcagcgagcgugaaagggcgcuuuaccauaagcagggacgauagcaagagcuuggccuaucuccagaugaauagcuugaaaacggaagauaccgcggucuauuacuguugcagggacgcgccaccgaacguggaaguggccucgaugacgaacugguacuuugacuugugggggcgagggacauuggucacggucucgagc

SEQ ID NO: 58567 - RNA, 387 nt, Artificial Sequence
  derived and/or modified sequence opt11 from anti-influenza_Chain
gaagugcaauugguccagagcgggagcgaggucaagaaaccgggcgagagccugaaaauaagcuguaaagggagcggguacucguucucgaacuauuggauaggcugggucaggcacaugccagggaaagggcucgaguggaugggcauaaucuaucccggggacucggacacgcgcuauagcccgagcuuucaagggcaagugaccaugagcgcggacaagagcucgagcacggucuaucuccaguggucgagcuugaaagcgagcgauaccgcgauauauuacugugccagacgcgggggccauagcuuuggcuauggcucgggcggggacacacacucggaauuugacucgugggggcaagggaccuuggucacggucucgagc

SEQ ID NO: 58568 - RNA, 387 nt, Artificial Sequence
  derived and/or modified sequence opt11 from anti-influenza_Chain
caaguccaacuccucgaaaccggcggcggccucgucaaacccggccaaucccucaaacucuccugcgccgccuccggcuucaccuucaccuccuacgccaugcacuggguccgccaaccccccggcaaaggccucgaaugggucgccgucgucucauacgacggcaacuacaaauacuacgccgacuccguccaaggccgcuucaccaucucccgcgacaacuccaaaaacacccucuaccuacaaaugaacucccuccgcgccgaagacaccgccgucuacuacugcgccaaagacucccgccuccgcucccuccucuacuucgaauggcucucacaaggcuacuucaaccccuggggccaaggcaccacccucaccgucucaucc

SEQ ID NO: 58569 - RNA, 387 nt, Artificial Sequence
  derived and/or modified sequence opt11 from anti-influenza_Chain
caaguacaacuagucgaauccggcgccgaagucaaaaaacccggcgccucagucaaacucuccugcaccgccucaggauacaacuucgccgccuacuacauccacuggguccgccaagcacccggacaaggccucgaauggaugggcugguccaaccccaacaccggcggcgccaacuacgcccaggacuuccaaggccgcgucaccaugaccgccgucaccagcacaagcaccgccuacauggaacuaucccgccucaccuccgacgacaccgcccucuacuucugcgcccgcgucccccgcgaccgccuccucacacucuacuacgaaagcucaaccuacggauucgacuacuggggacaaggaacccucgucaccgucuccagc

SEQ ID NO: 58570 - RNA, 387 nt, Artificial Sequence
  derived and/or modified sequence opt11 from anti-influenza_Chain
caagugcaauuggucgagagcgggggcgggcucgugcaaccgggagggagcuugcgcuugagcuguaccgugagcggguucacguucaauagcuaugcaaugaacugggucaggcaagcgcccggaaaagggcuagagugggugagcgggaucaggggaucgggcgagaacacguacuaugccgagaccgugaaagggcgcuuuaccauaagcagggacaauagcaagaacacgcucuaucucgagaugaauagcuugcgcgcggaagauaccgcggucuauuacugugccaggaaauggggcagaaugacggucuuuggcguggccacggaccagcucuauuacuuugacuauugggggcaagggacauuggucacggucucgagc

SEQ ID NO: 58571 - RNA, 387 nt, Artificial Sequence
  derived and/or modified sequence opt11 from anti-influenza_Chain
caaguccaacucgucgaauccggccccggccucgucaaacccucccaaacccucucccuaaccugcaccgucuccggcggcuccaucuccaacggcggcuaccacugguccuggauacgccaacaccccggcaaaggccucgaauggaucggcaacaucuacuaccgcggcuccaccuucuacgaccccucccucaaaucccgcguaaccaucuccguagacaccuccaaaucccaauucucccucaaacucaccuccgucaccgccgccgacaccgccgucuacuacugcgcccgcaugccccucgccaacuacgaccuccucaccggccucuacaucggcgccuucgaccucuggggccaaggcaccauggucaccgucuccucc

SEQ ID NO: 58572 - RNA, 387 nt, Artificial Sequence
  derived and/or modified sequence opt11 from anti-influenza_Chain
caagugcaauuggucgagagcggggccgaggucaagaaaccgggcgcgagcgugcgcgugagcuguaaagggagcggguacacguucacggccuaucacaugcacugggucaggcaagcgcccgggcaaggguucgagugggugggcuggaucaaucccaauagcggggccacguacuauaccucgaccuuugaaggacgcgugaccaugaccagggacacgagcauaaccacggccuauauggagcucucgagccugcgcucggacgauaccgcggucuauuacugugccacggacauagucguggaaagagacgcgagcuugggcggguucaauagcuauggcauggacgugugggggcaagggaccacgguaacggucucgagc

SEQ ID NO: 58573 - RNA, 390 nt, Artificial Sequence
  derived and/or modified sequence opt11 from anti-influenza_Chain
caaguccaacuccaacaauggggcgccggccuccucaaacccuccgaaacccucucacucaccugcgccgucuacggaggcuccuucuccgucuccggcuacuacugguccuggauccgccaaccccccggccgcggccucgaauggaucggcgaaaucucccacggcggcuccaccaacuacaaccccucccucaaaucccgagucacaaucuccgucgacaccaccaaaaaccaauucucccuacgccucuccuccgucaccgccgccgacaccgccgucuacuacugcgcccgcggcaccgaccccgacaccgaagucuacugccgcgucggcaacugcgccgccuucgacuacuggggccaaggcucccucgucaccgucuccucc

SEQ ID NO: 58574 - RNA, 390 nt, Artificial Sequence
  derived and/or modified sequence opt11 from anti-influenza_Chain
caaguccaacuccucgaauccggccccggccucgucaaacccucccaaacccuccuccucaccugcaccgucuccggcgccuccaucuccaccggcggcaacuacugguccuggauccgccaacaccccggcaaagaccucgaauggaucggcuacaucuucuacucaggcaccaccaaauacaaccccuccgucgacaaccccucccucaaaucccgagucaccauguccgucgacaccuccgaaaaccaauucucccucaaacucuccuccgucaccgccgccgacaccgccgucuacuucugcgcccgcggcucccccaacuccggcuacgacuggggcccccacuucgacuacuggggccaaggcacccucgucaccgucuccucc

SEQ ID NO: 58575 - RNA, 390 nt, Artificial Sequence
  derived and/or modified sequence opt11 from anti-influenza_Chain
gaagugcaauuggucgagagcgggggccaucucgugcaaccgggcaggagccugcgcuugagcugugccgcgagcggguucacguucgaggacuaugcaaugaacugggucaggcaagcgcccgggaaagggcuagagugggugagcgugaucucgugggauagcgggcgcauaggcuaugccgauagcgugaaagggcgcuuuaccauaagcagggacaaugcaaagaacucgagcuaucuccagaugaauagcuugcgcccggaagauaccgcgcucuauuacugugucagggacaugcucgcguacuauagcgauaacucgggcaagaaauauaacguguacgggauggaugucuggggacagggcacgaccgugaccgugagcucg

SEQ ID NO: 58576 - RNA, 390 nt, Artificial Sequence
  derived and/or modified sequence opt11 from anti-influenza_Chain
gaagugcaauuggucgagagcgggggcgggcucgugcaaccgggcaggagcuugcgcuugagcugugccgugagcggguucauauucgaggacuaugccauaaacugggucaggcaagcgcccgggaaagggcucgagugggugagcauaaucucgugggauagcgggcgcauaggcuaugccgauagcgugcgcgggcgauuuaccauaagcagggacaaugccaagaacucgagcuuucuccagaugaauagcuugcgcccggaagauaccgcggucuauuacugugucaaggacaugcucgcguacuauuacgauggcucgggcauacgauauaacuuguacgggauggaugucuggggccagggcacgaccgugaccgugagcucg

SEQ ID NO: 58577 - RNA, 390 nt, Artificial Sequence
  derived and/or modified sequence opt11 from anti-influenza_Chain
gaagugcaauuggucgagagcgggggcgggcucgugcaaccgggcaggagccugcgauugagcugugccgugagcggguucauauucgaggacuaugccauaaacugggucaggcaagcgcccgggaaaugucucgagugggugagcauaaucucgugggauagcgggcgaauaggcuaugccgauagcgugcgcgggcgcuuuaccauaagcagggacaaugccaagaacucgagcuuucuccagaugaauagcuugcgcccggaagauaccgcggucuauuacugugucaaggacaugcucgcguacuauuacgauggcucgggcauacgcuauaacuuguacgggauggaugucuggggccagggcacgaccgugaccgugagcucg

SEQ ID NO: 58578 - RNA, 396 nt, Artificial Sequence
  derived and/or modified sequence opt11 from anti-influenza_Chain
caaaucacccucaaagaauccggccccacccucgucaaacccacccaaacccucacacucaccugcgucuucuccggcuucucccucuccaucaccggcguccgagucggcuggauccgccaaccccccggcaaagcccucgaauggcuagcccucaucuccugggacgacgaaaaacacuacucccccucccuccaaucccgccucaccaucaccaaagacaccucaaaaaaccaaguaguccucaccaugaccaaccucgaccccgucgacaccgccaccuacuacugcgcccgcucaaccgaccgcggccacguccuccgcuacuucggcuggaugcuccccggcgacgccuucgacgucuggggccaaggcaccauggucaccgucuccuca

SEQ ID NO: 58579 - RNA, 396 nt, Artificial Sequence
  derived and/or modified sequence opt11 from anti-influenza_Chain
caaguccaacuccaagaauccggccccggccucgucaaacccuccgaaacccucucccucaccugcaccgucuccuccggccccauguccgacuacuacugguccuggauccgccaaccccccggcaaaggccucgaauggaucggccacgucuccgucucccacggcggccgcaccaaauccaaccccuccgucaugucccgcgucaccaucucugucgaaacauccaaaaaccaauucucccucaaacucaccuccgucaccgccgcagacaccgccgucuacuacugcgcccgccucaacuacuacgaccgcuccggcuaccacucccccgacggccccucaaacaacugguucgaccccuggggccaaggcacccucgucacagucuccuca

SEQ ID NO: 58580 - RNA, 396 nt, Artificial Sequence
  derived and/or modified sequence opt11 from anti-influenza_Chain
caaguccaacucguccaauccggcgccgaagucaaaaaacccggcgccuccgucaaagucuccugcaaaaccuccggcuacaccuucaccgcauacaccauccacuggguccgccaagcccccggccaacgccucgaauggaugggcuggaucaacgccggcaacggccacaccaaauacucacaacgcuucaaaggccgcgucaccaucacccgcgacaccuccgcccgcaccaccuacauggaacuccgaucacucaccuccgaagacaccgcccucuacuucugcgcccgcggccccgaaaccuacuacuacgacaaaaccaacuggcucaacucacaccccgacgaauacuuccaacacuggggccacggaacacaagucaccgucucaucc

SEQ ID NO: 58581 - RNA, 399 nt, Artificial Sequence
  derived and/or modified sequence opt11 from anti-influenza_Chain
caagugcaauugguccagagcgggagcgagguaaagaaaccgggcgcgagcgugaaagugagcuguaaagcgagcggguacacguucacgaacuaugacauaaacuggaucaggcaagcgcccgggcaagggcucgaguggaugggcuggaucaaucccaauagcgggaccacgggcucggcccagcgcuuucaagggcgcgugaccauaaccguggacacgagcauaaccacggucuauauggagcucucgagcuugcgcucagacgauaccgcgaucuauuacugugccaggggcagggaauugcucaggcuccagcacuuucuaacggacucgcaaucggaaaggcgcgauugcuuugacccgugggggcaagggaccuuggucacggucucgagc

SEQ ID NO: 58582 - RNA, 402 nt, Artificial Sequence
  derived and/or modified sequence opt11 from anti-influenza_Chain
gagguccagcucguggaaucgggcgggggccuggucaagcccgggggaucgcucaggcucucgugcgcggccucgggcuugagcuuucuaaaugccuggaugucgugggugcgccaggccccgggcaagggcuuggaaugggucgggcgaauaaaaucgaacacggacgggggcacgaccgauuacgcggccccggucaagggcagguucacgaucucgcgcgaugacucgaaaaauaccuuauaccugcaaaugagcucgcucaagaccgaggacacggccguguacuauugcacgaccgauggcccguacucagacgauuucaggagcggguacgcggccagguacagguacuuuggcauggacgugugggggcaagggaccacggucacgguaucgagc

SEQ ID NO: 58583 - RNA, 402 nt, Artificial Sequence
  derived and/or modified sequence opt11 from anti-influenza_Chain
gaagugcaauuggucgagagcgggggcgggcuagugaaaccgggagggagcuugcgcuugagcugugccgcgagcggguucucguucuugaacgcguggaugagcuggguaaggcaagcgcccgggaaagggcucgagugggugggaaggaucaagagcaauaccgauggcgggacaacggacuaugccgcgccagugaaagggcgcuuuaccauaagcagggacgauagcaagaacacgcuauaucuccagaugucgagcuugaaaacggaagauaccgcgguauauuacuguaccacggacgggccguauagcgaugacuuucgaucgggcuaugccgcgcgcuaucgcuauuucgggauggauguauggggccagggaacgaccgugaccgugagcucg

SEQ ID NO: 58584 - RNA, 402 nt, Artificial Sequence
  derived and/or modified sequence opt11 from anti-influenza_Chain
gaagugcaauuggucgagagcgggggcgggcucgugaaaccgggcgggagcuugcgcuugagcugugccgcgagcgggcucacguucuugaacgcguggaugagcugggucaggcaagcgccagggaaagggcuagagugggugggcaggaucaagagcaauaccgauggcgggaccacggacuaugccgcgcccgugaaagggcgcuuuaccauaagcagggacgauagcaagaacacgcucuaucuccagaugucgagcuugaaaacggaagauaccgcgguauauuacuguaccacggacgggcccuauagcgaugacuuucgcucgggcuaugccgcgcgcuauagauauuucgggauggaugucuggggccagggcacgaccgugaccgugagcucg

SEQ ID NO: 58585 - RNA, 402 nt, Artificial Sequence
  derived and/or modified sequence opt11 from anti-influenza_Chain
gaagugcaauuggucgagagcgggggcgggcuagugaaaccgggcgggagcuugcgacugagcugugccgcgagcggguucucguucucgaacgcguggaugagcugggucaggcaagcgcccgggaaagggcucgagugggugggcaggaucaagagcaauaccgauggcgggaccacggacuaugccgcgcccgugaaagggcgcuuuaccauaagcagggacgauagcaagaacacgcucuaucuccagaugucgagcuugaaaacggaagauaccgcggucuauuacuguaccacggacgggcccuauagcgaugacuuucgaucaggcuaugccgcgcgauaucgcuauuucggaauggaugucuggggccagggaacgacagugaccgugagcucg

SEQ ID NO: 58586 - RNA, 402 nt, Artificial Sequence
  derived and/or modified sequence opt11 from anti-influenza_Chain
gaagugcaauuggucgagagcgggggcgggcucgugaaaccgggcgggagcuugcgcuugagcugugccgcgagcgggcucacguucucgaacgcguggaugagcugggucaggcaagcgcccgggaaagggcucgagugggugggcaggaucaagagcaauaccgauggcgggaccacggacuaugccgcgcccgugaaagggcgcuuuaccauaagcagagacgauagcaagaacacgcucuaucuccagaugucgagcuugaaaacggaagauaccgcggucuauuacuguaccacggacgggcccuauagcgaugacuuucgaucgggcuaugccgcgcgcuaucgcuauuucgggauggaugucuggggccagggcacgaccgugaccgugagcucg

SEQ ID NO: 58587 - RNA, 402 nt, Artificial Sequence
  derived and/or modified sequence opt11 from anti-influenza_Chain
gagguacagcucguggaaucgggcgggggcuuggucaagcccgggggcucgcucaggcucucgugcgcggccucgggcuuuaccuuuagcaaugccuggaugucgugggugcgacaggccccgggcaagggauuggaaugggucgggcgcauaaaaucgaacacggacgggggcacgaccgauuacgcggccccggucaagggcagguucacgaucucgcgcgaugacucgaaaaauacccuguaccugcaaaugagcucgcucaagaccgaggacacggccguguacuauugcacgacagauggcccguacucggacgauuucaggagcggguacgcggccagguacagguacuuuggcauggacgugugggggcaagggaccacggucacggucucaagc

SEQ ID NO: 58588 - RNA, 402 nt, Artificial Sequence
  derived and/or modified sequence opt11 from anti-influenza_Chain
gaagugcaauuggucgugagcgggggcgggcucgugaaaccgggcgggagcuugcgauugagcugugccgcgagcgggcucucguucuugaacgcguggaugagcuggguaaggcaagcgcccgggaaagggcucgagugggugggcaggaucaagagcaauacagauggcgggaccacggacuaugccgcgcccgugaaagggcgcuuuagcauaagcagggacgauagcaagaacaugcucuuucuccauaugucgagcuugcgcacggaagauaccgcgguauauuacugugccacggacgggcccuauagcgaugacuuucgcucgggcuaugccgcgcgcuaucgcuauuucgggauggaugucuggggccagggcacgaccgugaccgugagcucg

SEQ ID NO: 58589 - RNA, 402 nt, Artificial Sequence
  derived and/or modified sequence opt11 from anti-influenza_Chain
gaagugcaauuggucgugagcgggggcgggcucgugaaaccgggcgggagcuugcgcuugagcugugccgcgagcgggcucucauuccugaacgcguggaugagcugggucaggcaagcgcccgggaaaugucucgagugggugggcaggaucaagagcaauaccgauggcgggaccacggacuaugccgcgcccgugaaagggcgcuuuagcauaagcagggacgauagcaagaacaugcucuuucuccauaugucgagcuugcgcacggaagacaccgcggucuauuacugugccacggacgggcccuauagcgaugacuuucgcucgggcuaugccgcgcgcuaucgcuauuucgggauggaugucuggggccagggcacgaccgugaccgugagcucg

SEQ ID NO: 58590 - RNA, 402 nt, Artificial Sequence
  derived and/or modified sequence opt11 from anti-influenza_Chain
gagguccagcucguggucucgggcgggggcuuggucaagcccgggggcucgcucaggcucucgugcgcggccucgggcuugagcuuucucaaugccuggaugucgugggugcgccaggccccgggcaagggccuggaaugggucgggcgcauaaaaucgaacacggacgggggcacgaccgauuacgcggccccggucaagggcagguucucgaucucgcgcgaugacucgaaaaauauguuguucuugcacaugagcucgcucaggaccgaggacacggccguguacuauugcgcgacagauggcccguacucggacgauuucaggagcggguacgcggccagguacagguacuuuggcauggacgugugggggugcgggaccacggucacggucucgagc

SEQ ID NO: 58591 - RNA, 402 nt, Artificial Sequence
  derived and/or modified sequence opt11 from anti-influenza_Chain
gaagugcaauuggucgagagcgggggcggacucgugaaaccgggcgggagcuugcgcuugagcugugccgcgagcggguucacguucuugaacgcguggaugagcugggucagacaagcgccagggaaagggcucgagugggugggcaggaucaagagcaauaccgauggcgggaccacggacuaugccgcgcccgugaaagggcgauuuaccauaagcagggacgauagcaagaacacgcucuaucuccagaugucgagccugaaaacagaagauaccgcgguauauuacugcaccacggacgggcccuacagcgaugacuuucgaucgggcuaugccgcgcgcuaucgauauuucgggauggaugucuggggccagggcacgaccgugaccgugagcucg

SEQ ID NO: 58592 - RNA, 402 nt, Artificial Sequence
  derived and/or modified sequence opt11 from anti-influenza_Chain
gagguccagcucguggaaucgggcgggggcuuggucaagcccgggggcucgcucaggcucucgugcgcggccucgggcuuuaccuuucucaaugccuggaugucgugggugcgccaggccccgggcaagugcuuggaaugggucgggcgcauaaaaucgaacacggacgggggcacgaccgauuacgcggccccgguaaagggcagguucacgaucucgcgcgaugacucgaaaaauaccuuguacuugcaaaugagcucgcucaagaccgaggacacggccguguacuauugcacgacagauggaccguacucggacgauuucaggagcggguacgcggccagguacagguacuuuggcauggacgugugggggcaagggaccacggucacggucucgagc

SEQ ID NO: 58593 - RNA, 402 nt, Artificial Sequence
  derived and/or modified sequence opt11 from anti-influenza_Chain
gagguccagcucguggaaucgggcgggggcuuggucaagcccgggggcucgcucaggcucucgugcgcggccucgggcuuuaccuuucucaaugccuggaugucgugggugcgccaggccccgggcaagggcuuggaaugggucgggcgaauaaaaucgaacacggacgggggcacgaccgauuacgcggccccggucaagggcagguucacgaucucgcgcgaugacucgaaaaauaccuuguacuugcaaaugagcucgcucaagaccgaggacacggccguguacuauugcacgaccgauggcccguacucggacgauuucaggagcggguacgcggccagauacagguacuuuggcauggacgugugggggugcgggaccacggucacggucucgagc

SEQ ID NO: 58594 - RNA, 414 nt, Artificial Sequence
  derived and/or modified sequence opt11 from anti-influenza_Chain
caagugcaauugcaagagagcgggggcgggcucgugcaaccgggcgagagcuugcgcuugagcugugucgggagcgggagcucguucggggaaucgaccuugagcuauuacgcgguaucgugggugcgccaggccccgggcaagggauuggaauggcucucgaucauaaacgcgggcgggggcgauaucgauuacgcggacucggucgagggcagguucacgaucucgcgcgauaacucgaaagagaccuuguacuugcaaaugaccaaucucagggucgaggacacgggcguguacuauugcgcgaaacacaugucgaugcagcaaguggucucggccgggugggagcgcgcggacuuggucggggacgcguucgaugucuggggacagggcacgauggugaccgugagcucg

SEQ ID NO: 58595 - RNA, 465 nt, Artificial Sequence
  derived and/or modified sequence opt11 from anti-influenza_Chain
cucucacgcaucaaccacuucgaaaaaauccaaaucauccccaaauccuccugguccgaccacgaagccuccuccggcgucuccuccgccugccccuaccaaggcacccccuccuucuuccgcaacgucgucuggcucaucaaaaaaaacaacaccuaccccaccaucaaacgcuccuacaacaacaccaaccaagaagaccuccucauccucuggggcauccaccacuccaacgacgccgccgaacaaaccaaacucuaccaaaaccccaccaccuacaucuccgucggcaccuccacccucaaccaacgccucguccccaaaaucgccacccgcuccaaagucaacggccaaaacggccgcauggacuucuucuggaccauccucaaacccaacgacgccaucaacuucgaauccaacggcaacuucaucgcccccgaauacgccuacaaaaucguaaaaaaa

SEQ ID NO: 58596 - RNA, 564 nt, Artificial Sequence
  derived and/or modified sequence opt11 from anti-influenza_Chain
aacguccccgaaugguccuacaucgucgaaaaagcaaaccccgccaacgaccucugcuaccccggcaacuucaacgacuacgaagaacucaaacaccuccucucccgcauaaaccacuucgaaaaaauccaaauaauccccaaauccuccugguccgaccacgaagccuccuccggcguauccuccgccugccccuaccaaggcacccccuccuucuuccgcaacgucgucuggcucaucaaaaaaaacaacacauaccccacaaucaaacgcuccuacaacaacaccaaccaagaagaccuccucauccucuggggcauccaccacucaaacgacgccgccgaacaaaccaaacucuaccaaaaccccaccaccuacaucucagucggcaccuccacccuaaaccaacgccucguccccaaaaucgccacccgcuccaaagucaacggccaaaacggccgcauggacuucuucuggaccauacucaaacccaacgacgccaucaacuucgaauccaacggcaacuucaucgccccagaauacgccuacaaaauagucaaaaaa

SEQ ID NO: 58597 - RNA, 609 nt, Artificial Sequence
  derived and/or modified sequence opt11 from anti-influenza_Chain
augcuccgcucccuaguccucaacgaaaaacuccgcgcccgcguccuagaacgcgcagaagaauuccuccucaacaacaaagccgacgaagaagucugguuccgcgaacuaguccucugcauccucaccuccaacuccuccuucaucuccgccuacaaaucaaugaacuacauccucgacaaaauccucuacauggacgaaaaagaaaucuccauccuccuccaagaaucaggauaccgcuucuacaaccucaaagccaaauaccucuaccgcgccaaaaaccucuacggcaaagucaaaaaaacaaucaaagaaaucgccgacaaagaccaaaugcaagcccgcgaauucaucgccacccacaucuacggcaucggauacaaagaagccucccacuuccuccgaaacguaggcuaccuagaccucgccaucaucgaccgccacauccuccgcuucaucaacaaccucggcauacccaucaaacuaaaauccaaacgcgaauaucuccucgccgaaucccuccuccgcuccaucgccaacaaccuaaacguccaaguaggccuccucgaccucuucaucuucuucaaacaaaccaacaccaucgucaaa

SEQ ID NO: 58598 - RNA, 615 nt, Artificial Sequence
  derived and/or modified sequence opt11 from anti-influenza_Chain
ggccucuucggggcaauagcgggcuucaucgaaggcggguggacaggcauggucgacggcugguacggguaccaccaccaaaacgagcaaggaagcggguacgcagccgaccucaagagcacgcaaaacgccauagacgagauaacgaacaaggucaacagcgugaucgagaaaaugaacacacaauucaccgcggucgggaaagaguucaaccaccuagaaaagcgcauagaaaaccucaacaaaaagaucgacgacggguuccuggacauauggacguacaaugccgagcuccugguccuacucgagaacgagcgcacgcucgacuaccacgacucgaacgugaaaaaccucuacgaaaaggucaggagccagcucaagaacaacgccaaggaaauaggcaacggcugcuucgaguucuaccacaagugcgacaacacgugcauggaaucggucaagaacgggaccuacgacuaccccaaguacucggaagaggccaagcucaaccgcgaggaaauagacggggucaagcuagagagcacgcgcauauaccagauccuggccaucuacucgaccguggccucgagccugguccuagucguaagccuaggcgcg

SEQ ID NO: 58599 - RNA, 639 nt, Artificial Sequence
  derived and/or modified sequence opt11 from anti-influenza_Chain
gaaaucguccucacccaaucccccggcacccucucccucuccccaggagaacgcgccacccucuccugccgcgccucccaacgcgucucauccuaccuagccugguaccaacaaaaacccggccaagcaccccgccuccucaucuacggcgccuccacccgcgccgccggcauacccgaccgcuucuccggcucaggcuccggcaccgacuucacccucaccauaucccgccuagaacccgaagauucagccguauacuacugccaacaauacggccgcacaccccucaccuucggcggcggcaccaaagucgaaaucaaacgcgccgccgcccccuccguauucaucuucccacccuccgacgaacaacucaaauccggcaccgccuccgucgucugccuacucaacaacuucuacccccgcgaagcaaaaguucaauggaaagucgacaacgcccuacaauccggcaacucccaagaauccgucaccgaacaagacuccaaagacucaaccuacucacucucuucaacccuaacccucuccaaagcagacuacgaaaaacacaaaguauacgccugcgaagucacccaccaaggacucuccucucccgucaccaaauccuuuaaccgcggcgaaugc

SEQ ID NO: 58600 - RNA, 639 nt, Artificial Sequence
  derived and/or modified sequence opt11 from anti-influenza_Chain
gacauacaaaugacccaaucacccuccucccucuccgccucccucggcggaaacgucacaaucacaugcaaagccucccaagacaucaacaaauacaucgccugguaccaacacaaacccggcaaaggcccccgccucgucauccacuacaccuccacccuacaacccggcauacccucccgcuucuccggauccggcuccggcaccgacuacuccuucuccaucuccaaccucgaacccgaagacaucgcaaccuacuacugccuccaauacgacauccuauacaccuucggcggcggcaccaaacucgaaaucaaacgcgccgacgccgcccccaccgucuccaucuucccccccuccucagaacaacucaccuccggcggcgccucagucgucugcuuucucaacaacuucuaccccaaggacaucaacgucaaauggaaaaucgacggcuccgaacgccaaaacggcguacuaaacuccuggaccgaccaagacuccaaagacuccaccuacucaauguccucaacccucacccucaccaaagacgaauacgaacgucacaacuccuacaccugcgaagcaacccacaaaacuuccaccucacccaucgucaaauccuucaaccgaaacgaaugc

SEQ ID NO: 58601 - RNA, 642 nt, Artificial Sequence
  derived and/or modified sequence opt11 from anti-influenza_Chain
gacauccaaaugacccaaucccccuccucccucuccgccuccguaggcgaccgcgucaccaucaccugccgcgccucccaaggcauauccucauaccuagccugguaccaacaaaaacccggcaaaguccccacccuccucaucuacgacgccuccacacuccgcucaggcguccccucacgcuucuccggcuccggcuccgccaccgacuucacccucaccaucuccucccuccaacccgaagacgucgccaccuacuauugccaacgcuacaacucagccccccccaucaccuucggccaaggcacccgccucgaaaucaaacgcgccgccgcccccuccgucuucaucuucccccccuccgacgaacaacuaaaaucaggcacagccucagucgucugccuccucaacaacuucuacccccgagaagcaaaaguccaauggaaagucgacaacgcccuccaaucaggcaacucccaagaauccgucaccgaacaagacuccaaagacuccaccuacucccucuccuccacccucacccuauccaaagccgacuacgaaaaacacaaaguauacgccugcgaagucacccaccaaggccucuccuccccagucacaaaauccuucaaccgcggcgaaugc

SEQ ID NO: 58602 - RNA, 642 nt, Artificial Sequence
  derived and/or modified sequence opt11 from anti-influenza_Chain
gaaaucguccucacccaaucccccggcacacucucacucucccccggcgaacgcgccacccucuccugccgcgccucccaaucagucuccuccuccuaccucgccugguaccaacaaaaacccggccaagcaccccgacuacucaucuacggcgccucaucacgcgccacaggcauccccgaccgauucuccggcuccggcucaggaaccgacuucacccucaccaucucucgccucgaacccgaagacuucgccgucuacuacugccaacaauacggcucaucuccccgcaccuucggaggcgguaccaaagucgaaauaaaacgcgccgccgcccccuccgucuucaucuucccacccuccgacgaacaacucaaauccggcaccgcauccgucgucugccuccuaaacaacuucuacccccgagaagccaaaguccaauggaaagucgacaacgcccuccaauccggcaacucacaagaauccgucaccgaacaagacuccaaagacuccaccuacuccuuauccuccacccucacccucuccaaagccgacuacgaaaaacacaaaguauacgcaugcgaagucacacaccaaggccuuucaucacccgucaccaaauccuucaacagaggcgaaugc

SEQ ID NO: 58603 - RNA, 642 nt, Artificial Sequence
  derived and/or modified sequence opt11 from anti-influenza_Chain
ucauacguccucacccaaccccccuccgucuccgucgcccccggcgaaacagcaaccgucaccugcggcggcaacaacaucggcuccaaaucaguccacugguaccaacaaaaacccggccaagcacccgucgucgucaucuacuacgacggagaccgacccuccggcauccccgaacgcuucuccggaagcaacuccggagacaccgccacacucaccaucucccgcgucgaagccggcgacgaagccgacuacuacugccucgucugggacuacacauccguacacuacgucuucgguaccggcaccaaagucaccguccucggccaacccaaagccaaccccaccgucacccucuucccccccucaucagaagaacuccaagccaacaaagccacacucgucugccucaucuccgacuucuaccccggcgcagucaccgucgccuggaaagcagacggcucacccgucaaagccggcguagaaaccaccaaacccuccaaacaauccaacaacaaauacgccgccuccuccuaccucucacucacccccgaacaauggaaaucccaccgcuccuacuccugccaagucacccacgaaggcucaaccgucgaaaaaacagucgcccccaccgaaugcagc

SEQ ID NO: 58604 - RNA, 642 nt, Artificial Sequence
  derived and/or modified sequence opt11 from anti-influenza_Chain
gacauccaaaugacacaaaccucuuccucccucuccgcaucccucggcgaccgcgucaccaucucaugccgcgcaucccaagacauccgcaacuaccucaacugguaccaacaaaaacccgacggcaccgucaaacuccucaucuacuacaccucccgacuccacucaggcguccccucccgauucuccgacuccggcuccggcaccgacuacucccucaccaucucaaaccucgaacaagaagaccucgccaccuacuucugccaacaaaccuacacacuccccuggaccuucggaggcggcaccaaacucgaaaucaaacgcgccgacgccgcccccaccgucuccaucuucccccccuccuccgaacaacucaccuccggcggcgcaucagucgucugcuuccuuaacaacuucuaccccaaagacaucaacgucaaauggaaaaucgacggauccgaacgccaaaacggcguccucaacucauggaccgaccaagacuccaaagacucaaccuacuccauguccuccacccucacccucaccaaagacgaauacgaacgccacaacuccuacacaugcgaagccacccacaaaaccucaaccucccccauagucaaauccuucaaccgcaacgaaugc

SEQ ID NO: 58605 - RNA, 645 nt, Artificial Sequence
  derived and/or modified sequence opt11 from anti-influenza_Chain
gacggcgucaaaccacucauccuccgcgacugcuccgucgccggcuggcuccucggaaaccccaugugcgacgaauucauaaacguccccgaauggucauacaucgucgaaaaagccaaccccgccaacgaccucugcuaccccggcaacuucaacgacuacgaagaacucaaacaccuccucucccgcaucaaccacuucgaaaaaauccaaaucauccccaaauccuccugguccgaccacgaagccuccucaggcgucucauccgccugccccuaccaaggcacccccucauucuuccgcaacgucgucuggcucaucaaaaaaaacaauaccuaccccaccaucaaacgcuccuacaacaacaccaaccaagaagaccuccuuauccucuggggcauccaccacucuaacgacgccgccgaacaaaccaaacucuaccaaaaccccaccaccuacauauccgucggcacaucaacccucaaccaacgccuaguccccaaaaucgccacccgcuccaaagucaacggccaaaacggacgcauggacuucuucuggaccauccucaaacccaacgacgccaucaacuucgaauccaacggcaacuucauagcccccgaauacgccuacaaaaucgucaaaaaa

SEQ ID NO: 58606 - RNA, 645 nt, Artificial Sequence
  derived and/or modified sequence opt11 from anti-influenza_Chain
gacauccaaaugacacaaucccccuccacccucuccgccuccguaggcgaccgcguaaccauaaccugccgcgccucccaaacuaucaacaacuaccucgccugguaccaacaaaaacccggcaaagcccccaaacuacucaucuacaaagccuccucacucgaauccggcguucccucccgcuucuccggcuccggcuccggcacagaauucacccuaaccaucuccucacuccaacccgacgacuucgccaccuacuacugccaagaauacaacaacgacucaccacucaccuucggcggcggcacaaaagucgaaaucaaacgaaccgucgccgcccccuccgucuucaucuucccaccaucagacgaacaacucaaauccggcaccgccuccgucgucugccuccucaacaacuucuacccccgcgaagccaaaguccaauggaaagucgacaacgcccuccaauccgguaacucccaagaauccgucaccgaacaagacuccaaagacuccaccuacucccucagcuccacacucacccucuccaaagccgacuacgaaaaacacaaaguauacgccugcgaagucacccaccaaggccucuccucgccagucacuaaauccuucaaccgcggcgaaugc

SEQ ID NO: 58607 - RNA, 645 nt, Artificial Sequence
  derived and/or modified sequence opt11 from anti-influenza_Chain
uccguccucacccaaccccccuccgcauccggcucucgcggccaauccaucaccaucuccugcaccggcucuaccucagacauuggcuccuacaacuacgucuccugguaccaacaacaccccggaacagcccccaaagucauccucuacgaaguaucccaacgacccuccggcgucccagaccguuucucaggaucaaaauccggcaacaccgccuuccucaccgucuccggccuccaagccgaagacgaagccgacuacuacugcgccuccuacgccggcaacaacaucuacgucuucggcuccggcaccaaagucaccguccucggccaacccaaagccaaccccaccgucacacuauucccccccuccuccgaagaacuccaagcaaacaaagccacccucgucugccucaucuccgacuucuaccccggcgccgucaccgucgccuggaaagccgacuccucucccguaaaagccggcgucgaaaccacaaccccaucaaaacaaucaaacaacaaauacgccgccuccuccuaccucucccucacacccgaacaauggaaaucccacaaaucauacucaugccaagucacccacgaaggcuccaccgucgaaaaaaccgucgccccaaccgaaugcagc

SEQ ID NO: 58608 - RNA, 645 nt, Artificial Sequence
  derived and/or modified sequence opt11 from anti-influenza_Chain
uccgcacucacacaaccccccuccgccuccggaucccgcggccaauccaucaccaucuccugcaccggcuccaccuccgacauaggcuccuacaacuacgucuccugguaccaacaacaccccggcaccgcccccaaaguaauacucuacgaagucucccaacgacccuccggcguccccgaccgcuucuccggcuccaaauccggaaacaccgccuuccucaccguauccggccuacaagccgaagacgaagccgacuacuacugcgcauccuacgccggcaacaacaucuacgucuucggauccggcaccaaagucaccguucuaggccaacccaaagccaaccccaccgucacccucuucccacccucauccgaagaacuccaagccaacaaagccacccucgucugccucaucuccgacuucuacccaggcgccguaacagucgccuggaaagccgacucaucacccgucaaagccggcgucgaaaccacuacccccuccaaacaauccaacaacaaauacgcagccuccuccuaccucucccucacccccgaacaauggaaaucacacaaauccuacuccugucaagucacccacgaaggcuccaccgucgaaaaaacagucgcccccaccgaaugcuca

SEQ ID NO: 58609 - RNA, 648 nt, Artificial Sequence
  derived and/or modified sequence opt11 from anti-influenza_Chain
caauccguccucacccaaccccccucagaauccgucucccccggccaaaccgcauccgucaccugcuccggccacaaacucggagacaaauacgucuccugguaccaacaaaaacccggccaaucccccguccuacucaucuaccaagacaacagacgccccuccggcaucccagaacgcuucaucggauccaauuccggcaacaccgcuacccucaccaucuccggcacacaagcccucgacgaagccgacuacuacugccaagccugggacucuucaacagccgucuucggaggcggcacaaaacucaccguacuaggcgccgccgcaggccaacccaaagccgcccccuccgucacccuauuccccccauccuccgaagaacuccaagccaacaaagccacccucgucugccucauaucagacuucuaccccggcgcuguaaccgucgccuggaaagccgacuccucccccguaaaagccggcgucgaaaccaccacacccuccaaacaauccaacaacaaauacgccgcauccuccuaccucucccucacaccagaacaauggaaaucccaccgcuccuacuccugccaaguaacccacgaaggcucuacagucgaaaaaaccgucgcccccaccgaaugcucc

SEQ ID NO: 58610 - RNA, 648 nt, Artificial Sequence
  derived and/or modified sequence opt11 from anti-influenza_Chain
caauccgcccucacccaacccgccuccgucucuggcuccccaggccaauccaucaccaucuccugcaccggcacauccuccgacgucggcucuuacaaccucguauccugguaccaacaacaccccggcaaagcccccaaacucaugaucuacgaagucuccaaacgccccuccggcgucuccaaccgcuucucaggcuccaaaucaggcaacaccgccucccucaccaucuccggccuccaagccgaagacgaagccgacuacuacugccaccucuacgucggcuccuccaacugggucuucggcggcggcaccaaacucgccguccucggucaacccaaagccgcccccuccgucacucucuuccccccaucuuccaaagaacuccaagccaacaaagccacacucgucugccccaucuccgacuucuaccccggagccgucacagucgccuggaaagccgacuccucccccguaaaagccggugucgaaaccacuacccccuccaaacaaucgaacaacaaauacgccgccucauccuaccucucccucacaccagaacaauggaaaucccacaaauccuacuccugccaagucacccacgaaggcuccaccgucgaaaaaaccgucgccccaaccgaaugcuca

SEQ ID NO: 58611 - RNA, 648 nt, Artificial Sequence
  derived and/or modified sequence opt11 from anti-influenza_Chain
gaaaucguacucacacaauccccagccacccucuccguaucccccggcgaacgcgccacccucuccugccgcgccucccaauccgucgacuccaaccuagccugguaccaacaaaaacccggccaagccccccggcuacucgucuacucugccucuacccgcgccaccggcauccccgcccgcuucuccggcuccggcuccggcaccgaauucacccuagccaucucaucacuccaauccgaagacuucgccgucuacuacugccaacacuacaccaacuggcccccccgccucaccuucggcggcggcuccaaagucgaaaucaaacgcaccgucgccgcacccuccgucuucauauucccacccuccgacgaacaacucaaaucaggcaccgccucagucgucugccuccucaacaacuucuacccacgcgaagccaaaguccaauggaaagucgacaacgcccuccaaucaggcaacucccaagaauccguaaccgaacaagacucaaaagacucaaccuacagccuaucauccacccucacacucucaaaagccgacuacgaaaaacacaaagucuacgccugcgaagucacccaccaaggccuaucaucccccgucaccaaauccuucaaccgaggcgaaugc

SEQ ID NO: 58612 - RNA, 648 nt, Artificial Sequence
  derived and/or modified sequence opt11 from anti-influenza_Chain
gaaaucguccucacacaaucccccgccacccucuccgucucccccggugaacgcgcaacacucuccugccgcgccucccaauccgucucccacaaccuagccugguaccaacaaaaacccggacaagcccccagacuccuagucuacucugccuccacccgcgccaccgguaucccagcccgauucuccggcuccggcuccggcaccgaauucacccucgccaucucaucccuccaauccgaagacuucgccgucuacuacugccagcacuacaccaacuaccccccucgccucaccuucggcggcggcucuaaagucgaaaucaaacgcaccguagccgcccccuccgucuucaucuucccccccucagacgaacaacucaaauccggcaccgccuccgucguaugccuacucaacaacuucuacccacgcgaagccaaaguccaauggaaagucgacaacgcccuccaauccggcaacucccaagaauccgucaccgaacaagacuccaaagacucaaccuacucccucuccuccacccucacacuauccaaggccgacuacgaaaaacacaaagucuacgccugcgaagucacccaccaaggacuauccucccccguaaccaaauccuucaaccgcggcgaaugc

SEQ ID NO: 58613 - RNA, 648 nt, Artificial Sequence
  derived and/or modified sequence opt11 from anti-influenza_Chain
gagaucguaaugacgcaaucgccagcaacccugagcgugagcccgggcgagcgcgcgaccuugagcugccgcgcgagccagagcguggacucaaacuuggccugguaccagcaaaaacccggacaagcgcccagacucuuggucuauagcgcgagcacgcgcgcgaccgggaucccggccagguucucgggcucaggaucaggcacggaguucaccuuggccauauccucgcuccagagcgaagacuuugccguguacuauugccagcacuauaccaauuggccgcccaggcucacguucggaggcgggagcaaagucgagaucaagcgcacggucgcggccccgagcguauucauauucccgcccucggacgagcaauugaaaucaggcacggccucgguagugugccugcucaauaacuuuuacccacgcgaggccaagguccaguggaaggucgauaacgcgcuccagagcgggaacucgcaagagagcgugaccgagcaagauagcaaggacucgacauauaguuuaagcucaacccugacccugagcaaggccgacuacgagaaacacaaaguguacgcgugcgaggucacgcaccagggcuugagcucgcccgucacaaagagcuuuaacagaggcgagugc

SEQ ID NO: 58614 - RNA, 648 nt, Artificial Sequence
  derived and/or modified sequence opt11 from anti-influenza_Chain
gaaaucguacucacccaaucucccgccacccucuccgucucccccggcgaacgcgccacccuauccugccgcgccucccaauccgucuccucaaaccuagccugguaccaacaaaaacccggccaagccccccgccuccucgucuacuccgcaucaacccgagccaccggcauccccgcccgcuucucaggcuccggcucaggcacagaauucacccucgccaucuccucacuccaguccgaagacuucgccgucuacuacugccaacauuacaccaacuggccccccagacucaccuucggcggcggcuccaaagucgaaaucaaacgcacagucgcagcccccucugucuucaucuucccccccuccgacgaacaacucaaaucagguaccgccucagucguaugcuuacucaacaacuucuacccccgcgaagccaaaguccaauggaaggucgacaacgcacuccaauccggcaacucccaagaauccgucacagaacaagacuccaaagacuccaccuacucccuauccuccacccucacccucuccaaagccgacuacgaaaaacacaaagucuacgccugcgaaguaacccaccaaggccucuccucccccgucaccaaauccuucaaccgcggcgaaugc

SEQ ID NO: 58615 - RNA, 648 nt, Artificial Sequence
  derived and/or modified sequence opt11 from anti-influenza_Chain
gaaaucgugcucacacaaucacccgcgacccuaagcguaagcccaggcgaacgcgccacccucagcugccgcgcaagccaaagcguagaccacaaccucgccugguaccaacaaaaacccggacaagcacccagacuccuagucuacagcgcaagcacacgcgcaaccggcaucccagcccgguucucaggcucaggcucaggcacagaauucacccucgccauauccucacuccaaagcgaagacuucgccguauacuacugccaacacuacaccaacuggccacccagacucacauucggaggcggcagcaaagucgaaaucaaacgcacagucgccgccccaagcguauucauauucccccccuccgacgaacaacuaaaaucaggcacagccucagucgucugccuccucaacaacuucuacccccgcgaagccaaaguccaauggaaagucgacaacgcccuacaaagcggaaacucacaagaaagcguaaccgaacaagacagcaaagacucaaccuacagccuaagcucaacccuaacacuaagcaaagccgacuacgaaaaacacaaagucuacgccugcgaagucacccaccaaggccucagcucacccguaaccaaauccuucaacagaggcgaaugc

SEQ ID NO: 58616 - RNA, 648 nt, Artificial Sequence
  derived and/or modified sequence opt11 from anti-influenza_Chain
gaaauaguccucacccaaucccccgccacacucuccguaucccccggcgaacgagccacacuauccugccgcgcaucccaauccgucucccacaaccucgccugguaccagcaaaaacccggacaagcaccccgacuccucgucuacagcgccuccacacgcgcaaccggcauccccgcccgauucucaggcuccggcuccggcaccgaauucacccucgccaucagcucccuccaauccgaagacuucgccguauacuacugccaacacuacaccaacuggcccccccgccucaccuucggcggcggcuccaaagucgaaaucaaacgcacagucgccgcccccuccgucuucauauucccccccucagacgaacaauuaaaauccggcaccgccuccgucguaugccuccucaacaacuucuacccccgcgaagccaaaguccaauggaaagucgacaacgcacuccaaucuggcaacucccaagaauccguaaccgaacaagacuccaaagacuccaccuacucccuauccuccaccuuaacccuauccaaagccgacuacgaaaaacacaaaguauacgcaugcgaagucacccaccaaggccucuccucccccguaaccaaauccuucaaccgcggcgaaugc

SEQ ID NO: 58617 - RNA, 648 nt, Artificial Sequence
  derived and/or modified sequence opt11 from anti-influenza_Chain
gaaaucguacucacacaaucccccgccacccucuccgucucccccggcgaacgcgccacccucuccugccgugccagccaauccgucucccacaaccucgccugguaccaacaaaaacccggccaagcaccccgccuccuagucuacuccgccuccacacgcgcaaccggcaucccagccagauucuccggcuccggcuccggcaccgaauucacccucgccaucuccucccuacaauccgaagacuucgccguauacuacugccaacacuacaccaacuuccccccccgucucaccuucggcggcggcuccaaagucgaaaucaaacgcaccgucgccgcccccuccgucuucaucuucccccccuccgacgaacaacuaaaauccggcaccgccuccgucguaugccuccucaacaacuucuacccacgcgaagccaaaguccaauggaaagucgacaacgcacuccaauccggcaacucccaagaauccgucaccgaacaagacuccaaagacucaaccuacucccucuccuccacacuaacucucuccaaagccgacuacgaaaaacacaaagucuacgcaugcgaagucacacaccaaggccucuccucucccguaaccaaauccuucaaccgcggcgaaugc

SEQ ID NO: 58618 - RNA, 648 nt, Artificial Sequence
  derived and/or modified sequence opt11 from anti-influenza_Chain
gaaaucguacucacacaaucacccgccacccucuccguuagccccggcgaacgcgccacccuguccugccgcgccagccaaagcgucgacuccaaccucgccugguaccaacaaaaacccggccaagcaccccgccuccuagucuacuccgccuccacccgcgccaccggcauccccgccagauucucaggcucaggcuccggcacagaguucacccucgccauauccucccuccaauccgaagacuucgccgucuacuacugccaacacuacaccaacuucccaccccgacucacauucggcggcggcagcaaagucgaaaucaaacgcacagucgccgcccccuccgucuucaucuucccacccucagacgaacaacucaaauccggcaccgccuccgucgucugccuccuaaacaacuucuacccccgcgaagccaaaguccaauggaaagucgacaacgcccuccaaucagggaacucccaagaaagcgucaccgaacaagacucaaaagacuccaccuacucccuauccuccacccucacccuaagcaaagccgacuacgaaaaacacaaagucuacgccugcgaagucacccaccaaggccucagcucccccgucaccaaauccuucaaccgaggcgaaugc

SEQ ID NO: 58619 - RNA, 648 nt, Artificial Sequence
  derived and/or modified sequence opt11 from anti-influenza_Chain
gaaaucguacucacccaaucacccgcaacacuauccgucucccccggcgaacgcgccacccucagcugccgcgccucccaauccgucgacucgaaccuagccugguaccaacaaaaacccggccaagccccacgacuccuagucuacagcgcauccacccgagccaccggaauccccgcccgcuucucaggcucaggcuccggcaccgaauucacccucgccaucuccucccuacaaucagaagacuucgccgucuacuacugccagcacuacaccaacuaccccccccgccucacauucggcggcggcucaaaggucgaaaucaaacgcacagucgccgcccccuccgucuucaucuucccccccuccgacgaacaacucaaauccggcaccgccucagucgucugccuucucaacaacuucuacccccgcgaagccaaaguccaauggaaagucgacaacgcccuccaauccggcaacucccaagaaagcgucaccgaacaagacucaaaagacucaaccuacucacucagcuccacccuaacccuauccaaagccgacuacgaaaaacacaaaguauacgccugcgaaguaacccaccaaggccucucaucccccguaaccaaauccuucaaccgcggcgaaugc

SEQ ID NO: 58620 - RNA, 648 nt, Artificial Sequence
  derived and/or modified sequence opt11 from anti-influenza_Chain
gaaacaacccucacccaaucccccgcaacccuuuccgucucacccggcgaacgcgccacacucuccugccgcgccucacaagucaucucccacaaccuagccugguaccaacaaaaacccggacaagcaccccgacuccuaaucuacggcgccuccacccgcgccuccggcauccccgcccgcuucucuggauccggcuccggcaccgacuacacccuuaccaucaccucacuccaauccgaagacuucgccguauacuauugccaacacuacucaaacuggccaccccgccucaccuucggcggcggcaccaaagucgaaaucaaacgcaccgucgccgcccccagcgucuucauauucccacccuccgacgaacaacucaaauccggcaccgccuccgucgucugccuccucaacaacuucuacccccgcgaagccaaaguccaauggaaagucgacaacgcccuccaaagcggaaacucacaagaauccgucaccgaacaagacucuaaagacuccaccuacucccucagcuccacccucacccucuccaaagccgacuacgaaaaacacaaagucuacgccugcgaagucacucaccaaggccuauccuccccaguaaccaaauccuuuaaccgaggcgaaugu

SEQ ID NO: 58621 - RNA, 648 nt, Artificial Sequence
  derived and/or modified sequence opt11 from anti-influenza_Chain
gaaaucguccucacccaaucccccgccacccuauccgucucccccggcgaacgcgccacccucuccugccgcgccucccaagucaucucccacaaccucgccugguaccaacaaaaacccggccaagcccccagacuacucaucuacggcgcauccacccgagccagcgguauccccgcccgcuucucaggcuccggcucaggcaccgacuacacacucaccaucaccucacuccaauccgaagacuucgcagucuacuacugccaacacuacuccaacuggccaccccgccucaccuucggcggcggcaccaaagucgaaaucaaacgcaccgucgcugcacccuccgucuucaucuucccacccuccgacgaacaacuaaaauccggcaccgccuccgucgucugccuccucaacaacuucuacccccgcgaagccaaaguccaauggaaaguagacaacgcccuccaauccggcaacucccaagaauccgucaccgaacaagacuccaaagacuccaccuacucccucuccuccacccucacccucuccaaagccgacuacgaaaaacacaaaguauacgccugcgaagucacccaccaaggacuauccucccccgucaccaaauccuucaaccgaggcgaaugc

SEQ ID NO: 58622 - RNA, 648 nt, Artificial Sequence
  derived and/or modified sequence opt11 from anti-influenza_Chain
gaaaucguccucacccaaucacccgccacccucucagucucccccggagaacgcgccacccuauccugccgcgccucccaagucaucucccacaaccuagccugguaccaacaaaaaccaggccaagcaccccgccuccuaauauacggcgccagcacccgcgccuccggaauccccgcccgcuucuccggauccggcuccggaaccgacuacacccucaccaucaccucacuccaacccgaagacuucgccgucuacuacugccaacacuacuccaauuggccaccccgccucacauucggcggcggaacaaaaguagaaaucaaacgcaccgucgcugcccccuccgucuccaucuucccacccuccgacgaacaacucaaauccggcaccgccuccgucgucugccuccucaacaacuucuacccccgcgaagccaaaguccaauggaaagucgacaacgcacuccaauccggcaacucccaagaauccgucaccgaacaagacuccaaagacuccaccuacucacucagcuccacccucacccucuccaaagccgacuacgaaaaacacaaaguguacgcaugcgaagucacccaccaaggacucuccucccccgucaccaaaucauucaacagaggcgaaugc

SEQ ID NO: 58623 - RNA, 648 nt, Artificial Sequence
  derived and/or modified sequence opt11 from anti-influenza_Chain
gaaaucgucaugacccaaucccccgccacccuaucagucagccccggagaacgcgccacccuaucaugccgcgccucacaagucaucucccacaaccucgccugguaccaacaaaaacccggccaagcaccccgccuccucaucuacggcgccuccacacgcgccuccgguauccccgcccgauucucaggcuccggcucaggaaccgacuacacccucaccaucaccucccuccaauccgaagacuucgccguuuacuacugccaacacuacuccaacuggccaccccgccucacauucggcggcggaaccaaagucgaaaucaaacgcaccgucgccgcccccuccgucuucauauucccacccuccgacgaacaacucaaauccggcacagccucagucguaugccuacucaacaacuucuacccccgcgaagccaaaguccaauggaaaguagacaacgcccuucaaucaggaaacucacaagaauccguaacagaacaagacuccaaagacucaacauacagccucuccuccacccucacccucuccaaagccgacuacgaaaaacacaaagucuacgccugcgaagucacccaccaaggccuaucaucccccgucaccaaauccuucaaccgcggcgaaugc

SEQ ID NO: 58624 - RNA, 648 nt, Artificial Sequence
  derived and/or modified sequence opt11 from anti-influenza_Chain
gaaaucguccucacccaaucccccgccacccucucagucucccccggcgagcgcgccacccuauccugccgagccagccaagucaucucacacaaccucgccugguaccaacaaaaacccggacaagcccccagacuccucaucuacggcgccuccacccgcgccuccggcauccccgcccguuucuccggcucaggcucaggcaccgacuacacccucaccaucaccucccuccaauccgaagacuucgccgucuacuacugccaacacuacuccaacuucccaccccgacuaacauucggcggcggcaccaaagucgaaaucaaacgcaccgucgcagccccauccguauucaucuucccacccuccgacgaacaacucaaaucaggaacagccuccguaguaugccuccuaaacaacuucuacccccgcgaagccaaaguccaauggaaagucgacaacgcccuccaaagcggcaacucccaagaauccgucaccgaacaagacuccaaagacucaaccuacucccucuccuccacccuaacccucucaaaagccgacuacgaaaaacacaaaguauacgccugcgaagucacccaccaaggccucuccucccccgucaccaaauccuucaaccgcggcgaaugc

SEQ ID NO: 58625 - RNA, 648 nt, Artificial Sequence
  derived and/or modified sequence opt11 from anti-influenza_Chain
gaaaucguccuuacacaaucacccgccacccucuccgucucccccggagaacgagccacccuauccugccgcgccucccaaguuaucucccacaaccuagccugguaccaacaaaaacccggccaagcaccccgucuccucaucuacggcgccuccacacgcgccuccggcauccccgcccgcuucuccggcucaggcucaggcacagacuacacccugaccaucaccucacuccaauccgaagacuucgccgucuacuacugccaacacuacuccaacuacccaccccgccucaccuucggcggcggcaccaaagucgaaaucaaacgcaccgucgccgcccccuccgucuucaucuucccucccuccgacgaacaacuaaaauccggcacagccuccgucgucugccuccuuaacaacuucuacccccgcgaagccaaaguccaauggaaagucgacaacgcccuccaauccggcaacucccaagaauccgucaccgaacaagacuccaaagauuccacauacucccucuccucuacacuaacccucuccaaagccgacuacgaaaaacacaaagucuacgccugcgaagucacccaccaaggccucuccucccccgucaccaaaucauuuaaccgcggcgaaugc

SEQ ID NO: 58626 - RNA, 648 nt, Artificial Sequence
  derived and/or modified sequence opt11 from anti-influenza_Chain
gaaaucguccucacccaaucccccgcaacccucuccgucagcccaggagaacgcgucacccucuccugccgagccucccaaagcgucgccaacaaccucgccugguaccagcaaaagcccggacaauccccccgacuccucaucuacggcgccagcacacgcgacaccggcauacccgccagauucuccggcuccggcuccggcaccgaauucacccucaccauaagcucacuccaauccgaagacuucgccgucuacuacugccaacaauacaacaacuggccccccauguacacauucggccaaggaaccaaacucgaaaucaaacgcaccgucgcagcaccauccgucuucaucuucccccccuccgacgaacaacucaaauccggcaccgccucagucgucugccuacucaacaacuucuacccccgcgaagccaaaguccaauggaaagucgacaacgcccuccaaagcggcaacucacaagaaagcgucaccgaacaagacuccaaagacucaaccuacucccucagcucaacccucacccucuccaaagccgacuacgaaaaacacaaaguauacgccugcgaagucacacaccaaggccucucauccccagucaccaaaagcuucaaccgcggcgaaugc

SEQ ID NO: 58627 - RNA, 648 nt, Artificial Sequence
  derived and/or modified sequence opt11 from anti-influenza_Chain
gacaucgucaugacccaaucacccuccacccucagcgccagcguaggcgaccgcgucaccauaaccugccgcgcaucccaaagcaucggcaacuggcucgccugguaccaacaaaaacccggcaaagcccccaaacuccucaucuacaaagucucaacccucgaaagcggcguccccucccgcuucucaggcucaggcucaggcaccgaauucacccucacaauaaacucacuccaaccagacgacuucgccaccuacuacugccaacgcuacaccuccaacucccaaggauucaccuucggacaaggcaccaaacucgaaaucaaacgcaccgucgcagcccccucuguuuucaucuucccccccuccgacgaacaacuaaaauccggcacagcauccgucguaugccuacucaacaacuucuacccccgcgaagccaaaguccaguggaaagucgacaacgcccuccaauccggcaacucacaagaauccguaaccgaacaagacagcaaagacuccaccuacagccucuccuccacccuaacccuaucaaaagccgacuacgaaaaacacaaagucuacgccugcgaagucacccaccaaggccuauccucacccgucaccaaauccuucaaccgaggcgaaugc

SEQ ID NO: 58628 - RNA, 648 nt, Artificial Sequence
  derived and/or modified sequence opt11 from anti-influenza_Chain
gacauccaacucacccaaucaccccucucuccccccgucacccucggccaacccgccuccaucucaugccgcuccucacaaucccuccucuacaccgacggcuucaccuaccucucaugguaccaccaacgucccggccaauccccccgccgacuuaucuacaaaauauccaaccgcgacuccggcguacccgaccgcuucucaggcuccggcucaggcaccgacuucacccucaaaaucucccgcgucgaagccgaagacgucggcgucuacuacugcaugcaagccacccacuggccccucaccuucggcgaaggcaccaaagucgaaaucaaacccaaagccgcgccauccgucacccuauuccccccauccuccgaagaacuccaagccaacaaagccacccucgucugccucaucuccgacuucuaccccggcgccgucaccgucgccuggaaagccgacuccucccccgucaaagccggcgucgaaaccaccaccccauccaaacaauccaacaacaaauacgccgccuccuccuaccuaucccucacccccgaacaauggaaaucacacaaauccuacuccugccaagucacccacgaaggcuccaccgucgaaaaaaccgucgcccccacagaaugcucc

SEQ ID NO: 58629 - RNA, 648 nt, Artificial Sequence
  derived and/or modified sequence opt11 from anti-influenza_Chain
gaaauaguccucacacaaucacccggaacccugucccuaagcccgggagaacgcgcaaccuuaagcugccgcgcaagccaaagcguacgcucaaacaaccucgccugguaccaacauaaaccaggccaagccccgcgccuacucauauucggagccucaagcagggccaccggcauacccgaccgauucagcggaagcggaagcggaaccgauuucacacucacaaucucgcgccuagaaccagaagacuucgcaguauacuacugccaacaauacggaagcucucccgcacucacguucggaggcgggaccaaagucgaaaucaaacgaacagucgcggcaccaagcguauucauauucccaccaucagacgaacaacuaaaaucaggcacggccucggucguaugccuacucaacaacuucuacccgcgcgaagccaaaguccaauggaaagucgacaacgcacuccaaagcggaaacucacaagaaagcguaaccgaacaagacagcaaggacucaaccuacagccuaagcucaacccuaacccugagcaaagccgacuacgaaaaacacaaaguauacgcaugcgaagucacacaccaaggccugagcucccccgugaccaagagcuucaacagaggcgaaugc

SEQ ID NO: 58630 - RNA, 648 nt, Artificial Sequence
  derived and/or modified sequence opt11 from anti-influenza_Chain
caaucaguccucacacaaccucccuccgccucaggcucccgcggacaaucgaucaccaucuccugcaccggcuccaccuccgacaucggauccuacaacuacgucuccugguaccaacaacaccccggcaccgcccccaaagucauccuauacgaagucucccaacgccccuccggcguccccgaccgcuucuccggcuccaaaucaggcaacaccgccuuccucaccgucuccggccuccaaaccgacgacgaagccgacuacuacugcgccuccuacgccggcaacaacaucuacgucuucggaucaggcaccaaaguaaccguccucggucaacccaaagccaaccccaccguaacccucuucccccccuccuccgaagaacuacaagcaaacaaagccacccucgucugccucaucuccgacuucuaccccggcgccgucacagucgccuggaaagccgacuccucccccgucaaagccggcgucgaaaccaccacccccuccaaacaauccaacaacaaauacgccgccucuucauaccucucccucacccccgaacaauggaaaucacacaaaucauacuccugccaagucacccacgaaggcuccaccguagaaaaaacagucgcacccaccgaaugcucc

SEQ ID NO: 58631 - RNA, 651 nt, Artificial Sequence
  derived and/or modified sequence opt11 from anti-influenza_Chain
caacccguccucacccaaccacccuccgccuccggaucccccggccaacgcgucaccaucuccugcuccggauccucuuccaacauaggcuccuacaccgucaacugguaccaacaacuccccggcaccgcacccaaacuccucaucuacucccuaaaccaacgccccucaggaguacccgacagauucucaggcuccaaauccggcaccuccgccucccucgcaauaucuggccuccaauccgaagacgaagccgucuacuacugcgcagccugggacgacucacucuccgcccacgucgucuucggcggcggcacaaaacucaccguccuaggacaacccaaagccgcccccagcgucacccucuucccacccuccuccgaagaacuccaagccaacaaagccacccucgucugccuaaucuccgacuucuaccccggcgccgucaccgucgccuggaaagccgacucaucacccgucaaagccggcguagaaaccaccacccccucaaaacaauccaacaacaaauacgccgccuccucauaccucucacuaacacccgaacaauggaaaucacaccgcucuuacuccugccaagucacccacgaaggcuccaccgucgagaaaaccgucgcacccaccgaaugcucc

SEQ ID NO: 58632 - RNA, 651 nt, Artificial Sequence
  derived and/or modified sequence opt11 from anti-influenza_Chain
caacccguccuuacccaaccccccuccgccuccggaacccccggacaacgcgucacaaucuccugcuccggauccuccuccaacaucggcuccaacaccgucuccugguaccaacaaguccccggcaccgcccccaaacuccuaaucuacggcaacaacgaacgcccauccggcgucccagaccgcuucuccggcuccaaauccgccaccuccgccucccuagccaucucaggccuccaauccgaagacgaagccgauuacuacugcgcagccugggacgacucccucaacggcuuuugggucuucggcggcggcaccaaacucaccguccucggccaacccaaagccgcccccuccgucacccucuucccccccuccucagaagaacuucaagcaaacaaagccacccuagucugccuuaucuccgacuucuacccaggcgccgucaccgucgccuggaaagccgacuccucaccagucaaagccggcgucgaaaccaccacccccuccaaacaaucaaacaacaaauacgccgccuccucauaccucucccucacccccgaacaauggaaaucccacaaauccuacucaugccaagucacccacgaaggauccaccgucgaaaaaaccgucgcccccacagaaugcucu

SEQ ID NO: 58633 - RNA, 651 nt, Artificial Sequence
  derived and/or modified sequence opt11 from anti-influenza_Chain
uccuacguccucacccaaccccccuccgucuccggaacccccggccaacgcguuaucaucuccugcuccggcuacuccuccaacauaggcuccaacaccgucaacugguaccaacaauuccccggcaccgccccccgccuacuaaucuacgccaacaaccaacgccccccaggcguccccgaccgcuucuccggcuccaaauccggcaccucagccucacucgccauuuccggccuacaauccgacgacgaauccgacuacuacugcgccgccugggacgacucccucaacggccacugggucuucggcggcggcacaaaacucaccguccucggccaacccaaagccgcccccucagucacccucuucccccccuccuccgaagaacuccaagccaacaaagccacccucguuugccucaucuccgauuucuaccccggcgcaguaaccgucgccuggaaagccgacuccucccccgucaaagccggcgucgaaaccaccacccccuccaaacaauccaacaacaaauacgccgcaucaucuuaccuaucccucacacccgaacaauggaaaucccaccgcuccuacuccugucaaguuacccacgaaggcuccaccgucgaaaaaaccgucgcccccaccgaaugcucc

SEQ ID NO: 58634 - RNA, 654 nt, Artificial Sequence
  derived and/or modified sequence opt11 from anti-influenza_Chain
uccuacguccucacccaaccccccuccgucuccgucgcccccggacaaaccgcccgaaucaccugcggaggcaacaacaucggauccaaaucaguccacugguaccaacaaaaaccaggccaagcccccguccucgucgucuacgacgacuccgaccgacccuccggcauccccgaacgcuucuccgggagcaacuccggcaacacagccacccucaccaucucccgcgucgaagccggcgacgaagcagacuacuacugccaagucugggacagcuccuccgaccacgccgucuucggcggcggcacccaacucaccguccuuggagccgccgccggccaacccaaagccgcccccuccguaacccucuuccccccauccuccgaagaacuccaagcaaacaaagccacccucgucugccucaucucagacuucuaucccggcgccguaaccgucgccuggaaagccgacuccucacccguaaaagccggcgucgaaacuaccacccccuccaaacaaagcaacaacaaauacgccgccucaagcuaccuaucccucacccccgaacaauggaaaucccaccgauccuacuccugccaagucacacacgaaggcucaaccgucgaaaaaaccgucgcacccaccgaaugcucc

SEQ ID NO: 58635 - RNA, 654 nt, Artificial Sequence
  derived and/or modified sequence opt11 from anti-influenza_Chain
caauccguaguaacccaaccccccuccgucuccgucgcccccggccaaaccgcacgcaucaccugcggcggcaacaacaucggcuccaaauccguccacugguaccaacaaaaacccggccaagcccccguccuagucgucuacgacgacuccgaccgaccauccggcauacccgaacgauucuccggauccaauuccggcaacacagccacccucacaaucucacgcgucgaagcaggugacgaagccgacuacuacugccaagucugggacuccuccuccgaccacuacgucuucggaaccggcaccaaagucaccguacuaggcgccgccgcaggccaacccaaagccgcccccucagucacccucuuccccccauccuccgaagaacuccaagcaaacaaagcaacccucgucugccucaucuccgacuucuaccccggcgccgucacagucgccuggaaagccgacuccucacccgucaaagcaggagucgaaacaaccacccccucaaaacaauccaacaacaaauacgccgccuccucauaccucucacucacccccgaacaauggaaaucccaccgcuccuacuccugccaagucacccacgaaggcuccaccgucgaaaaaaccgucgcccccaccgaaugcucc

SEQ ID NO: 58636 - RNA, 654 nt, Artificial Sequence
  derived and/or modified sequence opt11 from anti-influenza_Chain
cucucacgcauaaaccacuucgaaaaaauccaaaucauccccaaauccuccugguccgaccacgaagccucauccggagucuccuccgccugccccuaccaaggcaccccauccuucuuccgcaacgucgucuggcucaucaaaaaaaacaacaccuaccccaccaucaaacgcuccuacaacaacaccaaucaagaagaccuccuaauccucuggggcauccaccacuccaacgacgccgccgaacaaaccaaacucuaccaaaaccccaccacuuacaucuccgucggcaccuccacacuuaaccaacgccucguccccaaaaucgccacccgauccaaagucaacggccaaaacggccgcauggacuucuucuggaccauccucaaacccaacgacgccaucaacuucgaauccaacggcaacuucaucgcccccgaauacgccuacaaaaucguuaagaaaggcgacuccgcaaucgucaaaucugaagucgaauacggcaacugcaacaccaaaugccaaacacccaucggcgccaucaacucauccaugcccuuccacaacauccacccccuuaccaucggagaaugccccaaauacgucaaauccaacaaacucguccucgccacaggccuccgaaacuccccccuc

SEQ ID NO: 58637 - RNA, 657 nt, Artificial Sequence
  derived and/or modified sequence opt11 from anti-influenza_Chain
uccuccgaacucacccaaccccccagcgcauccggcacccccggccaacgcgucaccauauccugcuccggauccaccuccaacaucggauacaaccccgucuccugguaccaacaaguccccggcaccgcccccaaacuccucaucuacuccaacaccgaacgccccuccggaguccccgaccgcuucuccggcuccaaauccggcacauccgccucccucgccaucuccggccuccaauccgaagacgaagccgacuacuacugcgccgccugggacgacacccucaacggccccgucuucggaggcggcaccaaagucaccguccuaggccaacgcaccgucgccgcccccuccgucuucaucuucccccccucagacgaacaacucaaauccggcaccgccuccgucgucugccuccucaauaacuucuacccacgcgaagccaaaguccaauggaaagucgacaacgcacuccaauccggcaacucccaagaaucagucaccgaacaagacuccaaagacucaaccuauucccucuccucaacccucacccucuccaaagccgacuacgaaaaacacaaagucuacgccugcgaagucacccaccaaggccucuccucacccgucaccaaauccuucaaccgaggcgaaugc

SEQ ID NO: 58638 - RNA, 657 nt, Artificial Sequence
  derived and/or modified sequence opt11 from anti-influenza_Chain
gacaucgucaugacccaauccccccucucacuccccgucacccccggcgaacccgcauccaucuccugccgaucaucccaaucacuccuacgauccaacggauacaacuaccucgacugguaccuccaaaaacccggccaaucaccccaacuccucaucuaccucggcuccaaccgcgccuccggaguccccgaccgcuucuccggcuccggcuccggcaccgacuucacacucaaaaucucccgagucgaagccgaagacgucggcguauacuacugcaugcaagcccuccaaacccccuacaccuucggacaaggaaccaaacucgaaaucaaacgcaccgucgccgcccccuccguauucauauucccccccuccgacgaacaacuaaaauccggcaccgccuccgucgucugccuccucaacaacuucuacccccgcgaagccaaaguccaauggaaagucgacaacgcccuccaaucaggcaacucccaagaauccgucaccgaacaagacuccaaagacuccaccuacucccucuccucaacccucacccuguccaaagccgacuacgaaaaacacaaaguauacgcuugcgaagucacccaccaaggccuauccucccccgucaccaaaucauucaaccgcggcgaaugc

SEQ ID NO: 58639 - RNA, 660 nt, Artificial Sequence
  derived and/or modified sequence opt11 from anti-influenza_Chain
uccuacguccucacccaaccccccucagccuccggcacccccggccaacgugucaccaucuccugcuccgguuccaccuucaacaucgguuccaacgccgucgacugguaccgacaacuccccggcaccgcccccaaacuccuaaucuacuccaacaaccaacgccccuccggcguccccgaccgcuucuccggcucccgcucuggcacauccgccucccucgccaucuccggccuccaaucagaagacgaagccgacuacuacugcgccgccugggacgacauccucaacguccccgucuucggcggcggaaccaaacucaccguccucggcgccgccgccggccaaccaaaagccgcccccuccgucacccuauucccccccuccucagaagaacuccaagccaacaaagccacccucgucugccuaaucuccgacuucuaccccggcgccgucaccgucgccuggaaagccgacuccucccccgucaaagcaggcgucgaaaccaccacccccuccaaacaaucaaacaacaaauacgccgccuccuccuaccucucacucacccccgaacaauggaaaucccaccgcucauacuccugccaagucacccacgaaggcuccaccgucgaaaaaacagucgccccaacagaaugcuca

SEQ ID NO: 58640 - RNA, 660 nt, Artificial Sequence
  derived and/or modified sequence opt11 from anti-influenza_Chain
caauccgcacucacccaaccagccgccgucucaggcucacccggccaauccaucaccaucuccugcaccggcaccagcucagacgucggcggcuacaacuacgucuccugguaccaacaacacccaggcaaagcccccaaacucaugaucuacgaagucuccaaccgcccaucaggcgucuccaaccgcuucuccggcuccaaaucaggcaacaccgccucacuaaccaucagcggccuccaagccgaagacgaagccgacuacuacugcuccucauacaccuccucuuccaccuacgucuucggcacuggcacaaaagucaccguacucggcgccgccgccggccaacccaaagccgcccccuccgucacccucuucccccccuccuccgaagaacuccaagccaacaaagcaacccucguaugccucaucuccgacuucuaccccggcgccgucacagucgccuggaaagccgacuccucccccgucaaagcaggcgucgaaacaaccaccccaucaaaacaauccaacaacaaauacgcagccuccucauaccucucacucacccccgaacaauggaaaucacaccgcuccuacucaugccaagucacccacgaaggaucaacugucgaaaaaaccgucgcccccaccgaaugcucc

SEQ ID NO: 58641 - RNA, 660 nt, Artificial Sequence
  derived and/or modified sequence opt11 from anti-influenza_Chain
uccuacguccucacccaaccccccuccgucucaggcacccccggacaacgcgucaccaucuccugcucaggaucccgcuccaacgucggagacaacuccgucuacugguaccaacacgucccagaaauggcacccaaacuacuaguauacaaaaacacccaacgccccuccggcguccccgcacguuucuccggcuccaaauccgguaccucagccucacucgccaucaucggccuccaauccggcgacgaagcugacuacuacugcgucgccugggacgacucagucgacggauacgucuucggcucuggcaccaaagucaccguccucggagccgccgccggccaacccaaagccgcccccucagucacccucuucccccccuccucagaagaacuccaagccaacaaagcaacacucgucugccucaucuccgacuucuaccccggagccgucaccgucgccuggaaagcagacuccucccccgucaaagccggaguagaaaccaccacccccuccaaacaauccaacaacaaauacgccgccucaucauaccucucccucacccccgaacaauggaaaucacaucgcuccuacuccugccaagucacccacgaaggcucuaccgucgaaaaaaccgucgcccccaccgaaugcucc

SEQ ID NO: 58642 - RNA, 660 nt, Artificial Sequence
  derived and/or modified sequence opt11 from anti-influenza_Chain
uccuacguccucacccaaccccccuccgccuccggcacccccggccaacgcgucaccauauccugcuccggcucauccucaaacaucggcuccaacuacgucuacugguaccaacaacuacccggaaccgcccccaaacuccucaucuaccgagacggccaacgccccuccggcguccccgaccgauucucaggcuccaaguccggcaccuccgccucccucgccaucuccggacuccgcuccgacgacgaagccgacuacuacugcgccaccugggacgacaaccucuccggccccgucuucggcggcggaaccaaacuuaccguccucggcgccgcagccggccaacccaaagccgcccccuccguaacccuauuccccccauccuccgaagaacuccaagccaacaaagccacacuaguaugccucaucuccgacuucuaccccggcgccgucaccgucgccuggaaagcagauuccucccccgucaaagcaggagucgaaaccaccacccccucaaaacaauccaacaacaaauacgccgccuccuccuaccucucccuaacccccgaacaauggaaaucccaccgcucuuacuccugccaagucacucacgaaggcuccaccgucgaaaaaaccguagcccccaccgaaugcuca

SEQ ID NO: 58643 - RNA, 660 nt, Artificial Sequence
  derived and/or modified sequence opt11 from anti-influenza_Chain
caaucagcccucacacaacccgccuccguauccggcucccccggccaauccaucaccaucuccugcaccggcaccucuucagacguaggcggcuacaacuacgucuccugguaccaacaacaccccggcaaagcccccaaacucaugaucuacgaaguaagcaaccgccccuccggagucucuaaccgauucucaggcuccaaaucuggcaacaccgccucccucaccaucuccggccuccaagccgaagacgaagccgacuacuacugcuccuccuacaccuccuccuccacccucguauucggcacaggcaccaaaguaacaguccucggcgcagcagccggacaacccaaagccgcccccuccguaacccucuucccccccuccuccgaagaacuacaagccaacaaagccacccucgucugccucaucuccgacuucuaccccggcgccguaaccgucgccuggaaagccgacagcuccccagucaaagccggcgucgaaacaacuacccccuccaaacaauccaacaauaaauacgcugccuccuccuaccucucccucaccccagaacaauggaaaucucaccgcucauacuccugccaagucacccacgaaggcuccaccgucgaaaaaaccgucgcccccaccgaaugcucc

SEQ ID NO: 58644 - RNA, 660 nt, Artificial Sequence
  derived and/or modified sequence opt11 from anti-influenza_Chain
accguccucacccaaccccccuccguauccggcgcccccggccaacgcgucaccaucuccugcaccggcuccuccuccaacaucggcgccggcuacgacguacacugguaucaacaacuccccggcaccgcccccaaacuccuaaucuacggcaacuccaaccgccccuccggaguccccgacagauucuccggcuccaaauccggaacauccgccacccuaggaaucacaggccuccaaaccggcgacgaagccgacuacuacugcggcacaugggacuccucccucuccgcauacgucuucggaaccggaaccaaagucaccguccuaggcgccgcagccggccaacccaaagccgcacccuccgucacacucuucccccccuccuccgaagaacuccaagccaacaaagccacucucgucugccuaaucuccgacuucuaccccggcgccgucaccgucgccuggaaagccgacuccucacccgucaaagccggcgucgaaaccaccacccccuccaaacaaucaaacaacaaauacgccgccuccuccuaccuaucccucacccccgaacaauggaaaucccaccgcuccuacuccugccaagucacccacgaaggcucaaccgucgaaaaaacagucgcccccaccgaauguucc

SEQ ID NO: 58645 - RNA, 663 nt, Artificial Sequence
  derived and/or modified sequence opt11 from anti-influenza_Chain
caaucaguccucacccaaccacccuccgucucagccgcccccggccaaaaagucaccaucuccugcuccggcuccuccuccaacaucggcaacgacuacgucucaugguaccaacaacucccuggcaccgcccccaaacuacucaucuacgacaacaacaaacgccccuccggaaucccagaccgauucuccggcucaaaauccggcaccuccgcaacccuaggcaucacaggacuccaaaccggcgacgaagccaacuacuacugcgccaccugggacagacgccccaccgccuacgucgucuucggcggcggcaccaaacucaccguccucggagccgcagccggccaacccaaagcagcccccucagucacacucuucccccccuccuccgaagaacuccaagccaacaaagccacccucguaugccucaucuccgacuucuaccccggcgccgucaccgucgccuggaaagccgacuccucccccgucaaagcaggcgucgaaaccaccacccccucaaaacaauccaacaacaaauacgcagccuccuccuaccucucacucacccccgaacaauggaaaucacaccgcuccuacuccugccaaguaacccacgaaggauccaccguugaaaaaaccgucgcaccaaccgaaugcucc

SEQ ID NO: 58646 - RNA, 675 nt, Artificial Sequence
  derived and/or modified sequence opt11 from anti-influenza_Chain
auggucggguucacaccaguggcccuggccgcgcuagcggcaacgggcgcgcuagcauucccggccggaaacgcgacagagcuagagaaaagacaaacgaccccgaacucagaaggguggcacgacggguacuacuacucgugguggagcgacggcggggcccaggccacguacacgaaccuagaagggggcacauacgagaucucguggggagacgggggcaaccucguaggcggaaaaggguggaaccccggacucaacgccagagcaauacacuucgaaggggucuaccaaccgaacgggaacucguaccuggcaguguacggguggacacgaaacccccuggucgaguacuacaucguagaaaacuucgggaccuacgacccgagcucgggagcgaccgaccucgggaccguggaaugcgacgggagcauauacagacuaggaaaaacaacaaggguaaacgccccgagcauagacgggacccagaccuuugaccaguacuggagcgugcgacaggacaagagaacgagcgggaccgugcaaacgggaugccacuucgacgcgugggcacgagcgggacugaacguaaacggggaccacuacuaccaaauagucgcgaccgagggcuacuucucgagcggauacgcgcgcauaaccguggcagacguaggg

SEQ ID NO: 58647 - RNA, 687 nt, Artificial Sequence
  derived and/or modified sequence opt11 from anti-influenza_Chain
cgcuccgacaaaacacacacuugcccaccaugccccgccccagaacuccuugguggcccauccgucuuccucuucccccccaaacccaaagacacccucaugaucucacgaacccccgaagucaccugcgucguagucgacgucucccacgaagaccccgaagucaaauucaacugguacgucgacggcgucgaaguccacaacgccaaaaccaaaccacgcgaagaacaauacaacucaaccuaccgcgucgucuccguccucaccguccuccaccaagacuggcucaacggcaaagaauacaaaugcaaagucucaaacaaagcccuccccgcccccaucgaaaaaaccauauccaaagccaaaggccaacccagagaaccccaagucuacacccucccccccucccgcgaagaaaugaccaaaaaccaagucucccucaccugccucgucaaaggcuucuaccccuccgacauagcaguugaaugggaaagcaacggccaaccagaaaacaacuacaaaaccaccccccccguccucgacucugacggcuccuucuuccucuacuccaaacucaccgucgacaaaucccgcuggcaacaaggcaacgucuucucaugcucagucaugcacgaagcccuacacaaccacuacacccaaaaaucccucucacuaucccccggcaaa

SEQ ID NO: 58648 - RNA, 696 nt, Artificial Sequence
  derived and/or modified sequence opt11 from anti-influenza_Chain
cacgcacaagacauccucgaaaaaacccacaacggcaaacucugcgaccucgacggcguaaaaccccuaauccuacgcgacugcuccgucgccggcuggcuccucggaaaccccaugugcgacgaauucaucaacguccccgaaugguccuacaucgucgaaaaagccaaccccgccaacgaccucugcuaccccggcaacuucaacgacuacgaagaacucaaacaccuacucucccgcaucaaccacuucgaaaaaauccaaaucauccccaaauccucaugguccgaccacgaagccuccucaggcgucuccuccgccugccccuaccaaggcacccccuccuucuuccgcaacgucgucuggcucauaaaaaaaaacaacaccuaccccacaaucaaacgcuccuacaacaacaccaaccaagaagaccuccuaauacuauggggcauccaccacuccaacgacgcagccgaacaaaccaaacucuaccaaaaccccaccaccuacauauccgucggcacauccacacuaaaccaacgacucguacccaaaaucgccacccgcucaaaagucaacggccaaaacggccgcauggacuucuucuggaccauccucaaacccaacgacgccaucaacuucgaauccaacggaaacuucaucgcccccgaauacgccuacaaaaucguaaaaaaa

SEQ ID NO: 58649 - RNA, 699 nt, Artificial Sequence
  derived and/or modified sequence opt11 from anti-influenza_Chain
augcgacccuccauccaauuccucggccuccuccucuucuggcuacacggcggccaaugcgacauccaaaugacccaaagccccuccucccucuccgccucacucggcggcaacgucaccauaaccugcaaagccucccaagacaucaacaaauacaucgcaugguaccaacacaaacccggcaaaggcccccgacucgucauccacuacacauccacccuccaacccggcaucccaucccgcuucuccggcuccggcuccggcaccgauuacucauucuccaucuccaaccucgaacccgaagacaucgccaccuacuacugccuccaauacgacauccucuacacauucggcggcggcaccaaacuagaaaucaaacgagcagacgcagcccccaccgucucaaucuucccacccucauccgaacaacucacaucaggaggcgccuccgucgucugcuuccucaacaacuucuaccccaaagacaucaacgucaaauggaaaaucgacggcuccgaacgccaaaacggcguacucaacuccuggaccgaccaagacuccaaagacuccaccuacucaaugucaucaacccucacccucaccaaagacgaauacgaacgccacaacuccuacacaugcgaagcaacccacaaaaccagcaccucccccaucgucaaauccuucaaccgcaacgaaugc

SEQ ID NO: 58650 - RNA, 702 nt, Artificial Sequence
  derived and/or modified sequence opt11 from anti-influenza_Chain
augauguccuccgcacaauuccuaggccuccuacuccucugcuuccaaggcacccgcugcgacauccaaaugacccaaaccucaucaucccuauccgccucccugggcgaccgcgucaccaucuccugccgugccucucaagacauccgcaacuaccucaacugguaucaacaaaaacccgacggcaccgucaaacuccuaaucuacuacaccucacgccuccacucaggcguccccagccgcuucucagacucaggcuccggcaccgacuacucccuuaccaucucaaaccucgaacaagaagaccucgccaccuacuucugccaacaaaccuacacccuccccuggaccuucggcggcggcaccaaacucgaaaucaaacgcgccgacgccgcccccaccgucuccaucuucccucccuccuccgaacaacucaccuccggcggcgccucagucgucugcuuccucaacaacuucuaccccaaagacauaaacgucaaauggaaaaucgacggcuccgaacgccaaaacggcguccuaaacucauggaccgaccaagacuccaaagacuccacauacuccauguccuccacccucacccucaccaaagacgaauacgaacgccacaacucauacacaugcgaagcaacacacaaaaccucaaccucccccaucgucaaauccuucaaccgaaacgaaugc

SEQ ID NO: 58651 - RNA, 702 nt, Artificial Sequence
  derived and/or modified sequence opt11 from anti-influenza_Chain
auggaagcccccgcccaacuacuuuuucuccuacuccuauggcuacccgacaccacaggcgaaaucguacucacacaaucacccgccacccugucccuaagcccaggcgaacgcgccacccuauccugccgcgcauccgaaaacaucuggaauaaccuagccugguaccaacaaaaacccgggcaagcaccccgccuccucaucucaggcgccagcaccggagcgaccggagucccauccagauuccgcggcucaggcucccgcacagaguucacccucaccaucagcucccuccaauccgaagacuucgccauauacuucugccaacaauacaacuccuggccacgcaccuucggccccggaaccaaagucgaaaucaaacgcaccgucgcagcccccagcgucuucauauucccacccucggacgaacaacuaaaauccggcacagccucaguagucugccuccucaacaacuucuacccacgcgaagccaaaguccaauggaaagucgacaacgcccuccagagcggaaacucacaagaaagcgucaccgaacaagacuccaaagacuccaccuacucccuaagcucaacccuaacccugagcaaagccgacuacgaaaaacacaaagucuacgcaugcgaagucacacaccagggccuaagcucacccguaaccaaauccuucaaccgcggcgaaugc

SEQ ID NO: 58652 - RNA, 705 nt, Artificial Sequence
  derived and/or modified sequence opt11 from anti-influenza_Chain
auggaaacccccgcccaacuccucuuccuccuccuccucuggcuccccgacaccaccggcgaaaucguccucacccaaucccccggcacccucucccucucccccggcgaacgcgccacccucuccugccgcgccucccaaucccucucauccucaucccucgucugguaccaacaaaaacccggccaagcaccccgccuccuaaucuacggcgccuccucucgcgccaccggcauacccgaccgauucuccggcuccggauccggcaccgacuucacccucacaaucucccgccucgaacccgaagacuucgccgucuacuacugccaacaauacggcaacucccccuacaccuucggccaaggaacacaagucgaaaucaaacgaaccgucgccgcccccuccgucuucauauucccacccuccgacgaacaacucaaaucaggaacagccuccgucgucugccuccucaacaacuucuacccccgcgaagccaaaguccaauggaaagucgacaacgcccuccaauccggcaacucucaagaguccgucaccgaacaagacuccaaagacuccaccuacucacucuccuccacccuaacccucuccaaagccgacuacgaaaaacacaaagucuacgccugcgaagucacccaccaaggccucuccucccccgucaccaaaucuuucaaccgcggagagugc

SEQ ID NO: 58653 - RNA, 705 nt, Artificial Sequence
  derived and/or modified sequence opt11 from anti-influenza_Chain
auggaaaccccagcccaacuucuuuuccuccuccuucuauggcuacccgacacaaccggcgaaaccguccucacccaaucccccggcacccucagccucucacccggcgaacgcgccacccucuccugccgcgccucccaauccgucucaauauccuaucucgccugguaccaacgcaaacccggccaagccccacgccuacuaaucuacggcgccucccgccgcgcuaccggaaucccugaccgcuucuccggcucaggcuccggcaccgacuucacccucaccaucucccgccucgaacccgaagacuucgccgucuacuacugccaacaauacggauccucccccuacacauucggccaaggcacaaaacucgaaaucaaacgcaccgucgccgcccccucagucuucaucuucccacccuccgacgaacaacucaaauccggcaccgccuccgucgucugccuccucaacaacuucuacccccgcgaagcaaaaguccaauggaaagucgacaacgcacuccaauccggcaacagccaagaaucaguaacugaacaagacuccaaagacucaaccuacucacucuccucaacccucacccuauccaaagccgacuacgaaaaacacaaaguauacgcaugcgaagucacccaccaaggccucuccucacccgucaccaaauccuucaaccgcggagaaugc

SEQ ID NO: 58654 - RNA, 705 nt, Artificial Sequence
  derived and/or modified sequence opt11 from anti-influenza_Chain
auggccuggaugaugcuccuccucacccuccuaauacacugcaccggaucaugggcccaauccguccucacccaaccccccuccgucuccgccgcacccggccaaaaagucaccaucuccugcuccggcuccucauccaacaucggcaaaaacuacgucucaugguaccaacaacucccaggcacagcccccaaacuccucaucuacgacaacgacaaacgccccucaggcauacccgaccgcuucucaggcuccaaauccggaacaucagcaacccucggaaucaccggccuacaaaccggcgacgaagccgacuaccacugcggcgccugggacuccucccucaacggcggugucuucggcggcggaaccaaagucaccguccucggucaacccaaagcagccccaucaguaacccucuuccccccauccuccgaagaacuacaagccaacaaagccacccucguaugccuaaucuccgacuucuaccccggcgccguaaccgucgccuggaaagccgacucaucacccgucaaagccggcguagaaaccaccacacccuccaaacaauccaacaacaaauacgcagcauccucauaccucucacuaacucccgaacaauggaaaucccaccgcuccuacucaugccaagucacccacgaaggcucaaccgucgaaaaaaccgucgccccaaccgaaugcucc

SEQ ID NO: 58655 - RNA, 714 nt, Artificial Sequence
  derived and/or modified sequence opt11 from anti-influenza_Chain
augaugaaaaaaaaauccugguucacacucaugauaaccggcgucaucagccuauucuucuccgucuccgcauucgcaggcaacgucuucugggaaccccucagcuacuucaacuccuccaccuggcaaaaagccgacggcuacuccaacggccaaauguucaacugcacauggagagccaacaacgucaacuucacaaacgacggcaaacucaaacucucacucaccucccccgccaacaacaaauucgacugcggcgaauaccgauccaccaacaacuacggcuacggccucuacgaagucagcaugaaacccgccaaaaacaccggcaucguauccuccuucuucaccuacaccggccccucccacgguacccaaugggacgaaauagacaucgaauuccucggcaaagacaccaccaaaguccaauucaacuacuacaccaacggcgucggaggccacgaaaaaaucaucaaccucggcuucgacgccuccaccuccuuccacaccuacgccuucgacuggcaacccggauacaucaaaugguacgucgacgguguccucaaacacaccgccaccacaaacauccccuccacccccggcaaaaucaugaugaaccucuggaacggcaccggcgucgacuccuggcucggcuccuacaacggcgccaacccccucuacgccgaauacgacugggucaaauacaccucaaac

SEQ ID NO: 58656 - RNA, 729 nt, Artificial Sequence
  derived and/or modified sequence opt11 from anti-influenza_Chain
caaguacaauugguccagagcggggcagaggucaagaaaccgggcagcagcgugaaaguaagcugcaaagcgagcggaggaacguucucgagcuacgccauaagcuggguaagacaagcgccagggcagggacuugaguggaugggcgggaucaugggcauguucgggacaacgaacuacgcccagaaauuccaaggaagagugacaauaacagcagacgaguucacgagcgcggcauacauggaacuaagaagccuacgcucggaagauacagcagucuacuacugcgcgaggagcagcggcuacuacccggaauacuuccaggacuggggccagggcacacucgugaccgugagcucgggcacgggcggaagcgggggcacgggcuccggcacgggcggaagcacacaaucgguccuaacccagcccccaagcgagagcgugagcccaggccagaccgcgagcguaaccuguagcgggcacaaacuaggggacaaguacgugagcugguaccagcaaaagcccggacaaucacccgugcuacuaaucuaccaagacaaccggcgcccaagcgggaucccggaaagauucauaggcagcaacucaggcaacaccgcgacccuaacaauaagcgggacccaggcccuggacgaggccgacuacuacugccaggccugggacucgagcacagcaguauucgggggcgggaccaagcuaacgguccugggc

SEQ ID NO: 58657 - RNA, 729 nt, Artificial Sequence
  derived and/or modified sequence opt11 from anti-influenza_Chain
cagguccagcuaguacaaucaggcgcagaaguaaagaaacccggaagcucagucaaaguaucaugcaaagccucaggcgggcccuuccgcaacuucgcaaucaacugggugcgccaagcccccggccaaggacuggaauggaugggaggcauaaucgcagucuucggcacaacaaaauacgcacacaaauuccaaggccgagucacgaucacagccgacgacucgacaaacaccgcauacauggaacuaggcucacucaaaagcgaagacacggccguauacuacugcgcacgcggaccccacuacuacagcucauacauggacguauggggagaagggaccaccgucacagucucaagcgggaccgggggcucaggaggaaccggaagcggaaccggcggcucaaccgacauccaacucacgcaaucccccucaagccucagcgcaagcgugggcgaccgcgugaccauaaccugccgcgcaagccagggcauaagcaccuaccuagccugguaccaacaaaaacccggaaaagugcccaaacuccuaaucuacgccgcaagcacgcuccaaagcggagucccaagcagauucucaggcucaggcucaggaacagacuucacccugaccauaagcucacuccaacccgaagacguagcaacauacuacugccagaaauacaacucagccccgagcuucggcccaggcacaaaaguggacauaaaaagg

SEQ ID NO: 58658 - RNA, 729 nt, Artificial Sequence
  derived and/or modified sequence opt11 from anti-influenza_Chain
auguccuaccgcgucaaacgcaugcucaugcuccucgucaccggccucuuccuaagccucucaaccuucgccgccuccgccucagcccaaaccggcggauccuucuacgaacccuucaacaacuacaacaccggacucuggcaaaaagcagacggcuacucaaacggcaacauguucaacugcacauggagagccaacaacgucucaaugaccucccucggcgaaaugcgccucucccucaccucucccuccuacaacaaauucgacugcggcgaaaacagauccguccagaccuacggcuacggccucuacgaagucaacaugaaacccgcaaaaaacgucggcaucgucuccuccuucuucaccuacaccggccccaccgacggcacccccugggacgaaaucgacaucgaauuccuaggcaaagacaccaccaaaguccaauucaacuacuacaccaacggcgucggcaaccacgaaaaaaucgucaaccuuggauucgacgcagcaaacuccuaccacacauacgccuucgacuggcaacccaacucaaucaaaugguacgucgacggccaacucaaacacaccgccaccacccaaaucccccaaacacccggcaaaaucaugaugaaccucuggaacggcgccggcgucgacgaauggcucggcuccuacaacggcgucaccccccucucucgcucccuccacuggguccguuacaccaaacgc

SEQ ID NO: 58659 - RNA, 735 nt, Artificial Sequence
  derived and/or modified sequence opt11 from anti-influenza_Chain
cagguccagcuacagcaaucgggcgcggaagucaaaaagcccgggagcucaguaaagguaucgugcaaggucucgggcgugauauuuagcgggagcgcgaucucguggguacgccaggccccgggccagggccuggaauggaugggcgggauaagcccccucuucggcacgaccaacuacgcgcaaaaguuccagggcaggguaacgaucacggccgaucaaucgaccaacaccacauacauggaaguaaacucgcuccgguacgaggacacagccguguacuucugcgcgcgcgggccgaaguacuauagcgaguauauggacgugugggggaaaggcaccacagucacgguaucgagcgggacagggggcucgggcggaacaggaagcggaacaggaggcuccaccgacauacagaugacacaaucgccaucgagccugagcgcaagcgugggcgaccgcgugaccauaaccugccgcgcaagccagggcauaagcucauacuuggccugguaccagcaaaaacccgggaaagugcccacgcuccugauauacgacgcgagcacgcuaaggagcggagucccgagcagguucucgggcucgggcucggccacggacuucacccugaccauaaguucacuccagcccgaggacguggccacauacuacugccagagauauaacucggccccgcccaucacauuuggccagggcacgcgccuagaaauaaaaaga

SEQ ID NO: 58660 - RNA, 735 nt, Artificial Sequence
  derived and/or modified sequence opt11 from anti-influenza_Chain
gaaguccaacucgucgaauccggcgccgaagucaaaaaacccggcucauccgucaaagucucaugcaaagccuccggcggcaccuucuccuccuacggcaucagcuggguacgccaagcacccggacaaggccucgaauggaugggcgacaucaucggcauguucggcucaaccaacuacgcccaaaacuuccaaggcagacucaccauaaccgccgacgaauccacaagcaccgccuacauggaacucucgagccuccgcucagaagacacagcagucuacuacugcgcucgcuccuccggcuacuaccccgcauaccucccccacuggggccaaggcacacuugucaccgucuccucaggcaccggcggaagcggcggcaccggcucaggaacaggcggcucaaccgaaaucguccucacacaaucccccggcacccuaucccuaucacccggcgaaagagccacacucucaugccgagcaagccaaucggucuccagcuccuaccucgccugguaccaacaaaaacccggccaagcccccagacuccucaucuacggagccagcucacgagccaccggcauccccgaccgcuucucaggcucaggcuccggaaccgacuucacccuaacaaucucccgccuagaacccgaagacuucgccguauacuacugccaacaauacggcuccuccccaagaaccuucggcggcggaaccaaagucgaaaucaaacgc

SEQ ID NO: 58661 - RNA, 735 nt, Artificial Sequence
  derived and/or modified sequence opt11 from anti-influenza_Chain
gaaguacaacugguugagagcggggccgaggucaagaaaccgggaucgagcgugaaaguaagcuguaaagcgagcgggggaacguucucgagcuaugcaauaagcugggucaggcaagcacccgggcaggggcuugaguggaugggcgggaucauaggaauguucgggacagcaaacuaugcacagaaauuccaagggcgcgugaccauaaccgcagacgaguucacgagcacggccuauauggagcuaucgagcuugcgaucggaagauaccgcggucuauuacugugccaggggcaauuacuauuacgagagcucacucgauuacuggggccagggaacgcucgugaccgugagcucgggcacgggcgggagcgggggaacgggcucaggcacaggcgggagcacgcaaucggucgugacccagccaccgagcgugagcguggccccgggccagaccgcgcgaauaaccuguggcgggaacaauaucggaagcaagagcgugcacugguaccagcaaaagcccgggcaagcgcccgugcucguagucuaugacgauagcgaucggccgagcgggaucccggaaagauucucgggcucgaacucgggcaauaccgcgaccuugaccauaagcaggguagaggccggggacgaagccgauuacuauugccaggucugggacucgagcucggaccauuacguguucggaaccgggaccaagguaacgguccuaggc

SEQ ID NO: 58662 - RNA, 735 nt, Artificial Sequence
  derived and/or modified sequence opt11 from anti-influenza_Chain
gaaguccaacucguccaauccggcgcagaagucaaaaagccaggcgccucaguaaaagucuccugcaaagccuccggcuacaccuucaccggcuacuacgucuacugggugcgccaagcccccggccaaggacuagaauggaugggcuggaucagcgccuacaacggcaacaccaacuacgcccaaaaauuccaaggccgagucaccaucacagccgacaaauccaccucaaccgccuauauggaacucuccucccuccgaagcgaagacacagccguauacuacugcgcacgaucacgcucccuagacgucuggggccaaggaaccaccgucaccgucagcuccggcaccggcggcuccggaggcacaggauccggcaccggcggcagcaccgacguagucaugacccaaagccccgacucacucgccguaucccuaggcgaacgagccaccaucaacugcaaauccucacaauccguccuauacuccagcaacaacaaaaacuaccuagccugguaccaacaaaaacccggacaaccacccaaacuccucaucuacugggcauccacccgcgaauccggcguccccgaccgauucagcggcagcggcuccggcaccgacuucacacucaccauauccagccuccaagccgaagacgucgcaguauacuacugccaacaauacuacagcacaccccucaccuucggcggcggaaccaaagucgacauaaaaaga

SEQ ID NO: 58663 - RNA, 735 nt, Artificial Sequence
  derived and/or modified sequence opt11 from anti-influenza_Chain
gagguccagcuaguagaaaccggcgcggaagugaaaaagcccgggagcucaguaaaggucccgugcaagaguucaggaucgcccuuccgauccaacgcggucucgugggugagacaggccccgggccaaggcuuggaaugggucggaggaauacucggggucuuuggcucaccaucauacgcgcaaaaguuccagggaagggucacaaucacggccgacgaaucgacaaauacagugcacauggaacugcgcgggcucaggagcgaggacacagccguauacuacugcgcgcgcgggcccacguacuacuacucauacauggacguauggggcaaagggacaacagucacggucucgagcggaaccgggggaucgggagggaccgggagcgggacagggggaucaaccucauacgugcucacgcaaccgcccucggaaucagucgcgcccgggcaaacggccaggauaacgugcgggggcaauaacauaggaaggaacucgguccauugguaccaacagaaaccgggccaggccccgguccuggucguguacgacgacucggacaggcccucgggcauacccgagcgcuucagugggagcaagagcgggaacacggccacgcuaauaaucucgcgcguagaagugggcgacgaagcagacuacuacugucaaguauggcacaguucgagcgaccacuacgucuuuggcacgggcacaaaagugaccgugcucggg

SEQ ID NO: 58664 - RNA, 735 nt, Artificial Sequence
  derived and/or modified sequence opt11 from anti-influenza_Chain
caaaugcaauugguccagagcggggccgaggucaagaaaccgggcucgagcgugaaaguuaguuguaaagcaagcggaggcacguucucgagcuaugccauaagcuggguaaggcaagcacccgggcaagggcuagaguggaugggcgggaucuucggcauguucgggaccgcgaacuaugcacagaaauuucaagggagagugaccauaaccgcggacgaguucacgagcgcggccuauauggagcucucgagcuugggcucagaagauaccgcgauguauuacugugcaaggagcucaggcuauuacccgcaauauuuccaggacuggggccagggcacgcuugugacagugagcucaggcacgggcgggagcgggggcacaggaucaggaacgggcgggagcacggaaauagucaugacccaaagcccgggcacgcucucgcuaucgcccgggcaaagggccacgcuaucgugcagagccucacaaucagucucgagcucguacuuggccugguaccagcaaaagcccgggcaagcgcccaggcucuuaauguauggcgcaagcucacgcgcgaccgggauaccagacagguucucgggcucgggaucgggcacggacuuuacauugaccauaagcaggcucgagccagaggacuucgccguguacuacugccagcaauauggcucgagcucgcucacguucgggggcgggaccaagcuagagaucaagcgc

SEQ ID NO: 58665 - RNA, 735 nt, Artificial Sequence
  derived and/or modified sequence opt11 from anti-influenza_Chain
caaguacagcuaguacaaagcggggccgaaguaaagaaaccaggcucgagcguaaaagugagcugcaaagcgagcggggucacauucucguacuacgccaugagcugggucaggcaagcgcccgggcaaggccuagaguggaugggcgggaucucgcccauguucggaaccacaacauacgcccaaaaauuccaaggacgcguaaccauaaccgcagacgacagcacgagcacggcauacauggaggucaggagccuacgaucagaagacaccgcagucuacuacugcgccaggagcucaaacuacuacgacagcguauacgacuacuggggacagggaacccuagugacaguaagcucaggaacgggaggaagcggaggcacgggcucgggcacgggcgggucaacgcaaucagucguaacacagccaccaagcgagaguguggcaccgggccagacagcgcgaauaaccugcggcggacacaacaucggaagcaacagcguucacugguaccagcaaaagccaggacaagcacccgugcucguggucuacgacaacagcgaccgcccgagcgggaucccggaaagauucucgggcucuaacuccggcaacaccgcgacccugaccauaagcagggucgaagcaggggacgaggccgacuacuacugccaggucuggggcucaagcucggaccacuacguguucggcaccggaaccaagguaacgguccugggc

SEQ ID NO: 58666 - RNA, 738 nt, Artificial Sequence
  derived and/or modified sequence opt11 from anti-influenza_Chain
cagguacagcucgugcaaucgggagggggauuggucaagcccgggggaucgcuaagacucucgugcgcggccucaggcuuuacauuuagcucguacucaaugaauugggugcgccaggccccgggaaagggccuggaaugggucucgagcauaagcucgagcucgagcuauaucuauuacguggacucagucaagggaagguucacgaucucgcgagauaacgcgaaaaauagccuauaccugcaaaugaacucgcucagggccgaggacacggccguauacuacugcgcgcgcgggggagggagcuauggcgcguacgagggcuuugacuacugggggcaagggacccuggucacagucucgagcgggaccgggggcucgggcgggaccgggagcgggaccgggggcucgaccgagaucgugcucacgcaaucacccgggacauugagcuugagcccgggcgagcgcgcgaccuugagcugccgcgcaagucaacgcgugagcucguacuuggcaugguaccagcaaaagccagggcaagcgcccagacuauuaaucuauggcgcgagcacgcgcgcggccgggaucccggacagguucucgggcucgggcucaggcacggacuuuaccuugaccauaagcaggcucgaaccagaggacucagccguauacuauugccagcaauauggcaggaccccgcucacguucgguggagggaccaaggucgagaucaagcgc

SEQ ID NO: 58667 - RNA, 738 nt, Artificial Sequence
  derived and/or modified sequence opt11 from anti-influenza_Chain
gaagugcaauuggucgagagcggggccgaggucaagaaaccgggaucgagcguaaaggugagcuguaaagcgagcggaggcccguucaggagcuacgccauaagcugggucaggcaagcgcccggacaagggcccgaguggaugggcgggauaauacccauauucgggacaacgaaauaugccccgaaauuucaagggcgcguaaccauaacagcggacgauuucgcgggaacggucuauauggaacuaucgagccugcgaucggaagauacagcaauguauuacugugcaaagcacaugggcuaccaaguacgcgagaccauggaugugugggggaaaggaacaacgguaacaguaucgagcggaaccgggggcucgggcgggaccgggagcgggaccgggggaucgaccucguacgugcucacgcaaccgcccucggucucggucgcgcccgggcaaacagccaggaucacgugcgggggcaacaacauaggaucgaaaucgguacauugguaccaacagaaaccgggccaggccccgguauuaguaguguacgaugacucggacaggcccucaggcauaccagagcgauuuagcgggagcaauagcggaaacacggcaacgcuaacgaucagucgcguggaagcgggcgaugaagcggacuauuacugucaaguaugggacagcucgagcgaucacgcggucuuuggcgggggaacgcaacugaccgugcuaggg

SEQ ID NO: 58668 - RNA, 738 nt, Artificial Sequence
  derived and/or modified sequence opt11 from anti-influenza_Chain
gaagugcaacuggucgagaccggggccgagguaaaaaaaccgggcgcaagcgugaaagugagcugcaaagcaagcggauacacguucacaagcuacuacaugcacugggucaggcaagcgcccgggcaaggacuagaguggaugggauggaucaaccccaacagcgggggcacgaacuacgcccagaaauuccaagggcgaguaaccaugaccagagacacgagcauaagcacggcauacauggagcucucgcgccugcgcucagacgauaccgcggucuacuacugcgccagagaaggaaaauggggcccgcaagcagcauucgacauaugggggcaagggacaauggucacgguaucgagcgggaccgggggaucaggcgggaccgggagcggaaccgggggcucgacagagaucguaaugacacaaucgcccgggaccuugagccuaagcccgggcgagcgcgcgacacuaagcugccgcgcgagccaaaguguaagcucaagcuaccucgcgugguaccaacagaaaccgggccaggccccgcgccugcucauauacgacgcaucgagcagggccacggacauacccgaccgauucagcggcagcgggagcgggacagacuucacacucacgaucucgcgccuagaaccggaagacuucgcggucuacuacugucaacaguacggaagcucgcucuggaccuucggccaaggcacaaaaguagaaauaaaaaga

SEQ ID NO: 58669 - RNA, 738 nt, Artificial Sequence
  derived and/or modified sequence opt11 from anti-influenza_Chain
gagguccaacucguggaaucgggcgggggccugguccagcccgggggcucacucaggcuaucgugcgcggccucgggcuuuaccuuuagcauauacgcgaugucgugggugcgccaggccccgggcaagggccuggaaugggucucagccauaagcucgagcggggacucgaccuauuacgcggacuccgucaagggcagguucacgaucucacgcgauaacgcgcgcaauaccuuguaccugcaaaugaacucgcucagagccgaggacacggccguauacuauugcgcgagagcguacggguacacauucgaccccuggggccagggcacgcucgugaccgugagcucgggcacuggcgggagcgggggaacaggcucgggcacgggcgggagcacggaaauaguacugacccagagcccgcucucgcucccgguaacgcccggggaaccggccucaaucucaugcaggagcucgcaaucgcuccuacacucaaacggguacaacuacuuggacugguacuugcaaaagcccgggcaaucgccacagcuauugaucuaucucgggagcaaucgcgcgagcgggguaccggacagauucucgggcucaggcucgggcacagacuucacccugaaaaucagcagggucgaggccgaggacgugggaguauacuauugcaugcaagcacuccagaccccgcuaacguucgggggcggaacuaaagucgagaucaagcgc

SEQ ID NO: 58670 - RNA, 738 nt, Artificial Sequence
  derived and/or modified sequence opt11 from anti-influenza_Chain
gagguccagcucguagaaacaggagcagaagugaaaaagcccggaaguucgguaaaggucucgugcaaggccucgggcggaaccuuucgcacgcacgcgaucucgugggugcgccaggccccgggccagggcuuggaauggaugggcgggauaauagcgaucuucggaacggccaauuacgcgcaaaaguuccagggcaggaucacgaucacggccgaugaaucgaccucgaccgcauacauggaauuaagcucgcuaagaagcgaggacacggccguguacuuuugcgcgcgcgggagcggguaccauaucucgaccccguucgauaacuggggacagggcacgcucgugacagugagcucgggcacgggaggaagcgggggcacgggcucgggcacgggcgggagcacaagcuauguacugacccagcccccgagcgugagcguagcaccgggacagaccgcgcgcauaaccuguggcggaaacaacaucgggagcaagggcgugcacugguaccagcaaaagccaggacaagcgcccgugcucgugguauaugacgauagcgaccgcccgagcggaauaccggaaagguucucaggcucgaacucgggcaauaccgcgaccuugacaauaagcaggguagaggccggagaugaggccgacuacuauugccaggucugggacucgagcucggaccaugucguguucgggggcgggaccaagcucacgguccuaggc

SEQ ID NO: 58671 - RNA, 738 nt, Artificial Sequence
  derived and/or modified sequence opt11 from anti-influenza_Chain
gagguccagcuagugcagucaggagcugaagugaaaaagccagggagcucagucaaggucucgugcaaggcaucaggcgggaucuuucgaucgaacucgaucucaugggugcgccaggcaccgggacaggguuuggaauggaugggcgggauauucgcgcucuuuggcacgaccgauuacgcgcaaaaguuccagggcaggguaacgauaacagccgaugagucgaguacaaccguguacuuggaauugaguucgcucacgagcgaggacacggccguguacuauugcgcgcgcgggagcggguacacgacaaggaacuauuucgauuacuggggccaaggcacacucguaacagugaguucaggcacgggcggaagcgggggaacgggcucgggcacgggcgggagcacggaaauagucuugacccagagcccgggcacgcuuucgcucucacccggggaaagggcaacgcucucgugcagagccucacaaucgguaucgagcaacuacuugggcugguaccagcaaaagccagggcaagcgcccagacuacugauauauggcgcgagcucacgagcgagcgggaucccggacagguucucgggcgggggcuccggcacggacuucacccugaccauaagcaggcucgagcccgaggacuuugcaguguacuauugccagcaauauggcucaagcccgcucacguucgggggcgggaccaaggucgagaucaagaga

SEQ ID NO: 58672 - RNA, 738 nt, Artificial Sequence
  derived and/or modified sequence opt11 from anti-influenza_Chain
gagguccagcucguggaaucaggcgcggaagugaaaaagccagggagcucagucaaaguaucgugcaaggcaucgggcgggaucuuuaacucguacgcgaucucgugggugcgacaggccccaggccagggauuggaauggaugggcgggauaaucgcaauauuucacacgcccaaguacgcacaaaaguuccagggaagggucacgaucacggcagacgaaucgacaaauacagcguacauggaauugcgcucgcuaaagagcgaggacacagccuuguacuauugcgcgcgcgggagcacguaugauuucucaagcggacucgauuacuggggacagggcacgcucgugaccgugaguucgggcacaggcgggagcgggggcacgggcucgggcacgggcgggagcacgcaagcgggccugacccagcccccaagcguaagcguggccccgggccagaccgcgcgcauaaccuguggcgggaacaauaucgggagcaagagcgugcacugguaccagcaaaagcccggacaagcgcccgugcuaguggucuaugacgauagcgaucgcccgagcgggaucccggaaagguucucgggcucgaacucgggcaauacagcgacauugaccauaagcagggucgaggccggggacgaggcagauuacuacugccaagucugggacucgagcucagaccaugucguguucggaggagggacaaagcucacggucuuggga

SEQ ID NO: 58673 - RNA, 741 nt, Artificial Sequence
  derived and/or modified sequence opt11 from anti-influenza_Chain
caaaugcaacucguccaauccggcgccgaagucaaaaaacccggcagcuccguaaaagucuccugcaaagcaucaggaggaaccuucucauccuacgcaauaaccuggguccgacaagcccccggccaaggccucgaauggaugggaggcaucaucggaauguucggcuccaccaacuacgcacaaaacuuccaaggcagaguaaccaucaccgcagacgaaucaaccuccaccgcguacauggaacucagcucacuccgcagcgaagacaccgccgucuacuacugcgcccgcucaaccggcuacuaccccgccuaccuacaccacuggggccaaggcacccucguaaccguauccagcggcaccggcggauccggcggcaccggcagcggcaccggcggcuccacccaauccgcacuaacccaaccacgauccgucuccggcucacccggccaaucagucaccauauccugcacaggcacaagcucagacgucggaggauacaacuacgucuccugguaccaacaacaccccggaaaagcccccaaacuaaugaucuaugacgucagcaaacgccccagcggcgucccagaccgcuucuccggcucaaaauccggcaacaccgccagccuaaccaucuccggccuccaagccgaagacgaagcagacuacuacugcucgagcuacacaucaagcuccacccacgucuucggcaccggcacaaaagucaccguccucggc

SEQ ID NO: 58674 - RNA, 744 nt, Artificial Sequence
  derived and/or modified sequence opt11 from anti-influenza_Chain
gaaguacaacucgucgaauccggcgccgaagucaaaaaacccggcuccuccgucaaagucuccugcaaagcauccggcggccccuuccgcuccuacgccaucagcuggguacgccaagcccccggacaaggccccgaauggaugggcggcaucaucccaaucuucggaaccacaaaauacgcccccaaauuccagggccgcguaaccaucacagccgacgacuucgccggaacagucuacauggaacucuccucacuacgcuccgaagacaccgccauguacuacugcgccaaacacaugggauaccaaguccgcgaaaccauggacguauggggcaaaggcaccaccguaacagucagcagcggcacaggaggauccggcggcaccggcucaggcaccggcggauccacaagcuacguccucacacaaccccccagcgccuccggcacccccggacaacgcgucacaaucuccugcagcggcuccaccuucaacaucggcucaaacgccgucgacugguacagacaacugcccggaacagcccccaaacuccuaauauacuccaacaaccaacgccccagcggaguccccgaccgcuucuccggcagccgcuccggcaccagcgccucccucgccaucuccggccuacaauccgaagacgaagccgacuacuacugcgcagccugggacgacauacucaacguccccgucuucggcggcggcaccaaacucaccguccucggc

SEQ ID NO: 58675 - RNA, 744 nt, Artificial Sequence
  derived and/or modified sequence opt11 from anti-influenza_Chain
caggugcaauugguccagagcggggccgaggucaagaaaccgggcucgagcgugaaagugagcuguaaagcgagcgggggaccguucaggagcuaugccauaagcugggucagacaagcacccgggcaaggucccgaguggaugggagggaucauacccauauucgguaccacaaaauaugccccaaaauuucaaggucgcguaaccauaaccgcggacgacuucgcgggcacggucuauauggaacucucgagcuugcgaucggaagauaccgcgauguauuacugugccaagcacaugggcuaucaagugcgcgagaccauggacgugugggggaaagggaccacgguaacggucucgagcgggaccgggggcucgggcgggaccgggagcgggaccggaggcucgacccagagugcgcucacgcaaccggccgcagucucaggaucacccgggcaaucgaucacgaucucgugcacgggaacaagcucagacguaggaggauacaauuacgugagcugguaccagcaacaccccgggaaagcgcccaagcucaugaucuaugaagugagcaaucgaccgagcggggucucgaacagauucucgggcucgaaaucgggaaauaccgcaagccugaccauaagcgggcuccaggccgaggacgaggccgacuacuauugcucgagcuauacaucgagcucgaccuaugucuuuggcacgggcacaaaagugaccgugcucggg

SEQ ID NO: 58676 - RNA, 744 nt, Artificial Sequence
  derived and/or modified sequence opt11 from anti-influenza_Chain
gaaguacaguugguggagagcggggcagaggugaagaagccggggagcagcgugaaagugaguugcaaggcgaguggagggccguuccggagcuaugcgauaagcugggugaggcaggcaccggggcaggggccggaguggaugggagggauaauaccaauauucgggacgacgaaguacgcgccgaaguuccaggggagggugacgauaacggcggacgacuuugcggggacaguauacauggagcugagcagccugagaagcgaggacacagcgauguacuacugcgcaaagcacaugggguaccaggugagggagacgauggacgugugggggaaggggacgacggugacagugagcagcgggacgggagggagcggagggacggggagugggacgggagggagcacaagcuacgugcuaacgcagccgccgagugugagugggacaccagggcagagggugacaauaaguugcagcgggagcaggaguaacgugggggacaauagcguguacugguaccagcacguaccagagauggcaccgaaauugcugguguacaagaacacgcagaggccaagcggggugccggcaagguuuagcgggaguaagagcggaaccagcgcgagccuagcgauaauagggcugcagagcggggacgaggcagacuacuacugcguggcgugggacgacagcguggacggauacguguucgggagcgggacgaaggugacgguacugggg

SEQ ID NO: 58677 - RNA, 744 nt, Artificial Sequence
  derived and/or modified sequence opt11 from anti-influenza_Chain
gagguccagcucguggaaagcggagcggaagugaaaaagcccgggagcucgguaaaggucucgugcaaggccucgggcgggccauuccgaucguacgcgaucucaugggugcgacaagccccgggccagggcccggaauggaugggaggcauaaucccgaucuuuggcacgaccaaguacgcacccaaguuccagggcaggguuacaauaacggccgaugacuuugccgggacaguguacauggaauugagcucacuaagaagcgaggacacggccauguacuauugcgcgaaacauaugggauaccaggucagggaaacgauggaugucuggggcaagggcacgacagugaccgugagcucgggcacgggcgggagcggaggaacaggcucaggaacgggcgggagcacaagcuauguccugacccagcccccaagcgcaagcgggaccccgggacagcgcgugacaauaagcuguagcggaagcucgagcaacaucgggagcaauuacguguacugguaccagcaauugccagggacagcgccaaagcuacugauauaucgcgauggacagcgcccgagcggggucccggacagguucucgggcucgaaaucgggcacgagcgcgagcuuggccauaagcgggcuaaggagcgaugaugaggccgauuacuacugcgcgaccugggacgauaacuugagcggacccguguucgggggcgggaccaagcucacggucuugggc

SEQ ID NO: 58678 - RNA, 744 nt, Artificial Sequence
  derived and/or modified sequence opt11 from anti-influenza_Chain
gaagugcaacuggucgagagcggggcagaaguaaagaaaccgggcucaagcgugaaaguaagcugcaaagcgagcgggggcacauucucguucuacagcaugagcuggguaaggcaagcacccgggcaagggcucgaguggaugggcgggaucauacccauguucgggacaacaaacuacgcccagaaauuccaagggcgagugacaauaaccgcgguagagagcacgagcacggccuauauggagguaucgagcuugcgcucggaagauaccgcggucuauuacugcgccagaggcgauaaagggaucuacuacuauuacauggacguaugggggaaagggaccacggucacggucucgagcggaaccgggggaucgggcggaaccgggagcgggaccgggggaucgacccagagcgcgcucacacaaccagccucgguaucgggaucgcccggacaauccauaacgauaucaugcacaggcacgagcucggacgugggaggguacaacuacgugagcugguaccagcaacacccagggaaagcgccaaagcuaaugaucuaugaagugaguaaccgcccgagcgggguaucgaaccgguucucaggcucaaaaucgggcaauacagcgagccugaccauaagcgggcuccaggccgaggacgaggcagauuacuauugcucgagcuauacaucaagcucgaccuuggucuuuggcacgggcacgaaagugaccgugcucggg

SEQ ID NO: 58679 - RNA, 744 nt, Artificial Sequence
  derived and/or modified sequence opt11 from anti-influenza_Chain
augagccucuucggcgauaccauagccuaccuccuaucgcuaaucgaggacggggaagggaaagcggaacuggccgagaaacuacacuguugguucggcgggaaagaguucgaccucgacagcgcacucgaguggaucaaaaacaaaagguguuuaaccgacauacagaaagcgcuaauaggcgcgagcauaugcuuccucaagcccaaagaccaagaaaggaaaaggcgcuuuaucacagaaccgcucucaggaaugggcacgaccgcgaccaagaagaaaggccuaauacuggccgagcgcaaaaugagacgaugcgucuccuuccacgaagcguucgagaucgcagaagggcacgagagcucagcccugcucuacugcuugauggugauguaccucaaccccgagaacuacagcaugcaagugaaauugggcacgcucugcgcccuaugcgagaaacaggcaucacacucgcacagggcccacagcagggccgcgcgcucaagcgugcccggggucaggcgcgagaugcaaauggugagcgcgaugaacaccgcgaaaacgaugaacggcaugggcaagggagaggacgugcaaaagcucgcggaggaacuccagaacaauaucgggguacugcgcucgcucggggccucacaaaagaacggggaagggaucgcgaaagacgucauggaaguacucaaacaaucgagcaugggcaacagcgcgcucgugcgcaaguacuua

SEQ ID NO: 58680 - RNA, 747 nt, Artificial Sequence
  derived and/or modified sequence opt11 from anti-influenza_Chain
gaaguccaacucguggaaucaggagcggaagugaaaaagcccggaagcucgguaaaggucucaugcaaggccucgggcgggcccuuccgcucauacgcaauaucaugggugcgccaagccccaggccagggaccagaauggaugggagggauaaucccgaucuucggcacaacaaaguacgcgcccaaauuccaaggcagggucacaaucacagccgacgacuucgccgggaccguauacauggaacuaagcucccucaggagcgaggacacagccauguacuacugcgcaaaacacaugggguaccagguccgggaaacgauggacgucuggggcaaaggcacaaccguaacagucagcucgggcacaggcggaagcggaggcacaggcucgggcacaggcgggagcacacaaucgguccugacccaaccaccgagcguaagcgcagcaccgggccagaaagucaccauaagcugcuccggaagcucguccaacaucgggaacgacuacgugagcugguaccagcaacuacccggaaccgcgcccaaacuccuaaucuacgacaacaacaagcgcccgagcggaaucccagacagauucucaggcucgaaaucaggaacaagcgcaacccugggaauaacaggacuccagacaggagacgaggccaacuacuacugcgccaccugggacagacgaccgacagcauacguggucuucggaggaggcacaaaacuaacagugcuagga

SEQ ID NO: 58681 - RNA, 750 nt, Artificial Sequence
  derived and/or modified sequence opt11 from anti-influenza_Chain
cagguccagcucguacaaucgggcgcggaagugaagaaacccgggagcucggucagagucucgugcaaagcaucgggcucgauauuucgaaauuacgcgaugucgugggugcgccaggcaccgggccagggccuggaauggaugggagggauaauagcgaucuucggcacgcccaaguacgcgcaaaaguuccagggcagagucacgaucacagcagacgaaucgaccucgaccguguacauggaauugagcgggcuaaggagcgaggacacggcaauguacuauugcgcgcgcauaccccauuacaauuucgggagcgggaguuauuucgauuacuggggccagggcacgcuagugaccguaagcucgggaacgggagggagcgggggaacgggcucgggcacgggcgggagcacgaccguacucacgcaaccacccucggucucgggagcgccagggcaaagagucacgaucucgugcacgggcucgagcucgaacauaggagcgggcuaugacgugcacugguaccaacaauuacccgggaccgcgccaaagcuauugauauauggcaauagcaaccgcccgagcggggucccggacagguucucaggcucaaaaucgggaacgagcgcuaccuugggcauaaccgggcugcagacaggggacgaggccgauuacuauugcgggaccugggacucgagcuugagugcguacguguucgggaccgggacaaaggucacaguccugggc

SEQ ID NO: 58682 - RNA, 756 nt, Artificial Sequence
  derived and/or modified sequence opt11 from anti-influenza_Chain
gagguacagcucguggaaucaggcgcggaagucaaaaagcccggaagcucgguaaagguaucaugcaaggcaucgggacauauauuuagcggguacgcgaucucguggguacgacaagccccgggccagggauuggaauggaugggcgggauaaucccgaucuuuggcacgaccaauuacgcacaaaaauuccagggcagggucacgaucacagccgaucaaucgaccucgaccgcauacauggacuuaagcaaucuaaggagcgaagacacggccguguacuauugcgcacgagugaaagacggauauugcacgcuuacgagcugucccgugggcugguacuuugacuugugggggcgcgggacauuggucacggucucgagcgggaccgggggcucgggcgggaccgggagcgggaccgggggcucaaccgagauagugaugacgcaaucgcccgggacccugagcuuaagcccgggcgagcgcgcgaccuugagcugucgagcaagccagagcgucagcucgagcuaccucgcgugguaucaacagaaaccaggccaggccccgcgcuuacucauauucggggcaucgagcagagcaacgggcauacccgaucgauuuagcgggagcggaagcgggaccgauuucacgcuaacgauaucgcgccuggaaccggaagacuucgcgguauauuacugccaacaguacgggagcucgcucacguucggaggcgggaccaagcucgagaucaagcgc

SEQ ID NO: 58683 - RNA, 768 nt, Artificial Sequence
  derived and/or modified sequence opt11 from anti-influenza_Chain
caaguacaacucguccaaagcggcgccgaagucaaaaaacccggaucauccgucaaagucucaugcaaagccucaggaggcuucuucuccagcuacgccaucucauggguacgccaagcccccggccaaggccucgaauggaugggcggcguaauacccauauuccgcaccgcaaacuacgcccaaaacuuccaaggacgagucacaaucaccgccgacgaauucaccuccuacauggaauuauccucccucagauccgacgacaccgccgucuacuacugcgcacgccucaacuaccacgacuccggcaccuacuacaacgccccccgcggcugguucgaccccuggggacaaggaacacucgucacaguauccuccggaaccggcggcucaggcggaaccggcuccggcaccggcggcagcaccgacauccaaaugacccaaucacccgacucccucgccgucucccucggcgaaaaagccacaauaaacugcaaaucaucacaauccauccuaaacuccuccaacaacaaaaacuaccucgccugguaccaacaaaaaccaggccaacccccaaaacuccucaucuacugggccuccacccgcgaauccggcguccccgaccgcuucuccggcucaggcuccggaaccgacuucacccuaaccaucuccucccuccaagccgaagacgucgccguauacuacugccaacaauacuacucaucaccccccaccuucggccaaggcacaaaaguagaaaucaaacga

SEQ ID NO: 58684 - RNA, 768 nt, Artificial Sequence
  derived and/or modified sequence opt11 from anti-influenza_Chain
caaguccaacucguccaauccggagccgaagucaaaaaacccgguuccuccgucaaaguaagcugcaaagcaucaggaggcuucuucuccucauaugccaucuccuggguccgccaagcaccaggccaaggccuagaauggauggguggcgucauccccaucuuccgaaccgccaacuacgcccaaaacuuccaaggcagagucaccaucacagccgacgaauucaccuccuacauggaacucucaucccuccgcucagacgacaccgccgucuacuacugcgcccgccucaacuaccacgacuccggcacauacuacaacgccccccgaggcugguucgaccccuggggccaaggcacccucgucaccguauccuccggcaccggcggcucaggcggcaccggcuccggaaccggcggcagcaccgacauccaaaugacccaaucccccgacucccucgccgucucacucggcgaaaaagccaccaucaacugcaaauccucacaauccauccucaacuccuccaacaacaaaaacuaccuagccugguaucaacaaaaacccggccaaccacccaaacuacucaucuacugggccucaacccgagaauccggaguccccgacagauucuccggcucaggcucaggcacagacuucacccucaccaucuccucccuccaagccgaagacgucgccguauauuacugccaacaauacuacuccuccccacccacauucggccaaggcaccaaagucgaaaucaaacgc

SEQ ID NO: 58685 - RNA, 771 nt, Artificial Sequence
  derived and/or modified sequence opt11 from anti-influenza_Chain
aucugcaucggcuaccacgccaacaacuccaccgaacaagucgacaccaucauggaaaaaaacgucaccgucacccacgcccaagacauccucgaaaaaacccacaacggcaaacuaugcgaccucgacggcgucaaaccccuaauucuacgcgacugcuccgucgccggcuggcuccucggaaacccaaugugcgacgaauucaucaacguacccgaaugguccuacaucgucgaaaaagccaaccccgccaacgaccucugcuaccccggaaacuucaacgacuacgaagaacucaaacaccuccucucccgcaucaaccacuucgaaaaaauacaaaucauccccaaauccuccugguccgaccacgaagccuccuccggcgucagcuccgccugccccuaccaaggcacccccuccuucuuccgaaacguagucuggcucaucaaaaaaaacaacaccuacccaaccaucaaacgaagcuacaacaacaccaaccaagaagaccuccuaauacucuggggcauccaccacucaaacgacgccgccgaacaaaccaaacucuaccaaaacccaaccacauacaucagcgucggcaccagcacacucaaccaacgccucguccccaaaauagccacccgcuccaaagucaacggccaaaacggccgcauggacuucuucuggaccauacucaaacccaacgacgccaucaacuucgaauccaacggaaacuucaucgcccccgaauacgccuacaaaaucgucaaaaaa

SEQ ID NO: 58686 - RNA, 771 nt, Artificial Sequence
  derived and/or modified sequence opt11 from anti-influenza_Chain
aucugcaucggcuaccacgccaacaacuccaccgaacaagucgacaccaucauggaaaaaaacguaaccgucacccacgcacaagacauacucgaaaaaacacacaacggcaaacucugcgaccucgacggagucaaaccccucauacuccgcgacugcucagucgccggcuggcuccucggcaaccccaugugcgacgaauucaucaacguccccgaaugguccuacaucgucgaaaaagccaaccccgccaacgaccucugcuacccuggcaacuucaacgacuacgaagaacucaaacaccuccucucacgcauaaaccacuucgagaaaauccaaaucauccccaaauccuccugguccgaccacgaagccucauccggcgucucaucagcauguccauaccagggcaccccauccuucuuccgcaacguagucuggcucaucaaaaaaaacaacaccuaccccaccauaaaacgcuccuacaacaacaccaaccaagaggaccuccuaauacucuggggcauccaccacuccaacgacgccgccgaacaaaccaaacuauaccaaaaccccaccaccuacaucuccgucggcaccucuacccucaaccaacgccucguccccaaaaucgccacccgcuccaaaguaaacggacaaaacggccgaauggacuucuucuggaccauccucaaacccaacgacgccaucaacuucgaauccaacggcaacuucaucgcccccgaauacgccuacaaaaucguaaaaaaa

SEQ ID NO: 58687 - RNA, 777 nt, Artificial Sequence
  derived and/or modified sequence opt11 from anti-influenza_Chain
auggucaaauccaaauaccucgucuucaucucaguauucucccuccucuucggcgucuucguagucggauucucacaccaaggcgucaaagccgaagaagaacgccccaugggaaccgccuucuacgaaucauucgacgccuucgacgacgaacgcugguccaaagccggcgucuggaccaacggccaaauguucaacgccaccugguaccccgaacaagucaccgccgacggccucaugcgccucaccaucgccaaaaaaaccaccuccgcccgcaacuacaaagccggagaacuccgcaccaacgacuucuaccacuacggccuauucgaaguaucaaugaaaccagccaaagucgaaggcaccgucuccucauucuucaccuacaccggagaaugggacugggacggcgaccccugggacgaaaucgacaucgaauuccucggcaaagacaccacccgaauccaauucaacuacuucaccaacggcgucggcggcaacgaauucuacuacgaccucggcuucgacgccuccgaaucauucaacaccuacgccuucgaauggcgcgaagacuccaucaccugguacguaaacggcgaagccguccacaccgccacugaaaacaucccccaaaccccccaaaagaucaugaugaacuuauggcccggcgucggcgucgacggcuggaccggagucuucgacggcgacaacaccccagucuacucauacuacgacuggguccgcuacacaccccuccaaaacuaccaaauccaccaa

SEQ ID NO: 58688 - RNA, 777 nt, Artificial Sequence
  derived and/or modified sequence opt11 from anti-influenza_Chain
augguaaaauccaaauaccucgucuucauaagcgucuucagccuccucuucggaguauucgucguaggcuucagccaccaagggguaaaagccgaagaagaacgccccaugggcaccgcauucuacgaauccuucgacgccuucgacgacgaacgcuggucaaaagccggcgucuggaccaacggacaaauguucaacgccaccugguaccccgaacaagucaccgccgacggccucaugcgccucaccaucgccaaaaaaaccaccucagccagaaacuacaaagccggcgaacuccgcaccaacgacuucuaccacuacggacucuucgaagucuccaugaaaccagcaaaagucgaaggcaccgucuccuccuucuucacauacaccggagaaugggacugggacggcgacccaugggacgaaaucgacaucgaauuccucggcaaagacaccacccgaauacaauucaacuacuucaccaacggcgucggaggcaacgaauucuacuacgaccuaggcuucgacgccucagaaucauucaacaccuacgccuucgaauggcgagaagacuccaucaccugguacguaaacggcgaagccguacacaccgccaccgaaaacaucccccaaacgccccaaaaaaucaugaugaaccucuggcccggcgucggcguagacggauggaccggaguauucgacggcgacaacacccccgucuacagcuacuacgacuggguccguuacacaccccugcaaaacuaccaaauccaccaa

SEQ ID NO: 58689 - RNA, 783 nt, Artificial Sequence
  derived and/or modified sequence opt11 from anti-influenza_Chain
gauauccagaugacgcaaucacccucgagcgugagugcgagcgugggcgauagaguaaccauaaccugccgagcaagccaggacauaagcacgugguuggcuugguaccagcaaaagcccgggaaagcaccaaagcuccugaucuaugccgcaagcucacuccagagcggggucccgagcagguucucgggaucgggcucgggcacagacuuuacccugaccauaagcucgcuccagccugaggacuuugcaacguacuuuugccagcaagcgaacucauucccgcccacguucggaugcgggaccaagcuagagaucaaaggagggggaggaagcggaggcgggggcucgggcgggggcgggagcggaggcggaggcucagaagugcaauuggucgugagcgggggcgggcucgugaaaccgggcgggagcuugcgcuugagcugugccgcgagcggacuaucguuccugaacgcauggaugagcugggucagacaagcacccgggaaaugucucgagugggugggcaggaucaagagcaauaccgauggcgggaccacggacuacgccgcacccgugaaagggcgcuuuagcauaagcagggacgauagcaaaaacaugcucuuucuccauaugagcucauugcgcacggaagauaccgcggucuacuacugcgcaacagacgggcccuauagcgaugacuuucgcucgggcuaugccgcgcgcuaucgcuauuucggaauggacgucuggggccagggcacgaccguaaccgugaguuca

SEQ ID NO: 58690 - RNA, 783 nt, Artificial Sequence
  derived and/or modified sequence opt11 from anti-influenza_Chain
gauauccaaaugacacaaucgcccucgagcguaagugcgagcgugggcgaucgcgugaccauaaccugucgagcgagccaggacauaagcacguggcuggccugguaccagcaaaagcccgggaaagcgcccaagcuccugaucuaugccgcgagcucacuccagagcggggucccaagcagguucucgggcucgggcucaggcacggacuuuaccuuaacaauaagcucgcuccagcccgaggacuuugccacguacuucugccagcaagcgaacucguucccgcccacguucggaugcgggaccaagcucgagaucaagggagggggcggaagcgggggagggggcucgggagggggcgggagcgggggcgggggaucggaaguacaacuggucgugagcgggggcggacucgugaaaccgggcgggagccugcgcuuaagcugugccgcaagugggcuuucguuccugaacgcguggaugagcugggucaggcaagcgcccggaaaaugccuagagugggugggcaggauaaagagcaacaccgauggcgggaccacggacuaugccgcgcccgugaaagggcgauucagcauaagcagggacgauagcaagaacaugcucuuucuccauaugucgagcuugcgcacggaagauacagcggucuacuacugcgccacggacggacccuauagcgaugacuuuagaucaggcuaugccgcgcgcuaucgcuauuucgggauggaugucuggggccagggcacgaccgugaccgugagcucg

SEQ ID NO: 58691 - RNA, 789 nt, Artificial Sequence
  derived and/or modified sequence opt11 from anti-influenza_Chain
augggauucguccucuucucacaacuccccucauuccuccucgucucuacccuccuccuauuccucgucaucagccacuccugccgcgcccaaaacggcggcagcuaccccuacaaaucuggcgaauacagaaccaaaagcuucuucggcuacggcuacuacgaaguccgcaugaaagccgccaaaaacgucggcaucgucuccagcuucuucaccuacaccggccccuccgacaacaacccaugggacgaaaucgacaucgaguuccucggcaaagacaccaccaaaguccaauucaacugguacaaaaacggcguaggcggcaacgaauaccuacacaaccuaggcuucgacgccucccaagacuuccacaccuacggcuucgaauggcgccccgacuacaucgacuucuacgucgacggcaaaaaaguauaccgcggcacccgcaacauccccguaacccccggcaaaaucaugaugaaccucuggcccggcaucggcguagaugaauggcucggcagauacgacggcagaaccccacuccaagcagaauacgaauacgucaaauacuacccaaacggccgauccaaacucgucgucaacacacccuucgucgccgucuucuccaacuucgacagcucccaaugggaaaaagcagacugggccaacggaagcgucuucaacugcgucuggaaacccucacaagucaccuucuccaacggcaaaaugauccucacccucgaccgcgaauacgucgaccaccaccaccaucaccacaaagacgaacuc

SEQ ID NO: 58692 - RNA, 789 nt, Artificial Sequence
  derived and/or modified sequence opt11 from anti-influenza_Chain
augggauucguccucuucagccaacucccaucauuccuacucgucuccacccuccuccucuuccucgucaucucccacuccugccgcgcccaaaacggcggcuccuaccccuacaaauccggcgaauaccgcacaaaaagcuucuucggcuacggcuacuacgaaguccgcaugaaagcagccaaaaacgucggcaucguauccucauucuucacuuacaccggacccuccgacaacaaccccugggacgaaaucgacaucgaauuccucggcaaggacaccaccaaaguucaauucaacugguacaaaaacggcguaggcggcaacgaauaccuccacaaccucggcuucgacgcaucccaagacuuccacaccuacggcuucgaauggcgacccgacuacaucgacuucuacgucgacggcaaaaaagucuacagaggcacccgcaacaucccagucacccccggcaaaaucaugaugaaccucuggcccggcaucggcgucgacgaauggcucggccgcuacgacggccgcaccccacuccaagccgaauacgaauacguaaaauacuaccccaacggccgcuccaaacuugucgucaacacacccuucgucgccgucuucuccaacuucgacuccucccaaugggaaaaagccgacugggcaaacggaucagucuucaacugcgucuggaaaccaucccaagucaccuucuccaacggcaaaaugauccucacccucgaccgcgaauacgucgaccaccaccaccaccaccacaaagacgaacuc

SEQ ID NO: 58693 - RNA, 840 nt, Artificial Sequence
  derived and/or modified sequence opt11 from anti-influenza_Chain
auggcccaagucggacgcggcgccucaccccucucccgcgcacgagucccuccccucccccacccccuagacggcgaacaccucccccacgaucccgcaggcggcggccacggcaaagccuccucccaagacgcacccgucggccaacuccccggccaccuagcccgcccagccuucuuccacuaccugaaaaacucauuccucgucugcucacuuaccaccgucuucgcacucgcagucgccaccuucgccggcuacgcucucgcccgcuuccguuuccccggcgccgaacucuucggcggcucaguacucguuacccaagucaucccaggcauccuuuuccuaauccccaucuacaucauguacaucuacguccaaaacuggguccgcuccgcccuuggccucgaaguacgccuggucggcuccuacggcggccucguauucacuuacaccgccuucuucgucccccucuccaucuggauacuucgcggcuucuucgccuccauucccaaagaacucgaagaagccgccauggucgacggcgccacccccuuccaagccuuccaccgcgucauccucccccucgcacuccccggccucgccgccacagccgucuacaucuuccucaccgccugggacgaacuccucuucgcccaaguccuaaccaccgaagccacagccaccguccccguaggcauccgaaacuucgucggcaacuaccaaaaccgcuacgaccuuguaauggccgccgccaccgucgccacccuccccguccuugucuuauucuucuucguccaacgccaacucauacaaggacucaccgcaggagcugucaaaggc

SEQ ID NO: 58694 - RNA, 840 nt, Artificial Sequence
  derived and/or modified sequence opt11 from anti-influenza_Chain
auggcccaagucggccgcggagccucaccccuaucccgcgcccgcguaccaccccucccccacccccucgacggcgaacaccucccccacgaccccgcaggcggcggccacggcaaagccucaucucaagaugcccccgucggccaacuaccaggccaccucgcccgcccagccuucuuccacuaccucaaaaacuccuuccucgucuguucccucacuacaguauucgcccucgccgucgccaccuucgccggcuacgcccucgcccgcuuccgauuccccggcgccgaacucuucggcggcuccguccuagucacacaagucaucccaggcauccucuuccucaucccaauuuacaucauguacauauacguccaaaacuggguccgaucugcacucggccucgaaguacgccucguaggcuccuauggcggacucgucuucaccuacaccgccuucuucgucccacuauccauauggauccuccgaggcuucuucgccucaaucccaaaagaacucgaagaagccgcaauggucgacggcgccacccccuuccaagccuuccaccgcgucauccucccccuagcccuccccggacuugccgcaaccgccgucuacaucuuccucaccgccugggacgaacuccucuucgcacaaguccuaaccacugaagccaccgccaccguccccgucggaauccgcaacuucguaggcaacuaccaaaaccgauacgaccucgucauggcagccgccaccguagccacacuccccguccucguccuauucuucuucguccaaagacaacucauccaaggccucaccgccggcgccgucaaaggc

SEQ ID NO: 58695 - RNA, 843 nt, Artificial Sequence
  derived and/or modified sequence opt11 from anti-influenza_Chain
auggccgacaacaugaccaccacccaaaucgaagucggccccggggccacaaacgccacaauaaacuucgaagccggcauccucgaaugcuacgaacgcuucucguggcaacgcgcacucgacuacccaggccaagaccgacuacaccgccuaaaacgcaaacuggaaagccgaaucaaaacacacaacaaaucagaacccgaaaacaaacgaaugucccucgaagaacgcaaagcaauaggcgucaaaaugaugaaaguccugcuauucauggacccaagcgcaggcauagaaggcuucgaaccauacugcguaaaaaaccccucaaccagcaaaugccccaacuacgacuggacagacuaccccccaacacccggcaaauaccucgacgacaucgaagaagaacccgaaaacguagaccaccccauagaaguuguccuccgcgacaugaacaacaaagacgcccgccaaaaaauaaaagacgaaguaaacacacaaaaagaaggaaaauuccgacuaaccaucaaaagagacauccgcaacguccuaagccuccgaguacucgucaacggaaccuuccuaaaacacccaaacggagacaaaagccuaagcacccuccaccgccuaaacgcauacgaccaaaacggcggccucguagccaaacucguagccacagacgaccgcaccgucgaagacgaaaaagacggacaccgcauacucaacagccuauucgagcgcuucgacgaaggccacagcaaacccauccgcgccgccgaaaccgccgucggaguccucagccaauucggacaagaacaccgccuauccccagaagaaggcgacaac

SEQ ID NO: 58696 - RNA, 843 nt, Artificial Sequence
  derived and/or modified sequence opt11 from anti-influenza_Chain
auggccgacaacaugaccacaacccaaaucgaagucggacccggagccacgaacgcaaccauaaacuucgaagcaggcauccucgaaugcuacgaaagauucucauggcaacgcgcacucgacuacccgggccaagacagacuccaccgucuaaaaagaaaacuagaaucgcgaauaaaaacacacaacaaaucagaaccagaaaacaaaaggaugucacucgaagaaagaaaagcaaucggagucaaaaugaugaaaguacuccuguucauggacccaagcgcaggcauagaaggauucgaacccuacugcguaaaaaaccccucgaccucaaaaugcccaaacuacgacuggacagacuaccccccaacccccggcaaauaccuagacgacaucgaagaagaacccgaaaacguagaccaccccauagaaguaguccuacgcgacaugaacaacaaagacgcacgccaaaaaauaaaagacgaaguaaacacacaaaaagaaggaaaauuccgccugaccauaaaaagggacauacgaaacguucucagccuacgcguccucguaaacggaacauuccuaaaacacccgaacggagacaaaagcuuaagcacacuacaccgacuaaacgcauacgaccaaaacggcggacucguagccaaacucguagccacagacgaccgcaccgucgaggacgaaaaagacggccaccgcauacucaacagccuauucgagcgcuucgacgaaggccacagcaaacccauacgcgcagcugagaccgcugucgggguccugagccaauucggacaagagcacaggcucucacccgaagaaggggacaac

SEQ ID NO: 58697 - RNA, 858 nt, Artificial Sequence
  derived and/or modified sequence opt11 from anti-influenza_Chain
auguguaccaugccccugaugaagcuaaagaaaaugaugaggagaacagccuuucucuugagcgugcucauaggcuguagcaugcucgggagcgaucgcucggacaaggcaccgcacugggaauuggucuggagcgaugaauuugacuauagcgggcucccggacccggaaaagugggauuacgacgucgggggacauggcuggggaaaucaagagcuacaauacuauacaagggccaggaucgagaacgcgagagugggcgggggcgugcucauaaucgaggccaggcacgagccauaugaagggcgcgaguauacgagcgcgcgcuuggucacgagagggaaagcgagcuggaccuauggcagguucgagaucagggccaggcucccgagcgggcgcgggaccuggcccgcgauauggaugcugccagaccgacagacauacggaucggcauacuggccagacaauggcgagaucgauaucauggaacauguaggauucaaccccgaugucgugcacgggaccgugcacacgaaagcguacaaucacuugcucgggacccagcgcgggggcucaaucagaguaccgacagcacgcacggacuuucacguguacgcgaucgaguggacgccagaggaaauacgcugguucguggacgauagccuguacuaucgcuuucccaaugaaaggcuaacggacccggaagcggacuggcgacauuggccguucgaucaaccguuccaucucauaaugaauaucgcgguagggggagcauggggcgggcagcaaggggucgauccagaggccuuucccgcgcaacuggucguggacuaugucagggucuauagauggguagag

SEQ ID NO: 58698 - RNA, 858 nt, Artificial Sequence
  derived and/or modified sequence opt11 from anti-influenza_Chain
augugcaccaugccccugaugaagcuaaagaaaaugaugaggcgcacagcauuccuccuaagcguacuaauaggcugcagcaugcucgggagcgaccgaucggacaaggcaccgcacugggaauuggucuggagcgacgaguucgacuacagcgggcuaccggacccagaaaagugggacuacgacgucggaggacacggcuggggaaaccaagaacuccaguacuacaccagggccaggauagaaaacgcgcgcguaggcggaggcgugcuaauaaucgaggcaagacacgagcccuacgaagggcgagaauacaccagcgcgcgcuuaguaacgagagggaaagcaagcuggaccuacggcagauucgagaucagggcaaggcuaccaagcgggcgcgggaccuggccagcgaucuggaugcugccagaccgccagaccuacggcagcgcauacuggccggacaacggcgaaauagacauaauggaacacgucggguucaacccagacgucgugcacggaacaguacacacgaaagcguacaaccaccuccuggggacccagcgcggaggcucaauccgggucccgacagcgcgcacggacuuccacguguacgcaaucgaguggacacccgaggaaauccgcugguucguggacgacagccuguacuaccgauucccaaacgaaagacucacggacccggaagcggacuggagacacuggccguucgaccaaccguuccaccucauaaugaacaucgcagucgggggagcguggggcgggcagcaaggagucgaccccgaagccuuccccgcgcaacugguaguggacuacguccggguauaccgaugggucgag

SEQ ID NO: 58699 - RNA, 900 nt, Artificial Sequence
  derived and/or modified sequence opt11 from anti-influenza_Chain
aacguacccgaauggagcuacauagucgaaaaagccaaccccgcaaacgaccucugcuaccccggcaacuucaacgacuacgaagaacucaaacaccuucucucacgcaucaaccacuucgaaaagauacaaggcuacauccccgaagcaccccgcgacggacaagccuacguccgaaaagacggcgaaugggugcuccuaucaaccuuccuccgaucagacaaaacccacacaugcccacccugccccgccccagaacuacucggcggccccuccgucuuccucuucccucccaaacccaaagacacccucaugaucucccgcacccccgaaguaaccugcguaguaguagacguaucacacgaagaccccgaaguuaaauucaacugguacguagacggcgucgaaguacacaacgccaaaacuaaaccccgcgaagaacaauacaacuccaccuaccgcgucgucuccguccucaccguccuccaccaagacuggcucaacggcaaagaauacaaaugcaaaguaucuaacaaagcccuccccgcccccaucgagaaaaccaucucaaaagccaaaggccaaccccgagaaccacaagucuacacccucccacccucucgagaagaaaugaccaaaaaccaaguaucccuaaccugccucgucaaaggcuucuaccccuccgacaucgccgucgaaugggaauccaacggccaacccgaaaacaacuacaaaaccaccccucccguccucgacucugacggcucauucuuccucuacuccaaacucacagucgacaaaucucgcuggcaacaagggaacgucuucuccugcuccgucaugcacgaagcccuucacaaccacuacacccaaaaaucccugucccuaucccccgguaaa

SEQ ID NO: 58700 - RNA, 900 nt, Artificial Sequence
  derived and/or modified sequence opt11 from anti-influenza_Chain
aacguacccgaauggucauacaucgucgaaaaagcaaaccccgccaacgaccuaugcuacccaggcaacuucaacgacuacgaagaauuaaaacaccuccucucccgcaucaaccacuucgaaaaaauacaaggcuacaucccagaagccccccgcgacggccaagccuacguccgcaaagauggcgaauggguccuacucucaaccuuccuccgcuccgacaaaacccacaccugcccccccugcccugcacccgaacuccuaggcggccccucugucuuccucuucccacccaaaccaaaagacacccucaugaucucccgcacacccgaagucaccugcgucgucgucgacguaucccacgaagaccccgaagucaaauucaacugguacgucgacggcgucgaaguacacaacgccaaaaccaaaccccgagaagaacaauacaacuccaccuaccgagucgucuccguacucaccguccuccaccaagacuggcuaaacggcaaagaauacaaaugcaaagucucaaacaaagcccuccccgcccccaucgaaaaaaccaucuccaaggcaaaaggacaaccccgagaaccccaaguauacacccucccacccucccgagaagaaaugaccaaaaaccaagucagccucaccugccuagucaaaggcuucuaccccuccgacaucgccgucgaaugggaauccaacggccaacccgaaaacaacuacaaaaccaccccacccguccuggacuccgacggguccuucuuccuauacuccaaacuaaccgucgacaaaucccgcuggcaacaaggaaacgucuucuccugcagcgucaugcacgaagcccuccacaaccacuacacccaaaaaucccuaagccucucgccaggcaaa

SEQ ID NO: 58701 - RNA, 927 nt, Artificial Sequence
  derived and/or modified sequence opt11 from anti-influenza_Chain
auggucaaccgccgcgaccuaauaaaauggucagccgucgcccucggcgccggcgccggccucgccggacccgccccugcagcccacgccgccgaccucgaaugggaacaauacccaguacccgcagcccccggcggaaaccgcucauggcaacuccuacccucccacuccgacgacuucaacuacacaggcaaaccccaaaccuuccgcggccgauggcucgaccaacacaaagacggcuggucaggcccugcaaacucccucuacuccgcccgacacagcugggucgcagacggaaaccucaucguugaaggccgcagagcccccgacggacgugucuacugcggcuacgucaccuccagaacacccgucgaauacccacucuacaccgaaguccucaugcgcgucuccggacuaaaacucucauccaacuucuggcuccuaucacgcgacgacgucaacgaaaucgacgucauagaaugcuacggcaacgaaucacuccacggaaaacacaugaacacagccuaccacaucuuccaacgaaaccccuucacagaacuagcacgaucccaaaaaggcuacuucgccgacggcuccuacggcuacaacggcgaaaccggccaaguauucggcgacggcgccggacaaccccuccuccgcaacggauuccaccgcuacggcguccacuggaucuccgccaccgaauuugacuucuacuucaacggccgccucguccgccgacucaaccgcucaaacgaccuucgcgacccccgcucccguuucuucgaccaaccaaugcaccuuauccuaaacaccgaaucccaccaauggcgcgucgaccgcggcaucgaacccaccgacgcagaacucgccgacccaucaaucaacaacaucuacuaccgcugggucagaaccuaucaagccguc

SEQ ID NO: 58702 - RNA, 927 nt, Artificial Sequence
  derived and/or modified sequence opt11 from anti-influenza_Chain
auggucaaccgccgugaccucauaaaaugguccgccgucgcccucggcgccggagcaggccucgccggacccgcgcccgccgcacacgccgccgaccucgaaugggaacaauacccaguacccgcagcccccggcggcaaccgcagcuggcaacuccugcccucccacucagacgacuucaacuacacaggcaaaccccaaaccuuccgcggccgcuggcucgaccaacacaaagacggcuggucaggccccgccaauucccucuacuccgcccgacacuccugggucgccgacggcaaccucauagucgaaggacgccgagcacccgacggacgaguauacuguggcuacgucaccuccagaacacccgucgaauacccccucuacacugaaguccucaugcgagucuccggacucaaacucuccagcaacuucuggcuacuaucucgcgacgacguaaacgaaaucgacguaaucgaaugcuauggaaacgaaucccuccacggcaaacacaugaacacugccuaucacaucuuccaacgcaacccauucaccgaacuugcacgaucacaaaaaggauacuucgccgacggcuccuacggcuacaacggagaaaccggccaaguauucggugacggcgcaggccaaccccuccuccgaaacggcuuccaccgauacggcguccacuggaucuccgccaccgaauuugacuucuacuucaacggaagauuaguucgccgccuaaaccgcucaaacgaccuccgagacccccguuccagauucuucgaucaaccuaugcaccuaauacuaaacaccgaaucccaccaauggcgaguagaccgcggcaucgaacccacagacgccgaacuagccgaccccuccauaaacaacauauacuaucgcuggguccgcaccuaccaagcuguc

SEQ ID NO: 58703 - RNA, 960 nt, Artificial Sequence
  derived and/or modified sequence opt11 from anti-influenza_Chain
aucuguaucggcuaccacgccaacaacucuaccgaacaagucgauaccaucauggaaaagaacgucaccgucacccaugcccaggacauccucgaaaaaacccacaacggcaaacucugcgaccuagacggcgucaaaccccucauccuccgagacugcuccgucgccggcuggcuccuaggcaauccaaugugcgacgaauucaucaacgucccagaaugguccuacaucgucgaaaaagccaaccccgccaacgaccucugcuacccaggaaacuucaaugauuacgaagaacuaaagcaccuccuaucccgaaucaaccauuucgaaaaaauccaaaucauccccaaauccuccugguccgaccacgaagccuccuccggagucuccuccgcaugccccuaccaaggcacacccuccuucuuccgcaacgucgucuggcucaucaaaaaaaacaacaccuaccccaccaucaaacgcuccuacaacaauacaaaccaagaggaccuccuaauccuauggggaauucaccacuccaacgacgccgccgaacaaacaaagcucuaccaaaaccccaccaccuacaucuccgucggcaccuccacccucaaccaacgacucguucccaaaauagccacccggagcaagguaaacggccaaaacggacgcauggacuucuucuggaccauccucaagccuaacgacgccaucaacuucgaauccaacggcaacuucaucgcccccgaauaugccuacaaaaucgucaaaaaaggcgacuccgcuaucguaaaaucugaagucgaauacggcaacugcaacaccaaaugccaaacccccauaggcgccauaaacuccuccaugcccuuccacaacauccacccccuaaccaucggcgaaugccccaaauacguaaaauccaacaaacucguccucgccaccggccuccgaaacuccccccuc

SEQ ID NO: 58704 - RNA, 960 nt, Artificial Sequence
  derived and/or modified sequence opt11 from anti-influenza_Chain
aucugcaucggauaccacgccaacaacuccaccgaacaagucgacaccaucauggaaaaaaaugucaccguaacacacgcccaagacauccucgagaaaacccacaacggcaaacucugcgaccucgacggagucaaaccccucauccuacgcgacugcuccguagcaggauggcuccucggcaaccccaugugcgacgaauucaucaacguccccgaaugguccuacaucgucgaaaaagccaaccccgccaacgaccucugcuaucccggcaacuucaacgacuacgaagaacucaaacaccuccucuccagaaucaaccacuucgagaagauacaaauaauccccaaaucauccugguccgaccacgaagccuccuccggcgucucaucagcaugccccuaucaaggcacacccuccuucuuccgaaacgucguguggcucaucaaaaaaaacaacacauaccccaccaucaaacgcucauacaacaacaccaaccaagaagaccuccuaauccuauggggcauccaccacucaaacgacgccgccgaacaaaccaaacucuaccaaaacccaacaaccuacaucuccgucggaaccuccacccuaaaccaacgccuaguacccaaaauagccacccgcuccaaagucaacggacagaacggccgcauggacuucuucuggacaauacucaaacccaaugacgccaucaacuucgaauccaacggcaacuucaucgccccagaauacgccuauaaaaucgucaaaaaaggcgacucagcaaucgucaaguccgaaguagaauacggcaacugcaacaccaaaugccaaacccccauaggcgccaucaacuccuccaugcccuuccacaacauacacccccuaacaaucggagaaugccccaaauacgucaaauccaacaaacucguccucgcaaccggacuacggaacuccccccua

SEQ ID NO: 58705 - RNA, 960 nt, Artificial Sequence
  derived and/or modified sequence opt11 from anti-influenza_Chain
aucugcaucggcuaucacgcaaacaacagcaccgaacaagucgacaccaucauggaaaaaaacgucaccgucacccacgcccaagacauccucgaaaaaacacacaacggcaaacuuugcgaccuagacggcgucaaaccccucauccucagagacugcagcgucgccggcuggcuccucggcaacccaaugugcgacgaauucaucaacgucccugaauggucauacauagucgaaaaagccaaccccgcaaacgaucucugcuacccaggcaacuucaacgacuacgaagaacucaaacaccuccuaucccgcauaaaccacuucgaaaaaauccaaaucauccccaaauccuccugguccgaccacgaagcauccuccggcgucuccuccgccugccccuaccaaggcaccccaucauucuuccgcaacgucgucuggcucaucaaaaaaaacaacaccuaccccaccaucaaacgcuccuacaauaacacuaaccaagaagaccuccucauccucuggggaauccaccacuccaacgacgccgccgagcaaaccaagcucuaccaaaacccaacaaccuacaucuccguaggaaccucaacccucaaccaacgacuaguacccaaaauagcaacccgcucuaaagucaacggccaaaacggacgaauggacuucuucuggaccauauuaaaacccaacgaugccaucaacuucgaauccaacgggaacuucauagcacccgaauacgccuacaaaaucguaaaaaaaggcgacagcgccauagucaaauccgaagucgaauacggcaacugcaacaccaaaugccaaaccccaaucggcgccauaaacagcuccaugcccuuccacaacauccacccacucacaaucggcgaaugcccaaaauacgucaagucaaacaaacucguacucgcaaccggccuccgaaacuccccacuc

SEQ ID NO: 58706 - RNA, 978 nt, Artificial Sequence
  derived and/or modified sequence opt11 from anti-influenza_Chain
acacucugcaucggcuaccacgccaacaacuccaccgacacugucgacacaguccuagaaaaaaacgucaccgucacccacagcguaaaccuccucgaagacaaacacaacggaaaacucugcaagcuccgcggugucgccccccuccaccuaggcaaaugcaacaucgcaggcuggauacuaggcaaccccgaaugcgaaagccucagcacagcauccuccugguccuacauaguugaaacauccuccagcgacaacggcaccugcuaccccggcgacuucaucgacuacgaagaacucagagaacaacuauccucagucagcucauucgaacgcuucgaaaucuuccccaaaaccucauccuggcccaaccacgacuccaacaaaggugucacagccgccugcccacacgccggcgccaaauccuucuacaaaaaccucauauggcucgucaaaaaaggaaacucauaccccaaacucuccaaauccuacaucaacgacaaaggcaaagaaguccucguucuauggggcauacaccaccccuccaccuccgccgaccagcaaagccucuaccaaaacgcagacgccuacgucuucguaggcaccucucgcuacucuaaaaaauucaaacccgaaauagccauccgaccaaaaguccgcgaccaagaaggccgcaugaacuacuauuggacccuuguagaacccggcgacaaaaucaccuucgaagccaccggcaaccuugucgucccccgcuacgccuucgccauggaacgagacgccggcagcggcaucaucaucucagacacccccguccacgacugcaacaccacuugccaaacccccaaaggcgccaucaacaccucccuacccuuccaaaacauacaccccauaaccaucggcaaaugccccaaauacgucaagucuaccaaacuacgccuagcaacaggccuccgcaacguccccuccauccaaucccgc

SEQ ID NO: 58707 - RNA, 978 nt, Artificial Sequence
  derived and/or modified sequence opt11 from anti-influenza_Chain
acccucugcaucggcuaccacgccaacaacuccaccgacaccgucgacaccguccucgaaaaaaacgucaccgucacccacucagucaaccuccucgaagacaaacacaacggcaaacuauguaaacuacgcggcguagccccccuacaccucggcaaaugcaacauagccggcuggauccucggcaaccccgaaugcgaaucccucucaacagccuccuccuggagcuacaucguagaaacauccucauccgacaacggcaccugcuaccccggcgacuucaucgacuacgaagaacucagagaacaacuaucaucagucuccucauucgaacgcuucgaaaucuuccccaaaacauccuccuggcccaaccacgacagcaauaaaggcgucacugccgccugcccccacgccggcgccaaauccuucuacaaaaaccuaaucuggcucgugaaaaaaggcaacagcuaucccaaacucuccaaaucuuacaucaacgacaaaggcaaagaaguacucguccuauggggcauccaccaccccuccaccuccgccgaccaacaaucacucuaccaaaacgccgacgccuacguauuugucggcaccucccgcuacuccaaaaaauucaaaccagaaauugccauacgccccaaaguccgcgaccaagaaggccgcaugaacuacuacuggacccucgucgaaccaggcgacaaaaucaccuucgaagccaccggaaaccucgucguaccccgauacgccuucgccauggaacgugacgcaggauccggcaucaucaucuccgacacccccguccacgacugcaacaccacaugccaaacccccaaaggagccaucaacaccucccuccccuuccaaaacauccaccccaucaccaucggcaaaugcccuaaauacgucaaauccaccaaacuccgccuagccaccggccuccgcaacguccccuccauacaaucccgc

SEQ ID NO: 58708 - RNA, 960 nt, Artificial Sequence
  derived and/or modified sequence opt11 from anti-influenza_Chain
aucugcaucggcuaccacgccaacaacuccaccgaacaaguagacaccaucauggaaaaaaacgucacagucacgcacgcccaagacauacucgaaaaaacucacaacggcaaacuuugcgaccucgacggagucaaaccccucauccuccgagacugcuccguagccggcuggcuucucggcaacccaaugugcgacgaauucauaaacguacccgaaugguccuacaucgucgaaaaagcaaaccccgcaaacgaccucugcuaccccggaaacuucaacgacuacgaagaacugaaacaccuccucucccgaaucaaccacuucgaaaaaauccaaaucauccccaaaagcagcuggagcgaccacgaagccuccuccggcguguccuccgccugccccuaccaaggaacccccuccuucuuccgaaacgucgucuggcucauaaaaaaaaacaacaccuacccuaccaucaaacgcuccuacaacaacaccaaccaagaagaccuacucauccucuggggcauccaucacagcaacgacgccgccgaacaaaccaaacucuaccaaaaccccacaaccuacaucuccguaggcaccuccacccucaaccaacgacucguccccaaaaucgccacccgauccaaagucaacggccaaaacggccgcauggacuucuucuggaccauccucaaacccaacgacgccauaaacuucgaauccaacggcaacuucaucgcccccgaauacgccuacaaaaucguuaaaaaaggcgacucagccauagucaaaucagaagucgaauacggcaacugcaacaccaaaugccaaacaccaaucggagcaauaaacuccucuaugcccuuccacaauauacauccacucaccaucggcgaaugccccaaauacgucaaauccaacaagcuaguccuagccaccggccuccgaaauagcccccuc

SEQ ID NO: 58709 - RNA, 990 nt, Artificial Sequence
  derived and/or modified sequence opt11 from anti-influenza_Chain
augugcuccuccaucccaucccuaagagaagucuucgccaacgacuuccgcaucggcgccgcagucaacccagucacccuugaagcccaacaaucacuccucauccgccacgucaacucacucaccgccgaaaaccacaugaaauucgaacaccuacaaccagaagaaggccgcuucaccuucgacauagccaucaaaucauccaccuccccauucuccucacacggcguccgcggccacacccuaguauggcacaaccaaacaccaucaugggucuuccaagauucccaaggccacuucgucggccgcgacguccuccucgaacgcaugaaaucccacaucuccaccgucguccaacgcuacaaagguaaagucuacugcugggacgucaucaacgaagccgucgccgacgaaggcucagaauggcuacgauccuccacuuggagacaaaucauaggcgacgacuucauccaacaggccuuccucuacgcacacgaagccgaccccgaagcccuccuguucuauaacgacuacaacgaaugcuuccccgaaaaacgcgaaaagaucuacacacucgucaaaagccuacgcgacaaaggcaucccaauccacggcauaggcaugcaagcccacuggagccucaaccgccccacccucgacgaaauccgcgccgccaucgaacgcuacgcaucccucggcguaauucuccacaucaccgaacucgacaucuccauguucgaguucgacgaccaccgaaaagaccucgccgcacccacaaacgaaauggucgaacgccaagccgaacgcuacgaacaaaucuucagccucuucaaagaauaccgagacgucauccaaaacgucacauucugggguaucgccgacgaccacaccuggcucgaccacuuccccguccaaggccgcaaaaacuggccccuacucuucgacgaacaacacaaccccaaacccgccuucuggcgagucgucaacauc

SEQ ID NO: 58710 - RNA, 990 nt, Artificial Sequence
  derived and/or modified sequence opt11 from anti-influenza_Chain
augugcuccuccauccccucccuccgcgaagucuucgccaacgacuuccgcaucggcgcagccgucaacccagucacccuagaagcccaacaaucccuucucauccgccacgucaauucccucaccgccgaaaaccacaugaaauucgaacaccuacaacccgaagaaggcagauucaccuucgacaucgcaaucaaaagcucaaccucacccuucucaucccacggcguccgaggacacacccuagucuggcacaaccaaacacccucaugggucuuccaagacucccaaggacacuucgucggcagagacguccuacucgaacgcaugaaaucacacaucuccaccgucguacaacgcuacaaaggaaaggucuacugcugggacguaaucaacgaagccguagccgacgagggauccgaauggcuccgcucaucaaccuggcgccaaaucauuggcgacgacuucauccaacaagcauuccucuacgcccacgaagccgaccccgaagcccuccuauucuacaacgauuacaacgaaugcuucccagaaaaacgcgagaaaaucuacacccucguaaagucccuccgcgacaaaggcauccccauccacggcaucggcaugcaagcccacuggucccuaaaccgccccacccuagacgaaauacgcgccgcaauugaacgcuacgccucccucggagucauccuacacaucacggaacucgacaucuccauguucgaguucgacgaccaccgcaaagaccucgccgcccccaccaaugaaauggucgaacgccaagccgaacgcuacgaacaaaucuucucccuauucaaagaauaccgcgacgucauacaaaacguuaccuucuggggaaucgccgacgaccacaccuggcucgaccacuuccccguacaaggccgcaaaaacuggccccuacucuucgacgaacaacacaacccaaaacccgccuucuggcgaguugucaacauc

SEQ ID NO: 58711 - RNA, 1002 nt, Artificial Sequence
  derived and/or modified sequence opt11 from anti-influenza_Chain
augaaaaaccgcgucaucagccuccucauggccucccugcuccuaguccucagcgucaucgucgcccccuucuacaaagccgaagcagcaaccguaguaaauacccccuucgucgccguuuucuccaacuucgacuccagccagugggaaaaagccgacugggccaacggcucaguauucaacugcguauggaaacccucccaagucaccuucuccaauggcaaaaugauccucacccuagaccgcgaauacggcggcucuuacccauacaaaagcggagaauaccgcacaaaauccuucuucgguuacggcuacuacgaaguccgcaugaaagcagcuaaaaacgucggcaucgucuccuccuucuucaccuacaccggacccuccgacaacaaccccugggacgaaauagacauagaauuucuaggcaaagacaccaccaaaguccaauucaacugguacaaaaacggcgucggcggcaacgaauaccuccacaaccucggcuucgacgccucccaagacuuccacaccuacggcuucgaauggcgcccagacuacaucgacuucuacgucgacggcaagaaagucuaccgaggcacccguaacauccccguaacccccggaaaaaucaugaugaaccucuggccaggcaucggcgucgacgaauggcucggccgauacgacggaagaaccccacuccaagccgaauacgaauacgucaaauacuauccaaacggagucccccaagacaaccccacccccaccccaaccauugcccccuccacacccacaaaccccaaccucccccucaaaggagacgucaacggcgacggccacgucaacagcucagacuacucccuauucaaacgcuaccuucuccgcguuaucgaccgauuccccgucggcgaccaauccgucgcagacgucaaccgagacggacgcaucgacuccacugaccucacgaugcucaaacgcuaccuaauccgcgccauccccagccuc

SEQ ID NO: 58712 - RNA, 1002 nt, Artificial Sequence
  derived and/or modified sequence opt11 from anti-influenza_Chain
augaaaaaccgcgucaucucacuucuaauggccucccuacuccuaguccuauccgucaucguagcccccuucuacaaagccgaagccgccacagucgucaacaccccauucgucgcagucuucucaaacuucgacagcucacaaugggaaaaagccgacugggccaacggaucagucuucaauugcguauggaaaccaucccaagucaccuucucaaacggcaaaaugauccuaacccucgaccgugaauacggaggcuccuaccccuacaaaucaggugaauaccgcaccaaauccuucuucggcuacggcuacuacgaaguccgaaugaaagccgccaaaaacguaggcaucgucucauccuucuucaccuacaccggccccagcgacaacaaccccugggacgaaaucgacaucgaguuccuaggcaaagacaccacaaaaguacaauucaacugguacaaaaacggagucggcggcaacgaauaccuccacaaccuaggcuucgacgcaucccaagacuuccacaccuacggcuucgaauggcgccccgacuacauagacuucuacgucgacggcaagaaagucuaccgaggcacccgaaacauaccaguaaccccaggcaaaaucaugaugaaccucuggcccggaaucggcgucgacgaauggcucggccgauacgacggccgcacaccccuccaagcagaauacgaauacgucaaauacuaccccaacggcgucccccaagacaaccccaccccaacccccaccauugcccccuccacccccaccaaccccaaccucccacucaaaggcgacgucaacggcgacggacacgucaacucauccgacuacucucuauucaaacgcuaccuccuccgcguaaucgaccgauucccagucggagaccaaucagucgccgacgucaaccgcgacggccgcaucgacucaaccgaccuaaccaugcucaaacgcuaccucauccgcgccauaccaucacuc

SEQ ID NO: 58713 - RNA, 1041 nt, Artificial Sequence
  derived and/or modified sequence opt11 from anti-influenza_Chain
aucugcaucggcuaccacgcuaacaacuccaccgaacaagucgacaccaucauggaaaaaaacguaacaguaacacacgcccaagacauucuagaaaaaacccacaacggcaaacucugcgaccucgacggcgucaaaccucucauccuccgagacugcucagucgccggcuggcuccucggaaacccaaugugcgacgaauucauaaacguccccgaaugguccuacauaguugaaaaagcuaaccccgccaacgaccuaugcuacccaggcaacuucaacgacuacgaagaacuuaaacaccuacuaagcagaaucaaccacuucgaaaaaauccaaaucauccccaaaucaucuuggucagaccacgaagcaucaucaggcgucuccuccgcaugccccuaccaaggcacccccuccuucuuccgcaacguagucuggcucaucaaaaaaaacaacacauacccuaccaucaaacgcucauacaacaacaccaaccaggaagaccuccucauccuauggggcauacaccacuccaacgacgccgccgaacaaaccaaacucuaccaaaaccccaccaccuacaucuccgucggcacauccacccucaaccaacggcucguccccaaaaucgccacucgcuccaaagucaacggacaaaacggccgcauggacuucuucuggacuauccuaaaacccaacgacgccaucaacuucgaaagcaacggaaacuucaucgcccccgaauacgccuacaaaaucgucaaaaaaggcgauucggcaaucgucaaauccgaagucgaauacggaaacugcaacaccaaaugccaaacccccaucggcgccauaaacuccuccaugcccuuccacaacauacauccacucacaaucggcgaaugccccaaauacgucaaaucaaacaaacucguccucgccacuggccuccgcaacuccccacucggauacauccccgaagccccccgcgacggccaagcauacgucagaaaagacggcgaauggguccuacuuuccacauuccua

SEQ ID NO: 58714 - RNA, 1041 nt, Artificial Sequence
  derived and/or modified sequence opt11 from anti-influenza_Chain
aucugcauaggcuaccacgccaacaacuccaccgaacaagucgacaccaucauggaaaagaacguaaccguaacccacgcccaggacauacucgagaaaacccacaacggcaaacuaugcgaccucgacggcgucaaaccccuuauucuccgcgacugcuccgucgccggcuggcuccucggcaauccaaugugcgacgaguucaucaacgucccagaaugguccuacaucgucgaaaaagccaaccccgccaacgaccuaugcuaccccggcaacuucaacgacuacgaagaacuaaaacaccuccucucccgaaucaaccacuucgagaaaauccaaaucaucccaaaauccuccuggucagaccaugaagcauccuccggcgucucaagcgccugccccuaccaaggcacccccuccuuuuuccgaaacgucgucuggcucaucaagaaaaacaacaccuaccccaccauaaaacgcagcuacaacaacaccaaccaagaagaccuacucauacucuggggaauccaccacucaaacgacgccgcagaacaaacuaaacuauaccaaaaucccaccaccuacaucuccgucggcaccuccacccucaaccaacgccuugucccaaaaaucgccacccggucgaaaguaaacggccaaaacggccgcauggacuucuucuggaccauccuaaaacccaacgacgccauaaacuucgaauccaacggcaacuucaucgccccagaauacgcauacaaaaucguaaagaaaggcgacuccgccaucgucaaaucagaagucgaauacggcaacugcaacacuaaaugucaaaccccaaucggagccaucaacuccucuaugcccuuccacaacauccauccacucaccaucggcgaaugucccaaauacguaaaaucaaacaaacucguccuagccaccggccuccguaacagcccccucggcuacaucccugaagcaccccgagacggccaagccuacguccgcaaagacggcgaauggguccuccucuccacauucuua

SEQ ID NO: 58715 - RNA, 1047 nt, Artificial Sequence
  derived and/or modified sequence opt11 from anti-influenza_Chain
augaacaucaaaaagacagcagucaaaagugcacucgccguagcagccgcagccgcagcccuaaccacgaacgugagcgcgaaagacuucucgggcgcagaacuguacacacuagaggaaguacaauacggaaaauucgaagccagaaugaaaauggcggcagcgagcggaacagugagcucaauguuccuauaccaaaacggcucagagaucgcagacggcagacccuggguagaaguagacauagaaguccuaggcaaaaacccgggaucauuccaaagcaacauaauaacaggaaaagcaggcgcacaaaagacaucggaaaaacaccacgcaguaagcccggccgccgaccaagcauuccacacauacggacucgaauggacgcccaacuacgugcgcuggacaguagacggacaagaagucagaaaaacagaagggggccaaguaucaaaccuaaccgggacccaaggccuacgcuucaaccuguggucgagcgagagugcagccugggucggccaauucgacgaaagcaaacuaccacuauuccaauucaucaauuggguaaaaguguacaaauacacaccaggacaaggagaaggaggaucggacuucaccuuagacuggacagacaacuucgacacauucgacggcucgcgguggggaaaaggcgacuggacauuugacggcaaccgcguagaccuaaccgacaaaaacaucuacagucgagacggaauguuaauacuagcacuaaccagaaaaggacaagagagcuuuaacggacaaguaccaagggacgacgaaccggccccacaaucgagcucaagcgcacccgcgagcucaagcucagucccggccuccagcucaagcguaccagcaagcucaagcucagcauucgucccgcccagcagcucaagcgcgaccaacgccauacacgggaugaggaccacaccagcagucgcgaaagaacacaggaaccuagucaacgccaaaggagcaaaagucaacccgaacggccacaaaagauaccgagugaacuucgaacac

SEQ ID NO: 58716 - RNA, 1047 nt, Artificial Sequence
  derived and/or modified sequence opt11 from anti-influenza_Chain
gaaguccaacucgucgaauccggaggcggcguaguccaacccggacgcucccuacgccuaucaugcgcagccucaggcuucgccuuccacaaccgcgccaugcacuggguacgccaggcccccggcaaaggccucgaauggguagcccuuaucuacuucgacggauccaaacaauacuacgcagacucagucaaaggccgauucaccauaucccgcgacaacuccaaaaacaccgucuuccuacaaaugaacucacuacgcccagaagacaccgccguauacuacugcgcagucccaggacccaucuucggaaucuuccccccauggagcuacuucgaccacuggggccaaggcauccuugucaccgucagcucggccuccaccaaaggccccuccguguuccccuuagccccauccuccaaaagcaccuccggcggaaccgccgcccuaggcugccucgucaaagacuacuuccccgaacccgucacugucuccuggaacuccggagcccucaccucaggcguccacaccuucccugccguccuacaauccuccggccuuuacucacucuccucagucguuaccguccccucuuccucacucggcacccaaaccuacaucugcaacguaaaccauaaacccuccaacaccaaagucgacaaaaaagucgaacccaaaagcugcgacaaaacccacacaugcccccccugccccgcccccgaacuccucggcggccccuccgucuuccucuuccccccaaaacccaaagauacacucaugaucucccgaaccccagaagucaccugcgucgucgucgacgucucacacgaagaccccgaggucaaauucaacugguacgucgacggaguugaaguccacaacgcaaaaaccaaaccacgcgaagaacaauauaacuccacauacagagucgucuccguccucaccguccuccaccaagacuggcucaacggcaaagaauacaaaugcaaagucuccaacaaagcccuacccgcccccauagaaaaaaccaucuccaaagccaaaggc

SEQ ID NO: 58717 - RNA, 1047 nt, Artificial Sequence
  derived and/or modified sequence opt11 from anti-influenza_Chain
gaaguccaacuugucgaaucaggcggaggcguaguccaacccggccgaucacuccgccucuccugcgcagccucuggcuucgccuuccacaaccgcgccaugcacuggguccgacaagcccccggcaaaggacucgaaugggucgcccuaaucuacuucgacggcuccaaacaauacuacgcagacuccgucaaaggaagauucacaauuucccgagacaacuccaaaaacaccguauuccuacaaaugaacucacuccgcccagaagacaccgccguauacuacugcgccguuccaggccccaucuucggaauauucccucccuggagcuacuucgaccacuggggccaaggcauacuuguaaccguuuccuccgccucuaccaaaggccccucuguauucccacucgcccccuccuccaaauccaccucuggcggcaccgcugcacuuggcugccucgucaaagacuacuuccccgaacccguaaccgucuccuggaacuccggcgcacucaccucaggcguacacaccuuccccgccguccuccaauccagcggacuauacucccucuccucagucgucaccguaccaucuagcucacucggcacccaaaccuacaucugcaacgucaaccacaaacccuccaacaccaaagucgacaagaaaguagaacccaaauccugugacaaaacccacaccuguccacccugccccgcccccgaacuccucggcggccccuccgucuuccuguucccucccaaacccaaagacacccucaugaucucccgcacccccgaaguaaccugcgucguagucgacgucucccacgaagaucccgaagucaaauucaacugguacguagacggcgucgaaguccacaacgccaaaacaaaaccccgcgaagaacaauacaacagcaccuaccguguugucucaguacucacaguccuacaccaagacuggcuaaacggcaaagaauacaaaugcaaaguaucaaacaaagcccuccccgcccccaucgaaaagaccauaucaaaagccaaagga

SEQ ID NO: 58718 - RNA, 1047 nt, Artificial Sequence
  derived and/or modified sequence opt11 from anti-influenza_Chain
augaacaucaagaaaaccgccguaaaaagcgcccuagccgucgccgccgccgcagccgcccucaccaccaacgucuccgccaaagauuucuccggcgccgaacuauacacucucgaagaaguacaauacggaaaauucgaagcccgcaugaaaauggccgccgccucuggcaccgucucuuccauguuccuauaccaaaacggcagcgaaaucgccgacggacgccccugggucgaagucgacauugaaguccuaggcaaaaaccccggcuccuuccaaagcaacauaaucacaggcaaagccggcgcacagaaaaccuccgaaaagcaccacgccgucucacccgccgccgaccaagcauuccacaccuacggccucgaauggacccccaacuacguccgauggacaguagacggacaagaaguccgcaaaaccgaaggcggccaaguaucaaacuuaacaggcacccaaggccuacgauucaaucucuggucauccgaaucagccgcaugggucggccaauucgacgaaagcaaauuaccacucuuccaauucaucaacuggguaaaagucuacaaguacacccccggccaaggcgaaggcggaucugacuucacacucgacuggaccgacaacuucgacaccuucgacggcucacgauggggcaaaggcgacuggacauucgacggaaaccgcgucgaccuaaccgacaaaaacauauacucccgagacggcaugcucauccucgcacucacccgcaaaggccaagaaucauucaacggccaaguaccacgcgacgacgaacccgcaccccaaagcagcuccuccgcccccgccagcuccuccucagucccagcauccucaagcuccguacccgcaagcuccuccuccgccuucgucccacccuccuccuccucagccacgaacgcaauccacggaaugcgaacaacacccgcagucgccaaagaacaccgcaaccucgucaacgcuaaaggagcaaaagucaaccccaacggacacaaacgcuaccgcguaaacuucgaacac

SEQ ID NO: 58719 - RNA, 1161 nt, Artificial Sequence
  derived and/or modified sequence opt11 from anti-influenza_Chain
augaacaaauuccucaacaaaaaguggucccucauccuaaccaugggcggcaucuuccucauggccacccuaucccuaaucuucgccaccggaaagaaagccuucaacgaccaaaccucagccgaagacauccccucccucgcagaagccuucagagacuacuuccccaucggcgcagccaucgaacccggcuacacaaccggccaaaucgccgaacuauacaagaaacacgucaacaugcuagucgccgaaaacgcgaugaaacccgccucccuacaacccaccgaaggcaacuuccaaugggccgacgcggaccgcauaguccaauucgcaaaagaaaacggaauggaacugcgauuccacacucucgucuggcacaaccaaacccccaccggcuucucccucgacaaagaaggaaaacccauggucgaagaaacagacccccaaaaacgcgaagaaaaccguaaacuccuccuccaacgccucgaaaacuacauccgcgccgucguccucagauacaaagacgacaucaaauccugggacguagucaacgaagucaucgaacccaacgaccccggaggcaugagaaacucuccaugguaccaaauaaccggcaccgaguacaucgaagucgcauuccgcgccacccgagaagccggcggcuccgacaucaaacucuacauaaacgacuacaauaccgacgaccccguaaaaagagacauccuguacgaacucguuaaaaaccuccucgaaaaaggcguccccaucgacggaguaggccaccaaacacacaucgacaucuacaaucccccugucgaacgcaucaucgaaagcaucaagaaauucgcaggccuuggccucgacaacaucaucacagaacuggacauguccaucuacuccuggaacgaccgcuccgacuacggcgacucaauccccgacuacauccucacccuccaagccaaacgauaccaagaacuauucgacgcccucaaagaaaacaaggacaucgucucagccguagucuucuggggcauauccgacaaauacuccuggcuaaacggcuucccagucaaacgaaccaacgcaccacuccuuuucgaccgcaacuucaugcccaaacccgccuucugggccaucgucgaccccucccgccucagagaa

SEQ ID NO: 58720 - RNA, 1161 nt, Artificial Sequence
  derived and/or modified sequence opt11 from anti-influenza_Chain
augaauaaauuucucaacaaaaaguggucucucauccucaccaugggcgguaucuuccucauggccacccucucccucaucuucgcaaccggcaagaaagccuucaacgaccaaaccuccgcggaagacauccccucccucgcagaagccuuccgcgacuauuuccccaucggagccgcaaucgaacccggcuacacaacaggacaaaucgcagaacucuacaagaaacacgucaacaugcucguagcagaaaacgccaugaagccugcaucccuccaacccaccgaaggcaacuuccaaugggccgacgccgaccgcaucguccaauucgccaaagaaaacggcauggaacugcgcuuccacacccuagucuggcacaaccaaacaccuacaggauucucacuugacaaagaaggaaaacccauggucgaagagaccgacccccagaaaagagaagaaaacaggaaacuacuccugcaaagacuagagaacuacauccgcgcagucguccuccgcuacaaagacgacaucaaauccugggacgucgucaacgaagucaucgaaccuaacgaccccggcggcaugagaaacagccccugguaccaaaucaccggaacagaauacaucgaagucgccuuccgagcaacccgcgaagccggcggauccgacauuaaacucuacaucaacgacuacaacaccgacgaccccgucaaacgcgacauccuauacgaacuugucaaaaaccuacucgaaaaaggagucccaaucgacggagucggccaucaaacccacaucgacauauacaacccacccgucgaacgcaucaucgaauccaucaagaaauucgccggccucggccuagacaacaucaucaccgaacucgacaugucaaucuacagcuggaacgaccgaucagacuacggagacuccauccccgacuacauucugacucuacaagcaaaacgcuaccaagaacuauucgacgcgcuaaaagaaaacaaagacauagucagcgccgucgucuucuggggcauauccgacaaauacagcuggcuaaacggcuuccccgucaaacgcacaaacgcaccccuccucuucgaccgcaacuucaugcccaagcccgccuuuugggccaucgucgacccaucccggcuccgcgaa

SEQ ID NO: 58721 - RNA, 1221 nt, Artificial Sequence
  derived and/or modified sequence opt11 from anti-influenza_Chain
augcguaacgucgucagaaaaccacuaaccaucggccucgcacucacccuccuacucccaaugggcaugacagccacgucagccaaaaacgccgacagcuacgcaaagaaaccccacaucuccgcccucaacgcaccccaacuagaccaacgcuacaaaaacgaguucaccauaggcgcagccguagaaccguaccaacuacaaaacgaaaaagacguccaaaugcuuaaacgccacuucaacucgaucguagccgaaaacgucaugaaacccaucagcauacaacccgaagaaggcaaauucaacuucgaacaagccgaccguauagucaaauucgcaaaagccaacggcauggacauacgauuccacacccuaguauggcauucccaagucccgcaaugguucuuccuagacaaagaagguaagcccauggucaacgaaacagacccagucaaacgcgaacaaaacaaacagcuccuccuaaagcgccucgaaacacacauaaaaaccaucguagaacgauacaaagacgacaucaaauacugggacgucgucaacgaagucguaggcgacgacggaaaacugcgaaacuccccaugguaccaaaucgcaggcaucgacuacaucaaaguagcauuccaagccgcgcgcaaauacggcggagacaacauaaaacucuacaugaacgacuacaacacagaaguugaacccaaacgcaccgcucucuacaaccucguaaaacaacuaaaagaagagggcguaccaaucgacggaauaggccaccaaucacacauccaaaucggcuggcccuccgaagccgaaaucgagaaaaccauuaacauguucgcugcccucggccucgacaaccaaaucacagaacucgacgucucaauguacggcuggccaccccgcgcauaccccaccuacgacgccauccccaaacaaaaguuccucgaccaagccgcacgcuacgaccgacuauucaaacucuacgaaaaacucucggacaaaaucagcaacgucaccuuuuggggaaucgccgacaaccacaccuggcucgacagccgcgccgacgucuacuacgacgccaacggcaacgucguaguagacccaaacgcgccauacgccaaagucgaaaaaggcaaaggcaaagacgcaccauucgucuucggccccgacuacaaaguaaaaccagcguacugggccaucaucgaccacaaa

SEQ ID NO: 58722 - RNA, 1221 nt, Artificial Sequence
  derived and/or modified sequence opt11 from anti-influenza_Chain
augcgaaacgucguacgcaagccgcuaaccaucggccucgcgcuaacgcuacuccuaccaaugggcaugacagccaccucugcgaaaaacgccgacagcuacgccaagaaaccgcacaucuccgcacuaaacgccccacaacuagaccagcgcuacaaaaacgaguucaccaucggagcagccguggaacccuaccaacuacaaaacgaaaaagacguccaaaugcucaagcgccacuucaacuccauagucgcagaaaacguaaugaagcccaucagcauccaaccggaagaaggcaaauucaacuucgaacaagcagaucgaaucgucaaauucgcaaaagcaaacggcauggacauacgcuuccacacccuagucuggcacagccaagucccccaaugguucuuccucgacaaagaaggaaaacccauggucaacgaaacagaccccgucaagcgcgaacaaaacaaacaacuccuacucaaacgccucgaaacacacaucaaaaccaucgucgaaagauacaaagacgacaucaaauauugggacgucgucaacgaaguagucggagacgacggcaaacuucgcaacagccccugguaccaaauagccggaaucgacuacaucaaaguagccuuccaagcagcccgcaaguacggaggcgacaacauaaaacucuacaugaacgacuacaacaccgaagucgaaccaaagcgcacagcacucuacaaccucgucaaacaacucaaagaagaaggcguccccaucgacggaaucggccaccaaagccacauacaaaucggcuggccgagcgaagccgaaaucgagaaaacaaucaacauguucgccgcacuaggccucgacaaccagaucaccgaacuagacgucucaauguacggcuggcccccaagggccuacccaaccuaugacgccauaccaaaacaaaaguuccuggaccaagccgcacgcuacgaccgucucuucaaacuauaugaaaaacugagcgacaaaauauccaacguaacauucuggggcaucgccgacaaccacaccuggcucgacucccgcgcagacguauacuacgacgccaacggcaacgucgucguagaccccaacgcccccuacgccaaggucgaaaaaggaaaaggcaaggacgccccauucgucuucggcccagacuacaaagucaaacccgcauacugggccauaaucgaccacaaa

SEQ ID NO: 58723 - RNA, 1233 nt, Artificial Sequence
  derived and/or modified sequence opt11 from anti-influenza_Chain
cucucccgcaucaaccacuucgaaaaaauacaaauaauaccaaaaucauccuggagcgaccacgaagccucauccggaguauccagcgccugcccauaccaaggcacccccuccuucuuccguaacguagucuggcuaaucaaaaaaaacaacacauacccaacaaucaaacgcagcuauaacaacaccaaccaagaagaccuccuaauccucuggggcauccaccacuccaacgacgccgccgaacaaacgaaacuguaccaaaacccaaccacauacauauccgucggcacauccacucucaaccaacgccucgucccuaaaaucgcaacgcgcuccaaagucaacggccaaaacggccgcauggacuuuuucuggaccauccuuaaacccaacgacgcaauaaacuucgaauccaacggcaacuucaucgcaccagaauacgccuacaaaaucgucaaaaaaggcuacauccccgaagccccccgcgacggucaggcauacguccgaaaagacggugaauggguccuccucuccacauuucuacgauccgacaaaacccacaccugcccccccugcccagccccggagcuucuaggcggccccuccgucuucuuguucccccccaaaccaaaagacacccuaaugauaucccgcacacccgaagucacaugcgucgucgucgacguaagccacgaagaccccgaaguaaaauucaacugguacgucgacggcguagaaguccacaacgccaaaaccaaaccccgcgaagaacaauacaacuccaccuaccgcgucguuucagucuuaaccguccuccaccaagacuggcuuaacggcaaagaauacaaaugcaaaguaucaaacaaagcccugcccgcccccaucgagaaaacaaucuccaaagccaagggccaaccacgcgaaccccaagucuacacacucccacccucacgcgaagaaaugaccaaaaaccaaguaagucuuaccugccuugucaaaggcuucuaccccuccgacaucgccguugaaugggaaagcaacggccaacccgagaacaacuacaaaaccacgccccccguacucgacucagacggauccuucuuccucuacucuaaacucaccgucgacaaaucccgcuggcaacaagguaacguuuucucaugcucagucaugcacgaagcccugcacaaccauuacacccagaaauccuuaucccuaucccccggcaaa

SEQ ID NO: 58724 - RNA, 1233 nt, Artificial Sequence
  derived and/or modified sequence opt11 from anti-influenza_Chain
cucucacgcaucaaccacuucgagaaaauacaaauaauccccaaaucuagcugguccgaccacgaagccucauccggcguauccuccgccugccccuaccaagguacccccucauucuuccgcaacgucgucuggcuuaucaaaaagaacaacaccuaccccaccaucaaaagauccuacaacaacaccaaccaagaagaccugcucauacucuggggcauacaccacuccaacgacgccgccgaacaaaccaaacuauaccaaaaccccaccaccuacauaagcgucggaacaagcacacuaaaccaacgccuaguccccaaaaucgccacccgcucaaaagucaacggacagaacggccgcauggacuucuucuggacaauccucaaacccaacgacgcgaucaacuucgaauccaacggcaacuucaucgcaccagaauacgcuuacaaaaucgucaagaaaggcuacauccccgaagccccacgcgacggccaggccuauguccgaaaagacggcgaauggguccuccucucaaccuuccuccgauccgacaaaacccacacaugcccacccugccccgcccccgaacuacuuggcggcccaagcgucuuucucuucccacccaaacccaaagacacccuaaugauuucacgaacccccgaaguaaccugcgucgucgucgacgucagccacgaagaccccgaaguaaaauucaacugguacguagacggcgucgaaguucacaacgccaaaaccaaaccccgggaagaacaauacaacucgaccuacagaguagucuccguccuaaccguccuccaucaagacuggcuaaacggaaaagaauacaaaugcaaaguuucaaauaaagcccuccccgcccccaucgagaaaacaaucucaaaagccaaaggacagccgcgcgaaccacaagucuacacccucccacccucccgugaagaaaugaccaaaaaccaagucucccucacaugccucgucaaaggcuucuacccauccgacaucgccgucgaaugggaaucaaacggccaacccgaaaacaacuacaaaaccacuccacccguacucgacucagacggcuccuuuuuccuauacuccaaauuaaccgucgacaaaucacgauggcaacaaggcaacgucuucuccugcuccgucaugcacgaagcccugcacaaccacuacacccagaaaagccucucacucucccccggcaaa

SEQ ID NO: 58725 - RNA, 1293 nt, Artificial Sequence
  derived and/or modified sequence opt11 from anti-influenza_Chain
auggacgaccacgcagaaaaauuccucuggggcguagccaccagcgccuaccaaaucgaaggcgccacccaagaagacggccgaggaccauccauaugggacgccuucgcaagacgacccggcgccaucagagacggcuccacaggcgaaccugccugcgaccacuacagacgcuacgaagaagacaucgcacugaugcaaucacuuggagucagagccuaccgcuucuccgucgccuggcccagaauccugcccgaaggccgaggccguauuaacccaaaaggccucgccuucuacgaccgacucguagaccgccugcuagcgagcgguaucacacccuuccuuacccucuaccacugggaccucccccucgcccuagaagaacgcggaggcuggcgaucccgugaaaccgccuucgccuucgcugaauacgcagaagccguagccagagcccuagccgaccgcguacccuucuuugccacucucaacgaaccauggugcucagccuuccucggccacuggaccggcgaacacgcaccgggacuacgcaaccuagaagccgcccucagagccgcccaccaccuacuucucggccacggucucgcagucgaagcacuccgggccgccggcgcacgacgagucggcauaguccuaaacuucgcucccgccuacggcgaagacccagaagcaguagacguagcagacagguaccacaaccgcuacuuccucgaccccauacucggcaaaggcuaccccgaaucaccuuuccgagacccaccacccguccccauccucucacgagaccuugagcuaguugcaagaccccuugacuuccucggcgucaacuacuacgcccccguccgcgucgccccaggaaccggaacccuaccaguccgcuaccucccacccgaaggccccgccacagccaugggcugggaaguguaccccgaaggccuccaccaccuacuaaaacgacucggccgcgaaguccccuggccacucuacguaaccgaaaacggcgccgccuacccugaccuuuggacaggagaagccguagucgaagacccagaacgggucgccuaccucgaagcccacguugaagccgcccuacgagcccgagaagaaggcguagaccuccgcggauacuucgucuggucccuaauggacaacuucgaaugggcauucggauacacccgccgcuucggacucuacuacgucgacuuccccucccaacgccgcauacccaagcgcucagcccucugguaccgcgaacgaauugcccgagcacaaacc

SEQ ID NO: 58726 - RNA, 1293 nt, Artificial Sequence
  derived and/or modified sequence opt11 from anti-influenza_Chain
augacagaaaacgccgagaaauuccucuggggcguagccaccagcgcauaccaaaucgaaggagccacacaagaagacggccgcggacccagcauaugggacgccuucgcccaacgacccggcgcaauaagagacggcuccaccggagaacccgccugcgaccacuacagacgauacgaagaagacaucgcacucaugcaaucacuaggaguccgcgcauaccgcuucucaguagccuggccacgcauccuacccgagggucgaggcagaaucaaccccaaaggacuagcauucuacgaccgccucgucgaccgacuacucgccagcggaaucacacccuuccuuacccucuaccacugggaccuaccccuggcccuagaagaacgcggcggcuggagaucgagagaaaccgcauucgcauucgcagaauacgcagaggccguagcacgcgcccuggccgaccgagucccauucuucgcaacacuaaacgaaccauggugcucagccuuccucggccacuggaccggcgaacacgccccaggauuacgcaaccucgaggccgcacuccgagccgcccaccaccuccuccuaggccauggccuagcaguagaagcacugcgagcagcaggcgcaagacgaguaggaauaguccucaacuucgcaccagcauacggagaggacccagaagcagucgacgucgcagacagauaccacaaccgauucuuccuagacccaauacuaggaaaaggcuacccagaaagccccuuccgagacccacccccagucccaauccucucgagagaccucgagcuaguagcccgcccccucgacuuccugggugucaacuacuacgcccccgucagagucgcacccggaaccggcacccucccaguacgcuaccucccaccagagggcccagccacggccauggguugggaaguauaccccgaagggcucuaccaccuccuaaaacgacuaggcagagaaguacccuggccccuauacguaaccgaaaacggagccgcauacccggaccuauggacaggcgaagccguggucgaagaccccgaaagagucgcauaccuagaagcccacgucgaagccgcccuacgcgcaagagaagaaggagucgaccuccggggauauuucgucuggucacucauggacaacuucgaaugggcauucggcuacacccgccgauucggccuauacuacguagacuuccccucccaaagacgaauccccaaaagaucagcccucugguaccgcgaacgcauagcccgagcccaaaca

SEQ ID NO: 58727 - RNA, 1293 nt, Artificial Sequence
  derived and/or modified sequence opt11 from anti-influenza_Chain
auggcagaaaacgccgaaaaauuccucuggggcgucgccacaagcgccuaccaaaucgaaggagcaacccaggaagacggucgaggccccagcaucugggacacauucgcacgacgccccggcgccaucagggacggaagcacuggagaaccagcaugcgaccacuaccaccgauacgaagaagacaucgcacuaaugcaaucccucgggguaggcgucuaccgcuucucagucgcauggccacgaauacuacccgaaggacgcggccgcauaaaccccaaaggccuugccuucuacgaccgucuagucgacagacugcuagcagccggcaucacacccuuccucacgcucuaccacugggaccugccucaagcccucgaagaccgcggcggcuggagaagcagagaaacagcauucgccuucgcugaauaugccgaggccgucgccagagcccucgcagacagaguaccauucuuugccacacucaacgaacccuggugcucagcuuuccucggucauuggacaggcgaacacgccccaggccuaagaaaccucgaagccgcucuccgcgccgcacaccaccuccuccucggacacggccucgccgucgaggccuuacgcgccgccggcgccaaacgcgucggcauaguccucaacuucgcaccaguauacggcgaagacccagaagcaguagacguagcggaccguuaccacaacagauacuuccucgaccccauccucggccgcggcuaccccgaauccccauuccaagaucccccgccuacucccaacuuaucccgcgaccucgaacucguggcacgaccccuagacuuuuuaggaguaaacuacuacgccccaguccgcgucgccccugguaccggaccccuccccguacgcuaucuacccccagaaggcccagucacagcgaugggcugggaaguguaccccgaaggccucuaccaccuacucaaaagacuuggacgggaggucccauggccacuguacaucaccgaaaacggagcagcauaccccgaccuauggaccggagaagccgucgucgaagacccagaacgcguagccuaucuggaagcccacguagaagccgcccuacgcgcccgcgaagaaggcgucgaccuccgaggcuacuucguauggucacucauggacaacuucgaaugggcauucggauacacccgccgguucgggcucuacuacgucgacuuucccucacaacgacgaaucccaaaacgcuccgcacuaugguaucgagaacgaauagccagagcacaacuc

SEQ ID NO: 58728 - RNA, 1293 nt, Artificial Sequence
  derived and/or modified sequence opt11 from anti-influenza_Chain
auggacgaccacgcagaaaaauuccucuggggaguagccaccagcgcguaccaaaucgaaggcgccacccaagaagacggcagaggcccaagcaucugggacgcauucgcccggcgcccaggcgcaaucagagacggcuccacaggagagcccgcaugcgaccacuaccgacgauacgaagaagacaucgcacucaugcaaucccucggagucagagccuaccgauucagcguagcauggccacgaauccugccggaaggacgcggcagaaucaaccccaaaggccucgccuucuacgaccgccuagucgaccgacugcucgccagcggaaucacaccauuccucacacuauaccacugggaccuaccccuggcccuagaagaacgagguggcuggcgaucacgcgaaacagcauucgcauucgccgaauacgcagaggccgucgcacgcgcccuagccgaccgcguacccuucuuugcaacauuaaacgaaccuuggugcagcgccuuccucggccacuggaccggggaacacgcccccggccuacgcaaucucgaggccgcacugagggccgcgcaccaccuccuacucggccacggacucgcaguagaagcccuccgagccgccggagcaagacgcgucggcauaguccuaaacuucgcccccgccuauggcgaagacccagaagcagucgacgucgcagaccgcuaccacaacagauacuuccuagaccccauacugggaaaaggcuacccggaaucacccuuccgagacccaccacccguccccauccuaucacgagaucuggagcuaguagcacgcccacucgacuuucuuggagucaauuacuacgcuccagucagagucgcccccggaacaggaacacugcccguacgauaccucccgcccgaaggccccgcaacagccaugggcugggaagucuaccccgaaggacuacaccaccuccuaaaacgccucggaagagaaguccccuggccccucuacgucacagaaaacggcgccgcauauccagaccucuggacaggagaagcagucguagaagaccccgaacgagucgccuaccuggaagcacacguagaagcagcacuacgagcccgcgaagaaggcgucgaccuacgcggcuacuucguauggucacucauggacaacuucgaaugggcauucggcuacacaagacgauucggccucuacuacguagacuuccccucacaacgacgcauacccaaacgaucagcucuaugguacagagaaagaauagcccgggcccaaacc

SEQ ID NO: 58729 - RNA, 1293 nt, Artificial Sequence
  derived and/or modified sequence opt11 from anti-influenza_Chain
augacagaaaacgccgaaaaauuccucuggggcgucgccaccuccgcauaccaaaucgaaggcgcaacacaagaagacggccgcggccccuccauuugggacgccuucgcccaaagaccuggagccauacgcgacggcagcaccggcgaaccagcaugcgaccacuacagaagauacgaagaagacauagcucucaugcaaucccucggaguacgcgcauaccgcuucuccgucgccuggccccgcauccuccccgaaggacggggacgcauaaacccaaagggccuagccuucuacgaccgccuaguagaccgccuccucgcaagcggcaucacaccauuccuaacgcucuaccacugggaccuaccacuggcccuugaagaacgcggcggcuggcgcucccgcgaaacagcauucgccuucgcagaauacgccgaagccguagcacgagcacuugccgaccgaguucccuuuuucgccacccucaacgaacccuggugcucagcauuccucggacacuggaccggagaacacgcccccggccuccgcaaccucgaagccgcccuacgugcagcccaccaccuccuauuaggacacggacuugccgucgaagcccuacgcgcugccggagcacgacgcgucgguaucguccuuaacuucgcuccagccuacggcgaagaccccgaagccguagacgucgccgaccgcuaccacaaccgauucuuccucgaccccauacucgggaaaggauacccagaaucgcccuucagagaucccccacccguacccauccuaucccgcgaccuagagcucgucgcccgcccccucgacuuccucggcgucaacuacuacgcccccguaagagucgcacccggaaccggcacccuccccguccgcuaucucccacccgagggaccagccacggccaugggcugggaaguauacccagaaggacucuaccaccuacucaaacgccucggucgagaagucccauggccccucuacgucacagaaaacggcgccgccuauccagaccuauggaccggcgaagcaguaguagaagaccccgagcgaguugcauaccuagaggcacacguagaagcagcccuaagagcccgagaagaaggcgucgaccuacgaggcuauuucgucuggucacucauggacaacuucgaaugggccuucggcuacacacgccgcuucggacuuuacuacgucgacuucccaucacaacgacgcauacccaaaagaucagccuuaugguaccgagaacgcauagcccgcgcccagaca

SEQ ID NO: 58730 - RNA, 1293 nt, Artificial Sequence
  derived and/or modified sequence opt11 from anti-influenza_Chain
auggcggaaaacgccgaaaaauuccuguggggagucgccacauccgcauaccaaaucgaaggagcaacacaagaagacggccgcggccccagcaucugggacaccuuugcacgccgccccggcgcaauccgcgacggcuccaccggcgaaccagcaugcgaccacuaccaccgcuacgaagaagacaucgcacucaugcaaucccucggcgucggagucuaccgauucuccguagcauggccccgaauccuacccgaaggaagaggccgaaucaaccccaaaggacuugccuucuacgaccgccuuguugaucgccuacucgccgcaggaauaaccccuuuccucacccuauaccacugggacuuaccccaagcacuggaagaccgcggcggcuggcgcagccgcgaaaccgccuucgccuucgcugaauacgccgaagcagucgcccgagcccuagcagacagaguaccauucuucgccacccucaacgagcccuggugcucagccuuccuuggacacuggaccggagaacacgcacccggccuccgaaaccucgaggccgcacuaagggccgcccaccaccuacuccuaggccauggccucgccgucgaagcccuccgagcagccggagcaaaacgcgucggaaucguccuaaacuucgcccccguauacggcgaagacccugaagcagucgacgucgccgacagguaccacaaccgcuacuuccucgacccaauacuaggccgaggauaccccgaaucccccuuccaagauccaccucccacccccaaccucucccgcgaccucgaacuuguagcucggccccucgacuuccuaggcgucaacuacuacgccccagucagagucgcccccggcacaggaccacucccaguccgauaccucccacccgaaggccccguaacggccaugggcugggaagucuacccagaaggccucuaccaccuccuaaaacgccuuggccgcgaagucccuuggccccucuacaucaccgaaaacggagccgcauacccagaccucuggaccggcgaagccgucguugaagaccccgaaagagucgccuaccucgaagcacacguagaagccgcauuacgcgcccgcgaagaaggagucgaccuccggggcuacuucgucuggagccuaauggacaacuucgaaugggccuucggauacacacgacgcuucggccucuacuauguagacuuccccucccaacgcagaauaccaaaacgaucugcccuaugguaccgcgaacgaaucgcccgcgcacaacuc

SEQ ID NO: 58731 - RNA, 1296 nt, Artificial Sequence
  derived and/or modified sequence opt11 from anti-influenza_Chain
auguucaagcccaacuaccacuucuuccccauaaccggcuggaugaacgaucccaacggacugaucuucuggaaaggcaaguaccacauguucuaccaauacaaccccagaaagccagaauggggcaacaucugcuggggacacgccgucucagacgaccucguccacuggcgccaccucccaguagcacuauaucccgacgacgagacccacggcgucuucucgggcucagcaguggaaaaagacggaaaaauguuccucguauauaccuacuaccgagacccaacccacaacaaaggcgaaaaagagacccagugcguggccaugagcgaaaacggacucgacuucguaaaauacgacggaaacccagucaucagcaaacccccagaagagggcacacacgcauuccgggacccaaaaguaaacaggagcaacggcgaguggcgaaugguccucggaagcggaaaagacgaaaagaucggacgcgugcuccuauacacgagcgacgaccuauuccacuggaaauacgaaggugucaucuucgaagacgaaacaaccaaagaaauagaaugcccagaccuaguacgaaucggcgaaaaagacauacuaaucuacagcauaaccucaaccaacagcgugcuauucagcaugggcgaacucaaagaaggaaaacuaaacguagaaaaacgaggacuccuagaccacggcacggacuucuacgcagcacaaaccuucuucgggaccgaccgcguagucgucaucggauggcuacaaucguggcuccgaacgggccuguacccgacaaagcgcgaaggcuggaacggggucaugagccuacccagggaacuauacgucgaaaacaacgaacucaaagucaagcccguagacgaacuccuagcccuacgcaagcgcaaagucuucgaaacagccaaaagcgggaccuuccucuuagacgucaaagaaaacucauacgaaaucgugugcgaguucucaggcgaaauugaacucaggaugggcaacgaaagcgaagaaguagucauaaccaaauccagagacgaacucauagucgacaccacacguagcggcguauccggaggcgaaguccggaaaucaaccguagaagacgaagcaaccaaccgcauccgcgcguuccuagacucgugcagcgucgaguucuucuucaacgacuccaucgcauucucauuccgcauccaccccgagaacguauacaacauccugagugucaaauccaaccaggucaaacuugaaguauucgaacucgaaaacaucuggcuc

SEQ ID NO: 58732 - RNA, 1296 nt, Artificial Sequence
  derived and/or modified sequence opt11 from anti-influenza_Chain
auguucaaacccaacuaccacuucuuccccaucaccggauggaugaacgaccccaacggacugauauucuggaagggaaaguaccauauguucuaccaguacaaccccaggaaaccggaauggggaaacauaugcugggggcacgcggucuccgacgaccucgugcacuggcgacaccucccggucgcgcuauaccccgacgacgaaacccauggcguguucucaggcucggccguagaaaaggacggaaaaauguuccuagucuacaccuacuacagagacccaacccacaacaagggcgaaaaagagacccagugcguagcaaugagcgaaaacgggcucgacuucgugaaauacgacggaaacccgguaauaaguaagccgccugaagagggcacccacgcauucagagacccgaaaguaaacagaagcaacggcgaauggaggaugguucucggaagcgggaaagacgagaagaucggacgcgugcuacuguacaccagugaugaccuguuccacuggaaguacgaaggcgugaucuucgaagacgaaacgaccaaagagauagaaugucccgaccuaguacgaauaggcgagaaagacauccuaaucuacagcaucaccucaaccaacagcguccucuucagcaugggcgagcucaaagaagggaaacugaacguggaaaaacgagggcuccuagaccacggaacagacuucuacgcggcccagaccuucuucggcacagaccgcgugguggugaucggguggcuacaaucguggcuccgcacuggccuguacccgaccaagcgcgaaggcuggaacggggucaugagcuugcccagagaacuauacguggaaaacaacgagcugaaggucaaacccguggacgagcucuuagcacugcgcaagcgcaagguauucgaaacagcaaagagcgggaccuuccuccucgacguuaaagaaaacucguacgagaucguaugugaguucucaggcgaaauagagcuccgaauggggaacgagagcgaggaaguggucaucacaaaaagcagggacgaacuaauagucgacaccacgcgcucgggcguaagcggaggcgaaguaagaaaauccaccguagaagacgaagcaaccaaccgcauccgcgcauuccucgacuccugcucagucgaguucuucuucaacgacagcauagcauucucauucaggauacacccugagaacguguacaacauccuaagcgugaaaucaaaccaaguaaaauuagaagucuucgaacuagaaaauaucuggcuc

SEQ ID NO: 58733 - RNA, 1323 nt, Artificial Sequence
  derived and/or modified sequence opt11 from anti-influenza_Chain
gaagucaaacucguugaauccggaggcggccucguucaacccggaggcagccuccgccuaagcugcgccaccuccggcuucacauucuccgacuacuacauguccuggguacgccaaucccccggaaaagcccucgaaugguuaggauucacccgcucccgaguccucggcuacaccacagacuacuccgccucaguuaaaggccgcuucaccaucucccgcgacaacagccaaagcauccuauaccuacaaaugaacucccugcgcggagaagacagcgccacauacuacugcgcccgagaccgaccuauggacuacuggggccaaggcacauccgucaccguaagcucagccaaaaccaccccacccuccgucuacccccuagccccaggcucagccgcccaaacuaacuccauggucacccucggcugccucgucaaaggauacuucccagaaccggucacugucacauggaacucaggcucucucagcuccggcguccacaccuucccagccguccuacaauccgaccuauacacccuauccagcucagucacgguaccuucuucaaccuggccauccgaaaccguuaccugcaacgucgcucacccagcguccagcacuaaggucgacaagaaaauagucccccgcgacugcgguugcaaacccugcaucugcacuguccccgaggucucaagcguauucaucuucccucccaaacccaaagacguccuaaccauuacucuaacgcccaaaguaaccugcgucgucgucgacaucucaaaagacgacccagaaguccaguuuucaugguucguugacgacguagaaguccacaccgcccaaacccaaccacgcgaagaacaauucaacuccaccuuccguuccgucuccgaacucccaaucaugcaccaagacuggcuaaacggcaaagaauuuaaaugccguguaaacucagccgcauuccccgccccgaucgagaaaacaaucuccaaaaccaaaggccgaccuaaagcgccccaagucuacaccauacccccacccaaagaacaaauggccaaagacaaagucucacuuaccugcaugauaacagacuucuuucccgaagacauaaccgucgaauggcaauggaacggccaacccgccgaaaacuacaaaaacacccaaccaauaauggacaccgacgguaguuacuucguauacuccaaacucaacguacaaaaauccaacugggaagccggcaacaccuuuaccugcucaguacuccacgaaggacuccauaaccaccacaccgaaaaaucccucucacacuccccaggaaaa

SEQ ID NO: 58734 - RNA, 1323 nt, Artificial Sequence
  derived and/or modified sequence opt11 from anti-influenza_Chain
gaagucaaacucgucgaauccggcggcggucucguccaacccggaggcucacuccgccucucaugcgccaccucuggcuucaccuucagcgacuacuacauguccuggguucgccaaucccccggcaaagcccucgaauggcuuggcuucacccgcuccagaguacucggcuacaccacugacuacuccgccuccgucaaaggacgauucacaaucuccagagacaacucacaaucaauccucuaccuccagaugaacucccuuagaggcgaagacuccgccacauacuacugcgcccgcgaccgucccauggacuacuggggccaaggcaccuccgucaccgucuccucagccaaaacaaccccacccucagucuacccccucgcccccggaucagccgcacaaaccaacuccauggugacccuuggaugccucgucaaaggauacuuccccgaacccgucacagucaccuggaacuccggcucccucucauccggcguccacaccuucccagccguccuccaaucagaccucuacacccuauccuccucaguaaccgucccauccagcaccuggcccucagaaaccgucacauguaacgucgcccacccagccucuagcacaaaaguagacaagaaaaucgucccccgcgacugcgguugcaaaccuugcauuugcacaguccccgaaguauccucagucuucaucuucccacccaaacccaaagacguuuuaacaauaacacucacccccaaagucaccuguguagucgucgauaucuccaaagacgaccccgaaguccaauucuccugguucguggacgacgucgaaguccacaccgcccaaacccaaccccgagaagaacaauucaacuccaccuuccguuccguuuccgaacuacccaucaugcaccaagacuggcucaacggcaaagaguucaaaugccgcgucaacucagccgccuuccccgccccaaucgagaaaaccauaucaaaaacaaaaggccgacccaaagcaccccaaguuuauacuauaccaccacccaaggaacaaauggccaaagacaaagucucacucacaugcaugaucacugacuucuuccccgaagacaucacaguagaauggcaauggaacggccaaccugccgaaaacuacaaaaacacucaacccaucauggacacagacggauccuauuucgucuacuccaaacucaacguccaaaaauccaacugggaagccggcaacacauucacaugcucaguacuacacgagggccuccacaaccaccacaccgaaaaaucccuaucacacucucccggcaaa

SEQ ID NO: 58735 - RNA, 1329 nt, Artificial Sequence
  derived and/or modified sequence opt11 from anti-influenza_Chain
gaaguccaacuacaacaaucaggacccgaacucgucaaaccaggcgccucaguaaaaauguccugcaaagcauccggcuacaccuucaccuccuacgucaugcacuggguuaaacaaaaacccggccaaggacucgaauggaucggcuacaucaaccccuacaaugacggcacccgauacaaugaaaaauuccgaguaaaagccacccucaccucagacaaaagcuccucaaccgccuacauggaacucucuagccuaaccucagaagacuccgccgucuacuacugcgcccgccgcggccucaucaccacccccacccucgacuacuggggccaaggcacaacccucaccgucuccuccgcaaaaaccacacccccauccguauacccccuagcccccggcucagcagcccaaaccaacuccauggugacccucggcugccuagucaagggauacuuccccgaacccguuaccguaacauggaacuccggcucacuaagcucaggcguucacaccuuccccgccguacuccaaagcgaccucuacacccuaucaagcuccgucaccguucccuccuccaccuggccaagcgaaaccguaaccugcaacgucgcccaccccgccucaucaacaaaagucgacaagaaaaucgucccccgagacuguggaugcaaacccugcaucugcacaguucccgaagucuccucaguuuucaucuucccacccaaaccaaaagacguucucaccauaacccuaacccccaaaguaaccugcgucguuguugacaucuccaaagaugaccccgaaguccaauucagcugggucgacgacgucgaaguacacaccgcccaaacccaaccccgcgaagaacaauucaacucuaccuuccgauccgucuccgaacuacccauaaugcaccaagacuggcucaacggcaaagaguucaaaugccgcgucaacuccgccgcauucccagccccaauagaaaagaccaucucuaaaaccaagggacgccccaaggccccacaagucuacacgauacccccacccaaagaacaaauggccaaagacaaagucucccuaaccugcaugaucaccgacuucuuccccgaagacauaaccgucgaauggcaauggaacggccaacccgccgaaaacuacaaaaacacacaacccaucauggacaccgacggcagcuacuucgucuacuccaaacuaaacguccaaaaauccaacugggaagcgggcaacacauucacaugcuccguacuacacgaaggccuccacaaccaccacaccgaaaaaucccucucacacucccccggaaaa

SEQ ID NO: 58736 - RNA, 1329 nt, Artificial Sequence
  derived and/or modified sequence opt11 from anti-influenza_Chain
gaaguacaacuccaacaaucaggaccagaacucgucaaacccggcgcauccgucaaaauguccugcaaagccucaggauacaccuucacauccuacgucaugcacugggucaaacaaaaacccggccaaggacuagaauggauaggauacauaaaccccuacaacgacggcacacgcuacaacgaaaaauuccgcgucaaagcgacacuaaccuccgacaaguccucauccaccgccuacauggaacucuccucccuaaccucugaagauagcgccguauacuacugcgcccggcgcggccuuauaaccacacccacccucgacuacuggggccaaggcacaacgcuaaccgucuccuccgccaaaacaacaccacccuccgucuacccccucgcccccggcagcgccgcccaaaccaacuccauggucacccucggcugccucguuaaaggauacuuccccgaaccagucacagucaccuggaacagcggcagccucuccagcggcguccacaccuuccccgcuguucuccaauccgaccucuauacccucuccucaagcguaaccguccccucauccaccuggcccucagaaacagucacaugcaacguagcucacccagcaagcuccaccaaaguagauaagaaaauaguaccacgcgacugcgguugcaaaccaugcaucugcaccguccccgaaguguccuccguauucaucuucccacccaaacccaaagacguucucaccaucacacucacccccaaagucacuugcguagucguagauaucuccaaagacgaccccgaaguccaauucucaugggucgacgacgucgaaguacacaccgcacaaacccaaccccgagaagaacaauucaacagcaccuuccgcuccgucuccgaacuccccaucaugcaccaagacuggcucaacggcaaagaguucaaaugccgggucaacucagccgccuuccccgcuccaaucgaaaagaccaucuccaaaaccaaaggaagaccaaaagcaccccaaguauacaccaucccacccccaaaagaacaaauggccaaagacaaaguaucacucacaugcaugaucaccgacuucuuccccgaagacaucaccgucgaauggcaauggaacggccaaccagccgaaaacuacaaaaacacccaaccaaucauggacaccgacggauccuacuucgucuacuccaaacuaaacguccaaaaauccaacugggaagccggcaacaccuuuaccugcuccguacuccacgaaggucuccacaaccaccacacagaaaaaucccuaucccacucacccggaaaa

SEQ ID NO: 58737 - RNA, 1332 nt, Artificial Sequence
  derived and/or modified sequence opt11 from anti-influenza_Chain
aacguaccagaaugguccuacaucguagaaaaagccaauccagcuaaugaccucugcuaccccggcaauuucaacgacuacgaggaacuaaaacaccuauugucccgcaucaaccacuucgagaaaauccaaauaauccccaaauccuccuggucggaccacgaagccuccuccggcgucagcuccgccugccccuaccaaggcacccccucauucuuccgcaacguagucuggcucaucaagaaaaacaacaccuaccccaccaucaaacgcuccuacaacaacaccaaccaagaagaucuacucauccucuggggcauccaccacucaaacgacgccgccgaacaaaccaaacucuaccaaaacccaaccaccuacauauccgucggaaccucaacccuaaaccaacgccucguacccaaaaucgccacacggagcaaagucaacggccaaaacgggcgcauggauuucuucuggaccauccucaaacccaacgacgccaucaacuuugaauccaacggcaacuucauagcccccgaguacgccuauaaaauagucaagaaaggauacaucccagaagccccacgcgacggccaagccuacguccgcaaagacggcgaauggguccugcucucaaccuuccuccgcucagacaaaacccacacuugcccucccugccccgcccccgaacuccucgggggccccuccgucuuccuauuuccacccaaacccaaagacacccuuaugaucucccgcacccccgaaguaaccugcgucgucguagacguaagccacgaagaccccgaaguaaaauuuaacugguacgucgacggcgucgagguucacaacgcaaaaaccaaaccccgagaagaacaauacaacagcaccuaccgcguagucucaguacucaccguccuacaccaagacuggcucaacggaaaagaauacaaaugcaaagucuccaacaaagcacuccccgccccaaucgagaagaccaucuccaaagcaaaaggacaaccacgcgaaccccaaguuuacacccucccucccucccgcgaagaaaugaccaaaaaccaagucucacugaccugccucguuaaaggauucuaccccuccgacaucgccgucgaaugggaauccaacggccaacccgaaaacaacuacaaaaccacaccacccguccucgacuccgacggcuccuuuuuccucuacucaaaacucaccguagacaaaucacgcuggcaacaaggaaacguuuucuccugcuccgucaugcacgaggcccuacacaaccacuacacccaaaaaucccucuccuuaucacccggcaaa

SEQ ID NO: 58738 - RNA, 1332 nt, Artificial Sequence
  derived and/or modified sequence opt11 from anti-influenza_Chain
aacgucccagaauggucauauaucgucgaaaaagccaacccugcaaacgaccucugcuacccaggcaacuuuaaugacuacgaagaacucaaacaccuccucucacgaauuaaccacuucgagaaaauccaaaucaucccaaaguccuccuggagcgaccacgaagcauccuccggcgucuccucggccugcccauaccaaggcacacccucauucuuccgaaacguaguauggcucaucaagaaaaauaacacauaccccacuaucaaacggagcuacaacaacaccaaccaagaagaccuucucauccucugggguauccaccacuccaacgaugccgccgaacaaacaaaacucuaccaaaaucccaccaccuacaucuccgucggaacuuccacacucaaccaacgacucguaccuaagaucgcuacccgauccaaagucaacggacaaaacggacgcauggacuucuucuggacaauucuuaaaccuaacgacgccaucaauuucgaauccaacggcaacuucaucgcccccgaauacgccuacaaaaucguaaagaaaggcuacauacccgaagcaccccgcgacggccaagccuacguccgcaaagacggcgaauggguccuucucuccacauuccuacguuccgacaaaacccacacaugcccacccugccccgccccugaacuacucgggggcccuucaguauuccuauucccacccaaacccaaagacacacuaaugauaucccgcacccccgaaguaaccugcgucgucgucgacgucagccacgaagaccccgaagucaaauucaacugguacgucgacggcguugaaguacacaacgccaaaaccaaaccccgcgaagaacaauauaacagcaccuaccgcgucgucucaguauuaacuguccuccaucaagacuggcucaacggcaaagaauacaaaugcaaagucucaaacaaagcccuaccagcaccaaucgagaaaaccaucuccaaagccaaaggccagccccgcgaaccacaaguauacacgcucccacccagccgcgaagaaaugaccaaaaaccaaguuucacugacaugccucgucaaaggcuucuaccccucagacaucgccgucgaaugggaaucaaacggccaacccgaaaacaacuacaagaccaccccacccguccucgacuccgauggcagcuucuuccucuacucaaaacuaacaguagacaaauccagauggcaacaaggcaacgucuucucuugcuccguaaugcacgaagcacugcacaaccacuacacucagaaaagccuaucccucucccccggaaaa

SEQ ID NO: 58739 - RNA, 1341 nt, Artificial Sequence
  derived and/or modified sequence opt11 from anti-influenza_Chain
caaguccaacuacaagaaagcggacccggacuugucaaacccagugaaacccuaucacuaaccugcaccgucuccggcggacucauaggcaccgguucauacuacuggggauggauucgccaaacccccggaaaaggcauggaauggaucggcuccaucuccuacuccggcucaaccuacuaccaccccucccucaaaucccgcguaaccauaagcgacgacacauccaaaaaucaacuguuccuaaaacuuagauccgucaccgcagcagacaccgcccaauacuacugcgcgcgcuacaacuggggcauccgauacuucgacuucuggggucgaggcacccuagucaccguauccagcgcauccaccaaaggccccagcguguucccccucgcccccugcucccggagcacuuccgaauccaccgccgcacucggcugccuaguaaaagacuacuuccccgaacccgucaccgucucauggaacucaggcgcccucaccuccggcguacacacuuucccagccguccuucaguccucaggccuauacucacucucauccguagucacaguccccuccagcagccucggcaccaaaacauauaccugcaacguagaccacaaacccuccaacacaaaagucgacaaaaccagagaaucaaaauacggcccacccugccccucuugccccgcacccgaguuccucggcggucccuccgucuuccucuuucccccaaaacccaaagacacccucaugaucucccgcacccccgaaguuaccugcgucgucgucgacgucucucaagaagaccccgaaguacaauucaacugguacgucgacgguguugaaguccacaacgcaaaaacaaaaccgagagaagaacaauucaacucaaccuaccgcgucgucuccguccuaacaguucuccaccaagauuggcucaacgguaaagaauacaaauguaaaguaucaaacaaaggacuccccuccucuauagaaaagaccauaucaaaagcuaaaggccagcccagagaaccccaaguguacacacuaccucccgcccaagaagaaaugaccaaaaaccaagucucccuaaccugccuagucaaaggcuucuaccccuccgacauagcagucgaaugggaaagcaacggccagcccgaaaacaacuacaaaaccaccccgcccguacucgacucagacggcuccuuuuuccucuacucgcgccucaccgucgacaaaucucgcuggcaagaaggcaacgucuucuccugcuccguaaugcacgaagcccuccacaaccacuacacccaaaaaucgcuaucacucucucucgggaaa

SEQ ID NO: 58740 - RNA, 1341 nt, Artificial Sequence
  derived and/or modified sequence opt11 from anti-influenza_Chain
caaguccaacuccaagaaucaggcccaggccucgucaaacccuccgaaacccucucccucaccuguaccgucucaggcggacugaucggcaccggauccuacuacuggggcuggauccgacaaacccccggcaaaggaauggaauggauuggcuccaucuccuacuccggcuccaccuauuaccaccccucccuaaaaucacgugucacuaucucagacgacaccuccaaaaaccaauuauuccucaaacuacgcucagucaccgccgccgauaccgcccaauacuacugcgcccgcuacaacuggggcauccgcuauuucgacuucuggggccguggaacccucgucaccguauccucagcauccaccaaaggccccucagucuucccccucgcacccugcucuagaucaacauccgaauccacagccgcccucggaugccuaguaaaagacuauuucccagaaccugucaccgucuccuggaauagcggcgcacucaccuccggcguucacaccuuccccgcaguccuccaguccuccggccuguauucccucuccuccgucgucaccguaccauccuccucccuaggcaccaaaacauauaccugcaacgucgaccacaaacccuccaacaccaaaguagacaaaacacgagaauccaaauacggcccacccugccccuccugccccgccccagaguuccucggcggccccuccguuuuccucuucccacccaaacccaaagacacccucaugauaucccgcacaccagaagucacaugcguugucgucgacguaucccaagaagacccagaaguucaauuuaacugguacgucgacggagucgaaguccacaaugcaaaaacaaaaccccgagaagaacaauucaacuccacauacagaguagucuccguccugaccguccuccaucaagacuggcucaacggaaaagaauacaaaugcaaagucuccaacaaaggacuccccucauccaucgaaaagaccaucuccaaagccaaaggccaaccacgagaaccccaaguauacacacucccgcccgcgcaagaagaaaugaccaaaaaccaagucucccuaacuugccucgucaaaggcuucuaccccucagacauagccguugaaugggaauccaacggucaacccgaaaacaacuacaaaaccaccccaccaguccucgacuccgacggcuccuuuuuccucuacucgcgacucaccgucgauaaaucccgcuggcaagaaggcaacguauucuccugcuccgucaugcacgaagcccuccacaaccacuacacccaaaaaucccucucccucucacucggcaaa

SEQ ID NO: 58741 - RNA, 1344 nt, Artificial Sequence
  derived and/or modified sequence opt11 from anti-influenza_Chain
gaaguccaacuccaagaauccggccccggccucgucaaacccucccaaacucuaagccuaaccugcaacguauccggcggaucaaucaccggcgacuacaaaugguccuggauccgccaacccccuggcaaaggacuagaauggaucggccacauccacuccaccggcacaacauacuacaaccccucccuacgcucccgcaucacaauaucaauggacacauccaaaaacaaccucucccuccgccucaccucagucaccgccgccgacacagcugucuacuacugcgcuucccacacacucaccagcggacacuacccucgcgacuucgacuucuggggccaaggcacccucgucaccgucuccuccgccagcaccaaaggcccauccgucuucccccuugccccauguucucgcucaaccuccgaauccaccgccgcacucggcugccuuguaaaagacuacuucccagaacccgucaccgucucauggaacuccggagcacugaccucaggcguccacacauuccccgcaguacuccaauccagcggccucuacagccuuuccuccgucgucaccgucaccagcuccaacuucgguacccaaaccuacacuugcaacguagaccacaaacccuccaauaccaaaguagacaaaacaguagaacguaaaugcugcgucgaaugcccucccugccccgccccacccgucgccggccccagcgucuuccuauuuccacccaaacccaaagacacccucaugaucuccagaacgcccgaaguuaccugcguagucgucgacguaucccacgaagaccccgaaguccaauucaacugguacgucgacggcauggaaguccacaacgccaaaaccaaaccccgcgaagaacaauucaacuccaccuuccgcguaguaagcguccuaaccguuguccaccaagauuggcucaacggcaaagaauacaaaugcaaggucucaaacaaagggcuaccugcccccaucgagaaaacaauaagcaaaaccaaaggccaaccccgcgaaccccaagucuacacucuaccaccuucccgcgaagaaaugaccaaaaaccaaguaucccucacuugccugguaaaagguuucuaccccagcgacaucgcagucgaaugggaaucuaacggacaacccgaaaacaauuacaagaccaccccacccaugcuagacuccgauggcuccuucuuccuauacucaaaacucaccgucgacaaaucacgcuggcaacaaggcaacgucuucuccugcuccgucaugcacgaagcccuacacaaccacuacacccaaaagucucuaucacucuccggcaaa

SEQ ID NO: 58742 - RNA, 1350 nt, Artificial Sequence
  derived and/or modified sequence opt11 from anti-influenza_Chain
caaguccaacugcaacaaucaggcgccgaaguuaagaaacccggcuccuccgucaaagucuccugcaaaguaucaggcgucauauucuccggcucagccaucuccuggguacgccaagcccccggccaaggacucgaauggaugggaggcaucagcccccucuucggaacuacaaacuacgcccaaaaauuccaaggccgcgucaccauaaccgccgaccaauccaccaacaccacauauauggaagucaauucccuccgcuacgaagacacagccgucuacuucugcgcccgaggccccaaauacuacucagaauacauggacgucuggggcaaaggcaccaccgucacagucucaucagcaucaacaaaaggccccuccguauucccccucgcccccagcuccaaauccacaucuggcggcaccgccgcacucggcugccucgucaaagacuacuucccagaacccgucaccguauccuggaacucaggcgcacuuaccagcggaguccacacguuccccgcaguccuccaauccuccggacucuacuccuuaagcuccguagucaccguccccucuuccucccucggcacacaaaccuacaucuguaacguaaaccacaaaccaucaaacaccaaagucgacaaacgagucgaaccaaaauccugcgacaaaacccacacaugcccucccugccccgcacccgaacucuuaggcggucccucagucuuccuauucccacccaaacccaaagacacacuuaugaucucacgcacccccgaggucacgugcguaguugucgacguaucccacgaggaccccgaagucaaauucaacugguacguugacggagucgaaguacacaaugccaaaaccaaacccagagaagaacaguacaacuccaccuaccgcguaguauccguccucacaguacuccaucaagacuggcucaacggcaaagaguacaaaugcaaagucucaaacaaagcacuccccgcccccaucgagaaaaccauuuccaaagccaaaggccaaccccgagaaccccaagucuacacccuaccaccaucucgagaagaaaugaccaaaaaccaaguuucacucacaugccuaguaaaaggcuucuaccccuccgacauagcagucgaaugggaaagcaacggccaacccgaaaacaacuacaaaaccacaccacccguacucgacuccgacggcucauucuuccucuacuccaaacucacagucgacaaaucacgauggcaacaaggcaacguauucuccugcuccguaaugcacgaagcccuccacaaccauuacacacaaaaaucccucucccucucacccggcaaa

SEQ ID NO: 58743 - RNA, 1350 nt, Artificial Sequence
  derived and/or modified sequence opt11 from anti-influenza_Chain
caaguacagcuuguucaaucaggagccgaagucaagaaacccggcagcucaguaaaagucucaugcaaagccucaggcggcacauucuccucauacgccaucucauggguccgccaagcccccggccaaggccucgaauggaugggcggaaucaugggcauguucggaaccaccaacuacgcccaaaaauuucaaggacgcgucaccaucacugcagacgaauuuacauccgcggcauacauggaacuucgcucacuacgauccgaagauaccgcagucuacuacugcgcccgcuccuccggauacuauccagaauacuuccaagacuggggccaaggcacccuagucacugucucaucugccuccaccaaaggacccuccgucuucccacuagcccccagcucaaaaucuacgucaggcggcacagccgcacuaggcugccucgucaaagacuacuuucccgaacccgucaccguaucauggaacuccggcgcccuaaccuccggaguccacaccuuccccgccguucuccaaucguccggccuuuacagccuauccuccgucgucaccgucccauccuccucacucggcacccaaaccuacauaugcaauguaaaucacaaacccuccaacaccaaaguugacaaacgagucgaaccaaaaucaugcgauaaaacccacacuugcccacccugccccgcccccgaacuacucggcggccccuccgucuuccucuucccacccaaacccaaagacacccucaugauaucacggacccccgaagucacaugcgucgucgucgacguaucccacgaagaccccgaaguaaaguucaacugguacgucgacggcgucgaaguacacaacgcaaaaaccaagccacgcgaggaacaauacaacuccaccuacagagucgucuccguccuuaccguccuacaccaagauuggcuuaacggaaaagaauacaaaugcaaaguauccaacaaagcccuccccgcacccaucgagaaaacaaucuccaaagcaaaaggccaaccacgagaaccccaagucuacacccucccaccaucacgcgaagaaaugaccaaaaaucaagucucccugaccugccucgucaaaggcuucuacccauccgacaucgccgucgaaugggaaucaaacggccagcccgaaaacaauuacaaaacaacaccucccguccucgacuccgacggauccuucuuccucuacagcaaacucaccgucgacaaaucccgauggcaacagggcaacgucuucucaugcuccguaaugcacgaagcacuccacaaucacuacacccaaaaaucccuaucacucucccccggcaaa

SEQ ID NO: 58744 - RNA, 1350 nt, Artificial Sequence
  derived and/or modified sequence opt11 from anti-influenza_Chain
gaaguacagcuagucgaauccggcgccgaaguaaagaaacccgguagcucagucaaagucuccugcaaagcaucagggggcaccuucucaucauacggcauuuccuggguacgccaagcccccggccaaggccucgaauggaugggcgacauuaucggcauguucggauccaccaacuacgcccaaaacuuccagggccgacucaccaucaccgccgacgaaucaaccucaaccgccuacauggaacuuuccucccuccgcucagaagacacagcagucuacuacugcgcccgcaguagcggcuacuaccccgcauaccuaccccacuggggccagggcacccuagucacagucuccuccgccuccacaaaaggaccauccgucuucccccucgcacccuccucaaaaucaaccagcggcggcaccgccgcccuaggcugccucguuaaagacuauuuccccgaaccaguaaccgucucauggaacuccggagcccucaccuccggcguccacaccuuccccgccguccuacaauccuccggacuauacucacucucgucaguagucacagucccuagcucaucccucggaacccaaaccuacaucugcaacgucaaucacaaacccuccaacaccaaagucgacaaacgcgucgaaccaaaauccugcgacaaaacccacacaugcccucccugccccgcccccgaacugcugggaggcccaagcguauuccuauucccacccaaacccaaagacacccucaugaucucccgcacacccgaagucacaugcguaguuguagacguuucucacgaagaccccgaaguuaaauucaacugguacgucgacggcgucgaaguccacaacgccaaaaccaaacccagagaagaacaguacaacagcaccuacagagucgucuccguccuaaccguccuccaccaagacuggcucaacggcaaagaauacaaaugcaaaguuuccaauaaagcccuucccgcccccaucgagaaaaccaucuccaaagccaaaggacaaccccgugaaccccaagucuauacccucccacccucccgcgaagaaaugaccaaaaaccaagucucacuaaccugccucgucaaaggcuucuaccccagcgacauagccgucgaaugggaauccaacggacaacccgaaaacaacuacaaaaccacaccacccguccucgacuccgacggaucuuucuuucuuuacucaaaacucacagucgacaaaucccgcuggcaacaaggcaacgucuucucaugcucagucaugcacgaagcccuacacaaccacuacacacaaaaaucucuaucccucagccccggaaaa

SEQ ID NO: 58745 - RNA, 1350 nt, Artificial Sequence
  derived and/or modified sequence opt11 from anti-influenza_Chain
gaaguccagcuagucgaaucaggcgcugaaguaaagaaacccgggucuuccguaaaagucucaugcaaagccuccggcggcaccuucuccuccuacgccauaucuuggguccgccaagcccccggccaagggcuagaauggaugggcggcaucauaggcauguucggaacagccaacuacgcccaaaaauuccaaggccgcgucaccauaaccgccgacgaguucaccuccacagccuacauggaacucuccucccuccgcuccgaagacacagccgucuacuauugcgcccgaggcaacuacuacuaugaaagcucccuagacuacuggggacaaggaacacucguaaccgucuccucugccucaaccaaaggccccuccgucuucccacuagcaccaagcuccaaauccaccucaggcggcacagcugcacucggcugccuaguaaaggacuacuuccccgaacccguaaccgucuccuggaacucaggagcccucaccuccggcguccacaccuuuccugccguccuccaaucuuccggccucuacucgcuuuccuccguagucaccguccccuccagcucccugggcacccaaaccuacaucugcaacgucaaccacaaaccauccaacacaaaaguggacaaacgcgucgagcccaagucaugcgacaaaacccauaccugcccacccugccccgcacccgaacuccugggaggacccuccgucuuccucuucccacccaaacccaaagacacacucaugauaucccgcacucccgaagucacuugcguaguagucgacguaucccacgaagaccccgaagucaaauucaacugguacgucgacggcguugagguucacaacgccaaaaccaaaccccgcgaagaacaauacaacuccacauaccgcgucguuucuguucuuaccguccuacaccaagacuggcugaacggaaaagaauacaaaugcaaaguaucaaacaaggcccuccccgcacccaucgagaaaaccaucucuaaagccaaaggccaaccccgcgaaccccaaguauacacacucccacccucacgcgaagaaaugaccaaaaaucaaguaucacucacaugccucgucaaaggauucuaccccucagacaucgccgucgaaugggaaucaaacggccaaccugaaaacaacuacaaaacaacaccuccaguccuagauucggauggcucauuuuuccuauauuccaaacucaccguugacaaaucccgcuggcaacaaggcaacgucuucuccugcucagucaugcacgaagcccuccacaaucacuacacccagaaaucacuaucacucucccccggcaaa

SEQ ID NO: 58746 - RNA, 1350 nt, Artificial Sequence
  derived and/or modified sequence opt11 from anti-influenza_Chain
gaaguccaacucguccaaucaggagccgaagucaagaaacccgguuccuccaugaaagucucauguaaagccuccggcucaaucuucuccaacuacggaauauccuggguacgccaagcccccggccaaggacucgaauggaugggaggcaucauccccaucuucggagccgccaacuacgcccaaaaauuccaaggccgcgucacaaucaccgccgacgaaagcaccuccaccguauacauggaaguccgcucccuccgcagcgaagacaccgccguuuacuacugcgcccgccgccaacagcucuacaaaggauacuaccaccacuggggccaaggcacccucgucacagucagcuccgcaucaaccaaaggccccuccgucuucccccucgcacccucauccaaauccaccuccggcggaaccgcagcccucggcugccucgucaaagacuacuuccccgaacccgucaccgucagcuggaacuccggcgcucucaccuccggcguccacacguuccccgccguccuccaguccucgggacucuacucccuauccuccguaguuaccguccccuccucuucacuaggcacgcaaaccuauaucugcaauguaaaccacaaaccuuccaacacuaaagucgacaagaaagucgaaccaaaaucuugcgacaaaacacacacaugcccaccgugccccgccccugaacuacucggcggacccucaguauuccuauucccacccaaacccaaagacacccuaaugauaucccgcacccccgaaguaaccugcgucguagucgacgucucccacgaagaccccgaaguuaaauucaacugguacgucgacggcgucgaaguccacaacgcgaaaaccaaaccccgcgaagaacaauacaauucaaccuaccgcguagucagcguccuuaccguccuccaccaagacuggcuaaacggcaaagaauacaaaugcaaaguauccaacaaagcacuacccgccccuaucgagaaaaccaucuccaaagccaaaggccagccccgcgaaccccaaguauacacccuucccccgucccgcgaagaaaugaccaaaaaccagguuagccucacaugccucgucaaaggauucuacccaucagacaucgccgucgaaugggaauccaacggccaacccgaaaacaacuacaaaaccaccccucccguacucgacuccgacggcagcuucuuccuauacuccaaacuaacugucgauaaaucacgcuggcaacaaggcaacgucuucucgugcucaguaaugcacgaagcacuccacaaccacuacacacaaaaaucacucagccuuagccccggcaaa

SEQ ID NO: 58747 - RNA, 1350 nt, Artificial Sequence
  derived and/or modified sequence opt11 from anti-influenza_Chain
cagguccaacucguccaaucaggcgcuggcgucaaaaaacccggauccagcaugaaagucucaugcaaagccuccggcuccauauucuccaacuacggcauaagcuggguccgccaagcacccggccaaggccucgaauggaugggaggcaucauacccaucuucggugccgcaaacuacgcccaaaaauuccaaggucgcgucaccauaaccgccgacgaauccaccuccacaguauacauggaaguccgcucccuacgcagcgaagacacagccguguacuacugugccaggcgccaacaacucuacaaaggcuacuaccaccacuggggccaaggcacacuugucaccguauccuccgccagcaccaaaggucccuccgucuucccucucgcccccuccuccaaauccacaucuggaggcaccgccgcacuaggaugccuugucaaagacuacuuccccgagccagucaccgucagcuggaacucaggcgcacuaacauccggcguccacaccuucccagcuguccuacaaucauccggccucuacucccucuccuccguagucaccguccccuccuccucccucggcacccagaccuacaucugcaacguaaaccacaaaccguccaacacaaaagucgacaaaaaagucgaacccaaaucaugcgacaaaacccacaccugcccccccugcccagcccccgaacuccucggcggacccuccguauuccucuucccccccaaaccaaaagacacacucaugaucagccgaacccccgaaguaaccugcgucgucgucgacgucucccacgaagacccagaagucaaauucaacugguacgucgacggaguggaaguacacaacgccaaaacaaaaccacgcgaagaacaauacaacucuaccuaccgcguagucuccguacucaccguacuccaucaagauugguuaaacggcaaagaauacaaaugcaaagucucuaauaaagcccuacccgcucccauagaaaaaacuauauccaaagccaaaggccaaccccgagaaccucaaguauacacacucccccccucccgagaagaaaugacaaaaaaccaagucucccuaaccugucucgucaaaggcuucuaccccuccgacaucgccgucgaaugggaauccaacggccaacccgaaaacaacuacaaaaccaccccccccguccuugacuccgacggcucauucuuccucuacuccaaacucaccgucgacaaaucccgcuggcaacaaggaaacguauucucuugcucagucaugcacgaagcucuccacaaccacuacacccaaaaaucacuuucucucucccccggaaaa

SEQ ID NO: 58748 - RNA, 1350 nt, Artificial Sequence
  derived and/or modified sequence opt11 from anti-influenza_Chain
caaguccaacucguccaauccggcgccgaaguccgcaaacccggcuccagcgucaaggucuccugcaaagucagcggcggaaucauacgaaaauacgccaucaacuggguccgccaagcccccggacagggccucgaauggauggguggcauaaucgccaucuucaacaccgccaacuacgcacaaaaauuccaaggccgcgucaccaucaccgcagacgaauccaccuccaccgucuacauggaacuaagcucccucaggucagaagacacugcacuauacuacugcgccagaggaaugaauuacuacucagacuauuuugacuacuggggccaaggaucccucgucacagucucccccgccuccaccaagggccccagcguauucccccucgcccccucaucaaaaucaaccuccggcggcaccgccgcccuaggaugccucguaaaagacuacuuccccgaacccgucacagucucauggaacucaggcgcccucaccucaggcguacacacauuccccgcaguacuacaauccuccgggcucuacagccucuccucaguagucacaguccccuccucaucacucggcacccaaacauacauaugcaauguaaaccacaaacccuccaacaccaaagucgacaaaaaggucgaacccaaauccugugacaaaacccacacaugcccacccugccccgcccccgaacuacucggaggcccuagcgucuuccuauucccacccaaacccaaagacacccucaugauaucccgcacccccgaagucacuugugucgucgucgaugucucacacgaagaccccgaagucaaauucaacugguacguugacggagucgaaguccacaacgccaaaacaaaaccccgcgaagaacaauacaacagcaccuaccgagucgucucuguccucaccguccuccaccaagauuggcucaacggaaaagaauacaaaugcaaagucagcaacaaagcacuccccgcccccaucgagaaaacaauauccaaagccaaaggccaaccacgagaaccccaagucuacacccuaccacccuccagagacgaacuaaccaaaaaccaaguaucacuuaccugccucgucaaaggcuucuaccccuccgauauagcugucgaaugggaaucgaacggccaacccgaaaacaauuacaaaaccaccccaccgguacuugacagcgacggcucauuuuuccucuacuccaaacucaccgucgacaaaagccgcuggcaacaaggcaacguauucagcugcagcguaaugcacgaagcccuacacaaccauuacacccaaaaaucacuaucccucucccccggaaag

SEQ ID NO: 58749 - RNA, 1350 nt, Artificial Sequence
  derived and/or modified sequence opt11 from anti-influenza_Chain
caaguccaacucguacaauccggcgccgaaguccguaaacccggauccucaguaaaagucagcugcaaagucuccggcggcaucauccgcaaauacgcaaucaacuggguacgacaagcccccggccaaggccuagaauggaugggcggcauaaucgcuaucuucaacaccgcaaacuacgcccaaaaguuccaaggccgcgucacaauaaccgcugacgaauccaccucaacugucuacauggaacucagcucccuccgauccgaagacacugcacuuuacuacugcgcccgcggcaugaacuacuacagcgacuacuucgacuacuggggccaaggaucacucguaaccgucucccccgcuucaaccaaaggacccucagucuucccccuagccccauccuccaaaagcacaucaggcggcacagcggcccuuggcugccucguaaaagacuacuuccccgaaccaguaacaguauccuggaacuccggcgcacucacaucaggaguccacaccuuccccgcaguccuccaauccuccggacucuacucucucuccuccgucguaaccgucccuuccucuucccucggcacccaaaccuacaucugcaacgucaaccacaaaccaagcaacacgaaggucgacaagaaagucgaacccaaaucgugcgacaaaacccacaccugucccccaugccccgcccccgaauuacucggcggccccucagucuuccuauucccacccaaacccaaagacacccucaugaucucccgcacacccgaaguaacaugcgucgucgucgacguaucccacgaagaccccgaagucaaauucaacugguaugucgacggagucgaagugcacaacgccaaaacaaaaccccgugaagaacaauacaacucaaccuaccgcgucgucuccguucucacuguccuacaccaagacuggcuaaacggcaaggaauacaaaugcaaggucucaaacaaagcacuccccgcccccaucgagaaaaccauaucaaaagccaaaggccaacccagagaaccccaagucuacacacucccacccucacgagacgaauuaaccaaaaaccaggucucccucacaugccuagucaaaggcuucuaucccuccgacauagccgucgaaugggaauccaacggccaacccgaaaauaacuauaaaacaacaccacccguccuagacuccgauggcaguuucuuccucuacuccaaacucaccgucgacaaaucacgcuggcaacaaggaaacgucuucucaugcuccgucaugcacgaagcccuacacaaccacuacacacaaaaaucacucagccucucccccggaaaa

SEQ ID NO: 58750 - RNA, 1350 nt, Artificial Sequence
  derived and/or modified sequence opt11 from anti-influenza_Chain
gaaguucaacuuguacaauccggcgcagaaguaaagaaacccggauccuccaugaaaguaagcugcaaagcauccgguuccaucuucuccaacuacggaaucuccuggguccgccaagcccccggccaaggccucgaauggaugggcggcauaauccccaucuucggagcagccaacuacgcacaaaaauuccaaggccgcgucacaauaaccgccgacgaauccaccuccacagucuacauggaaguccgcucccuccgcuccgaggacaccgcagucuauuacugcgcacgccgacaacagcucuacaaaggcuacuaccaccacuggggucaagguacccucguaacagucuccuccgcaucaaccaaaggaccaucugucuucccacuagcaccauccagcaaauccaccucaggaggcacagccgcccucggcugccucgucaaagacuacuuucccgaaccugucacagucuccuggaacuccggagcccuaacuuccggaguccacacuuuccccgccgucuuacaaucauccggacuauacucccuaucaucagucgucacagugcccuccucaucccucggcacucagacuuacaucuguaacgucaaccacaaacccuccaacaccaaagucgacaagaaagucgaacccaaaucaugcgacaaaacacacacaugcccacccugcccagcacccgaacuucuaggcggcccauccgucuuccucuucccuccaaaacccaaagacacccuaaugaucucacgaaccccagaaguaaccugcgucgucguggacgucagccacgaagaccccgaagucaaauucaacugguacguggacggaguagaaguucacaacgccaaaaccaagcccagagaagaacaauacaacucaaccuaccgcguagucuccguccuaaccguccuccaccaagacuggcucaacgguaaagaauacaaaugcaaagucuccaauaaagcccuccccgcucccauugagaaaaccaucuccaaagccaaaggccaaccccgcgaaccacaaguauacacccucccaccuucccgcgaagaaaugacuaaaaaccaagucucccucacaugccuagucaaaggcuucuaccccuccgauauagcaguugaaugggaaucuaacggucaaccagaaaacaacuacaaaacaaccccaccaguccucgauucagacggauccuucuuccucuacucaaagcucaccguagacaaaucccgcuggcaacaaggcaacgucuucucaugcuccgucaugcacgaagcccuccacaaccacuacacacaaaaaucccucucccucucccccggcaaa

SEQ ID NO: 58751 - RNA, 1350 nt, Artificial Sequence
  derived and/or modified sequence opt11 from anti-influenza_Chain
caaguccaacucguccaaucaggcgccggagucaagaaacccggcuccucaaugaaaguauccugcaaggcuucuggcucaaucuucuccaacuacggcaucagcuggguucgacaagcccccggccaaggccuugaauggaugggcggcaucaucccgaucuucggcgcagccaacuacgcccaaaaauuccagggccgcgucaccaucaccgcagacgaauccacuuccaccguauacauggaaguccgcucccuccgcuccgaagacaccgccgucuacuacugcgcccgucgccaacagcuauacaaaggcuacuaccaccacuggggacaaggcacccuaguaaccguuuccagugccucuaccaaaggccccucaguguucccccucgcccccagcucuaaauccacaucuggcggcacagccgcacucggaugccucgucaaagacuacuuccccgaacccgugaccgucaguuggaacuccggcgcccucaccuccggcguacacaccuucccagccguccuccaaucguccggacucuacucacuaagcucaguagucaccguccccuccuccucacucggaacccaaaccuacaucugcaaugucaaccacaaacccagcaacaccaaagucgacaagaaagucgaaccaaaauccugcgacaaaacccacaccugucccccaugccccgcccccgaacuucucggcggucccuccgucuuccuguucccacccaaacccaaagacacccuaaugaucucacgcacacccgaaguaaccugcgucgucgucgacguaucccacgaagaccccgaagucaaauucaacugguacgucgacggcguggaaguucacaacgcgaaaacaaaacccagagaagaacaauacaacuccaccuaucgcguagucuccguccucaccguacuccaccaggacuggcuaaacggcaaagaguacaaaugcaaagucucaaacaaagcccugccagccccaaucgagaaaaccauauccaaagccaaaggccaacccagagaaccacaaguauacacacucccacccucccgcgaagaaaugaccaaaaaucaagucucccugacaugccucguaaaaggcuucuaccccuccgauauagccgucgaaugggaaagcaacggccaacccgaaaacaacuacaaaacuacaccacccguacuugacucugacggauccuucuuccuauauucaaaacucaccgucgacaaaucacgauggcaacaaggaaacgucuucuccugcuccgucaugcacgaagcccuccacaaccacuacacacaaaaauccuuaucccuaucccccggcaaa

SEQ ID NO: 58752 - RNA, 1350 nt, Artificial Sequence
  derived and/or modified sequence opt11 from anti-influenza_Chain
caaguacaacuccaacaaucuggagcagaagucaagaaacccggaagcucagucaaagucuccugcaaagucuccggagucauauucuccggcuccgccaucucauggguccgccaagccccaggccagggccuagaauggaugggcggaauaucaccacucuucggcaccaccaacuaugcccaaaaauuccaaggacgagucaccauuaccgccgaccaauccaccaacaccaccuacauggaaguuaacucccuacgguacgaagacaccgccguauauuucugcgcccgcgggcccaaauacuacuccgaauacauggacgucuggggcaaaggcacuaccguaacagucuccuccgcaucaaccaaaggccccucagucuucccccuugcacccuccucaaaauccacaucaggcggaaccgcagcccuaggaugccucgucaaagacuacuucccagaacccgucacaguauccuggaacucuggagcccuuaccucaggcguccacaccuuccccgcaguccuccaauccagcggacuauacagccuaagcucggucgucaccgugccaucaagcucccuaggcacucaaaccuacaucugcaacgugaaccacaaacccucaaacacaaaagucgacaaaagaguugagcccaaaucaugcgacaaaacccacacaugucccccaugccccgccccugaacuccucggcggucccucagucuuccucuucccacccaaacccaaagacacccucaugaucucacgcacacccgaagucacuugcgucgucgucgacgucucccacgaagaccccgagguuaaauucaacugguacgucgacggagucgaaguccacaaugccaaaaccaaaccccgugaagaacaauacaacuccaccuaccgcguagucuccguccuuaccguccuacaccaagacuggcuaaacggaaaagaguacaaaugcaaagucucaaacaaagcccuuccagcacccauagagaaaaccauaucaaaagcuaaaggccaaccacgcgaaccccaaguauacacacugccacccucacgcgaagaaaugaccaaaaaccaaguaucacucacaugcuuagucaaagguuucuaccccagcgacauagccgucgaaugggaaagcaacggacagcccgagaacaacuacaaaacaacacccccaguccuugacuccgauggcagcuuuuuccucuacucuaaacucaccgucgacaaaucccgauggcaacaaggaaacgucuucuccugcuccgucaugcacgaagcgcuacacaaccacuauacccaaaaaucccucucccucucucccggcaaa

SEQ ID NO: 58753 - RNA, 1350 nt, Artificial Sequence
  derived and/or modified sequence opt11 from anti-influenza_Chain
caagugcaacucguacaaucaggcgcagaaguaaagaaacccggcuccucagucaaaguaagcugcaaggccuccggcggcaccuucuccuccuacgcgaucucauggguccgccaagcacccggccaaggacucgaauggaugggcggcauuaugggcauguucggcacuaccaacuacgcacagaaauuccaaggacgcgugacaaucaccgccgacgaguucacauccgccgccuacauggaacuccgcucccuccgauccgaagacaccgccguauacuacugcgcccggucauccggcuacuacccagaauacuuccaagacuggggccaaggcacccucguaaccguuuccucggccucaaccaaaggaccauccgucuuuccccuagcaccaucauccaaauccaccuccggcggcaccgcagcccuaggcugccucgucaaagauuacuuccccgaaccagucaccguauccuggaacuccggcgcccuaaccucgggaguccacaccuucccagccguccuccaauccuccggccucuacucccucucauccgucguaaccguccccucuagcucccuaggaacacaaacauacaucugcaacguaaaccacaagcccucuaacaccaaagucgacaaacgcgucgaacccaaauccugcgacaaaacucacacaugcccacccugccccgcccccgaacuccuuggcggccccuccguauuucuauucccucccaaacccaaagacacccucaugauaucccguaccccagaagugaccugcgucgucgucgacgucucacacgaagacccugaagucaaauucaacugguacgucgacggcgucgagguccacaacgcuaaaacaaaaccacgcgaggaacaauacaacuccacauaccgcgucgucuccguccucacuguccuccaccaagacuggcuaaacggcaaagaauacaagugcaaagucagcaacaaagcccuccccgcaccgaucgagaaaaccaucucuaaagccaaaggucaaccacgugaaccccaaguauauacucugccaccaucacgcgaagaaaugaccaaaaaccaagucucccuuaccugccucguaaaaggcuucuaccccagcgacaucgccgucgaaugggaaagcaacggccaacccgaaaacaacuacaaaaccaccccaccuguccucgacagcgacgguuccuucuuccucuauuccaaacucacagucgacaaaucccgauggcaacaaggcaacgucuucucaugcuccgucaugcacgaagcccuccacaaccacuacacccaaaaaucacucucacucucgcccggcaaa

SEQ ID NO: 58754 - RNA, 1350 nt, Artificial Sequence
  derived and/or modified sequence opt11 from anti-influenza_Chain
gaaguccaacucgucgaaucaggcgccgaagucaagaaaccaggcuccuccgucaaaguaucaugcaaagccagcggaggcaccuucucuucauacggaaucucauggguccgccaagcccccggacaaggccuagaauggaugggcgacaucaucggcauguucggcuccaccaacuacgcucaaaacuuccaaggacgccugaccauaacagcagacgaauccaccuccaccgcuuacauggaacucagcucucuccguucagaggacaccgccgucuacuacugcgcacgcuccuccggauacuaccccgccuaccucccccacuggggccaaggaacccucguaaccgucucauccgcaucaacaaaaggacccucaguauuuccauuagccccauccuccaaauccaccuccggcggcacagcagcacuaggaugccucgucaaagacuacuuccccgaacccgucacugucucauggaacuccggagcccucaccagcggcguccacaccuuccccgccguccuacaauccuccggucucuacucccucuccagcgucguaaccguacccuccuccucacucggcacccaaacauacaucugcaacgucaaccacaaacccucaaacacaaaagucgauaaacgcgucgaacccaaauccugcgacaaaacccacacaugcccacccugccccgcccccgaacuccuuggcgguccaucagucuuccucuucccacccaaacccaaagacacccucaugauaucaagaacacccgaaguaaccugcgucgucgucgacgucucccacgaagaccccgaagugaaauucaacugguacgucgacggaguagaaguccacaacgccaaaacaaaaccccgugaagaacaauacaacuccacauaccguguagucuccguccuaaccguccuccaccaagacuggcuuaauggcaaagaauacaaauguaaagucuccaacaaagcccuccccgcccccauagagaaaacaauauccaaagcaaaaggccagccccgcgaaccccaagucuauacucuaccacccucucgcgaagaaaugaccaagaaccaagucucccuuacuugccucgucaaaggcuucuaccccucagacaucgcaguagaaugggaaucaaacggacaacccgaaaacaacuacaagaccacacccccuguccuagacuccgacggaucuuucuuccuauacucuaaacucaccgucgacaaaucccgauggcaacaaggcaacguauucuccugcucggucaugcacgaagcucuccacaaccacuacacccaaaaaucacugucccuaagccccggcaaa

SEQ ID NO: 58755 - RNA, 1350 nt, Artificial Sequence
  derived and/or modified sequence opt11 from anti-influenza_Chain
gaaguacaacucgucgaauccggagcagaagucaagaaacccggcuccuccgucaaaguaucaugcaaggcuuccggaggcaccuucuccucauacgcaaucuccuggguacgccaagcacccggccaaggccuugaauggaugggaggcauaaucggcauguucggcaccgcaaacuacgcccaaaaauuccaaggacgcgucaccaucacagcggacgaguucacaagcaccgcauacauggaauuaagcucacuacgaucagaagacaccgccgucuacuacugcgcacgcggcaauuacuacuacgaauccucacucgacuacuggggucaaggaacccucguaacaguaagcagcgcaagcacaaaaggcccuagcgucuucccccucgcccccuccuccaaaucuaccucugguggcacagccgcacuaggcugccuugucaaagacuacuuuccagaacccguaacagucucauggaacagcggcgcucucaccuccggcguccacaccuuucccgccguccuccaauccucaggccucuacucacuauccucagucgucacaguaccguccuccucccuaggcacccaaaccuacauaugcaacgucaaccacaaacccuccaauaccaaaguagacaaacgcguugaaccaaaauccugugacaaaacccacacgugcccucccugccccgcccccgaacuacucggcggacccuccgucuuccucuucccacccaaacccaaagacacccuaaugaucucaagaacccccgaagucacaugcgucguagucgacgucucccacgaagaccccgaagucaaauucaacugguacguagacggagucgaaguccacaacgccaaaaccaaaccccgggaagaacaauacaacuccaccuaccgcguagucuccguccucacaguacuccaccaagacuggcucaacggaaaagaauacaaaugcaaagucagcaacaaagcacuccccgcccccaucgaaaagaccaucuccaaagccaaaggccaaccccgcgaaccccaaguauacacacuaccucccucccgagaagaaaugaccaaaaaccaaguauccuuaaccugccuuguaaaaggguucuaccccuccgacaucgccgucgaaugggaauccaacggccaacccgaaaacaacuacaaaacgaccccacccguacucgacucagacgggucauucuuccuuuacucaaaacuuacagucgacaaaagccgcuggcagcaaggcaacgucuucucaugcucagucaugcacgaagccuugcacaaccacuacacccaaaaaucccuaucccucucccccggcaaa

SEQ ID NO: 58756 - RNA, 1353 nt, Artificial Sequence
  derived and/or modified sequence opt11 from anti-influenza_Chain
gaaguccaacucguagaauccggcgccgaagucaaaaagcccggaagcuccguaaaagucuccugcaaagcaagcggcgggcccuuccgauccuacgcaaucaguuggguccgccaagcccccggacaaggccccgaauggaugggcggcaucauccccauauucggaaccaccaaauacgccccaaaguuccaagggcgcguaacaaucacagcagacgacuucgccggcaccgucuacauggaacuaucuucacuacgaucugaagacacagcaauguacuacugcgccaaacacaugggcuaccaaguccgcgaaacaauggacgucuggggcaaaggcaccacagucaccguauccucagcaucaaccaaaggccccucagucuucccccuggcgcccuccucaaaaucaaccagcgguggaaccgccgcccuaggcugccucgucaaagauuacuucccagagcccguuaccgugagcuggaacuccggcgcacucaccucaggaguacacaccuuccccgccguccuccaauccucaggccucuacucccuauccuccgucguaaccguacccucaucaucacucggcacccaaaccuacaucugcaacgucaaccacaaacccaguaauaccaaaguagacaaacgaguagaaccgaaaagcugcgacaaaacccauaccugcccacccugccccgcccccgagcuccuagggggccccucgguauuccucuucccacccaaaccaaaggacacccucaugauaucccggaccccagaaguaaccugcguugucgucgacgucucccacgaagaucccgaagucaaauucaacugguacgucgacggcgucgaaguacacaaugccaaaaccaaaccacgagaagaacaauacaacuccaccuaccgcgucguuuccguacuaaccguacuccaccaagacuggcucaacggcaaagaauacaaaugcaaagucuccaacaaagcacuccccgcacccauagagaaaacaauaucaaaagcuaaaggacaaccgcgagaaccccaaguauacacccucccacccucccgcgaagaaaugaccaaaaaccaaguaucccuaacaugccucgucaaaggcuucuaccccagcgacaucgccguagagugggaaucaaacggccaacccgaaaacaacuacaaaacaacaccacccguccucgauuccgacgguuccuucuuccucuacagcaaacucacagucgacaaauccagauggcaacaagguaacguauucucuugcuccgucaugcacgaagcccuacacaaccacuacacccaaaaaucacucucccucucucccggaaaa

SEQ ID NO: 58757 - RNA, 1353 nt, Artificial Sequence
  derived and/or modified sequence opt11 from anti-influenza_Chain
caaguccaacucguccaauccggcgccgaagucaagaaacccggcuccuccguaaaagucucaugcaaagcauccggaggccccuuccgauccuacgcgaucuccuggguacgccaggcacccggacaaggccccgaauggaugggcggcauaauccccaucuucggaaccaccaaauacgccccaaaauuccaaggacgagucaccaucaccgccgacgacuucgccggcaccgucuacauggaacuuuccucacuccgcagcgaagacaccgccauguacuacugcgccaaacacaugggcuaccaaguccgcgaaaccauggacgucuggggcaaaggaaccaccgucaccgucuccucugccuccaccaaaggccccucagucuucccccucgcccccucuaguaaaucaaccuccggaggaaccgccgcacuaggcugccuaguaaaagacuacuucccagaacccguaaccguauccuggaacuccggcgcucuaacauccggcguacacacuuucccagccguacuccaaucauccggccucuacagccuaucauccgucguaaccguacccuccuccucacucggcacacaaacauacaucugcaaugucaaccacaaacccuccaacaccaaagucgacaagcgugucgaacccaaauccugcgacaaaacccacacaugcccacccugccccgcccccgaacuacucggaggacccuccgucuuccucuucccacccaaacccaaagacacccuuaugaucucccggacacccgaaguaaccugcguagucgucgacgucucccacgaagaccccgaagucaaauucaacugguacguugacggcgucgaaguccacaacgccaaaaccaaaccccgcgaagaacaauacaacucuaccuaccgcgucgucuccguccuaacaguacuccaccaagacuggcucaacggcaaagaauacaaaugcaaagucucaaacaaagcccuccccgcccccauagagaaaaccauauccaaagccaaaggucaaccccgcgaaccccaagucuauacccuuccacccucacgcgaagaaaugaccaaaaaccaaguaagccuaacaugccuugucaaagguuucuaccccucggacaucgccguagaaugggaaucuaacggccaaccagaaaacaacuacaagaccaccccacccguccuagacucagauggauccuucuuccucuacuccaaacuaaccguagacaaaucacgcuggcaacaaggcaacgucuucagcugcuccgucaugcacgaagcacuccacaaccacuauacccaaaaaucacugucccucucacccgguaag

SEQ ID NO: 58758 - RNA, 1353 nt, Artificial Sequence
  derived and/or modified sequence opt11 from anti-influenza_Chain
gaaguacaacucgucgaaagcggggcagaagucaagaaacccggcucaucagucaaagucuccugcaaagccagcggcggaacuuucuccuucuacuccauguccugggucagacaggccccaggccaaggacuggaauggaugggaggaaucauacccauguucggcaccacaaacuaugcucaaaaauuucaaggccgcgucaccauaaccgccguagaaucuaccuccacugcauacauggaaguauccucccuacgcucagaagacacagccgucuacuacugcgcacgcggggauaaaggcaucuacuacuacuacauggacgucuggggcaaaggcaccacagucacaguauccucagccuccacaaaaggcccauccguauucccccucgcccccucaucaaaaucaacaucaggcggcacagccgcacuaggcugccuuguuaaagauuacuuccccgagccagucacaguauccuggaacagcggagcacuuacuuccggcguccacaccuuccccgccguacuacaauccagcggacucuacagucucuccuccgucgucacaguccccuccagcucacucggcacccaaaccuacaucuguaacguuaaccacaaaccaucaaacaccaaagucgacaaaagagucgaacccaaaucgugugacaaaacccacacaugcccacccugccccgcacccgaacuccucggcggacccuccgucuuccuauucccacccaaacccaaagacacccuaaugaucagccgcacccccgaagucaccugugucgucgucgacguaucccacgaagaccccgaagucaaauucaacugguacgucgacggcguagaaguccacaacgccaaaaccaaacccagagaagaacaauacaacaguaccuaccgaguagucucaguccuaaccguccuccaccaagacuggcuaaacggcaaagaauacaaaugcaaagucucaaacaaagcccuccccgcccccaucgagaaaaccauauccaaagcaaaaggccagccacgcgaaccucagguauacacccugccacccucccgcgaagaaaugaccaagaaucaagucucccuaaccugccucgucaaagguuucuacccaagcgacaucgcagucgaaugggaauccaacggacaacccgaaaacaauuacaaaaccaccccaccaguccucgacuccgacggcuccuucuuccuauauuccaaacucaccgucgacaagucccgauggcaacaagggaacgucuucagcugcucaguaaugcacgaagcacuccacaaccacuacacacaaaaaucacuaagccuaucccccggcaaa

SEQ ID NO: 58759 - RNA, 1353 nt, Artificial Sequence
  derived and/or modified sequence opt11 from anti-influenza_Chain
gaaguacaauuagucgaaagcggcgccgaagucaagaaacccggcucuagcguaaaagucuccugcaaagcaagcggaggccccuuucgcagcuacgccaucucaugggucagacaagcacccggacaaggccccgaauggaugggaggaauaauccccaucuucgggacaaccaaauacgccccaaaauuccaaggacgcgucaccauaacagccgacgacuucgcaggcaccgucuacauggaacucagcagucuccgauccgaagacaccgccauguacuacugcgccaaacacaugggauaccaaguacgcgaaaccauggacguguggggcaaaggaacaaccgucaccgucucauccgccuccaccaaaggccccuccgucuuuccccucgcacccagcuccaaauccaccuccggcggcacagcagcccucggcugccuagucaaagauuacuuccccgaacccgucacugucuccuggaacuccggcgcgcuaacauccggcguccacaccuuccccgccguccuccaaucauccggucuauacagccuaagcuccgucgucaccguccccucguccucacuagggacccagaccuacaucugcaacguaaaccauaaaccauccaacacaaaagucgacaaacgaguagaacccaaaucaugugacaaaacccacaccugucccccaugccccgcaccggaacuccuaggcggcccuagcgucuuccucuuuccacccaaacccaaagacacccuuaugaucucacgcaccccagaagucacaugcguaguugucgacguaucacacgaagaccccgaaguaaaauucaacugguacgucgacggcgucgaaguacacaacgccaaaaccaagccccgagaagaacaauacaacuccacauaccgcgucguaucaguccuaaccgugcuacaccaagacuggcucaacggaaaagaauacaaaugcaaggucucaaacaaagcccucccagcccccaucgagaaaaccaucuccaaagccaaaggccaacccagagaaccucaaguauacacacugccacccucccgagaagaaaugaccaaaaaccaagucucccucacaugcuuagucaaaggauucuaccccagcgacaucgccguugaaugggaauccaacggccaaccagagaacaacuacaaaacaacacccccuguccuagacuccgacgguucauucuuccuauacuccaaacucaccgucgacaaaucccgcuggcaacaaggcaacgucuucuccugcucaguaaugcacgaagcccuccacaaccacuacacccagaaaucgcucucccucucccccggcaaa

SEQ ID NO: 58760 - RNA, 1353 nt, Artificial Sequence
  derived and/or modified sequence opt11 from anti-influenza_Chain
caagugcaacucguccaaucaggagcagaagucaagaaacccggcagcagcgucaaagucuccugcaaagcauccggcggacccuuccgcuccuacgccaucuccuggguacgacaagccccuggccaaggacccgaauggaugggaggaaucauucccaucuucggaacuaccaaauacgcgcccaaauuccaaggccgcguaaccauaacagccgacgacuucgccggcaccguauacauggaacucuccucccuccgcuccgaagacaccgccauguacuauugcgccaaacacaugggauaccaaguccgcgaaacaauggacguaugggguaaaggaacuacaguaaccguuuccuccgcguccaccaaaggcccauccgucuucccauuagccccuuccuccaaauccaccucaggcggaacggccgcacucggaugccuaguaaaagacuacuuccccgaacccgucaccgucuccuggaacucaggcgcccuaacgucaggaguucacaccuucccagccguccuacaguccagcggccucuacucacucucaagcgucguaaccguacccuccucaucccucggcacccaaaccuacaucugcaacgucaaccacaaaccaucaaacacaaaagucgacaaacgagucgaacccaaaagcugugacaaaacccacacaugcccucccugccccgcacccgaacuccucggcggcccauccgucuuccucuuucccccaaaacccaaagacacccuaaugaucagccgaacacccgaagugacaugcguuguagucgacguaucacacgaagaccccgaagucaaauucaacugguacguagacggcgucgaaguucacaacgccaaaaccaaaccccgagaagaacaauacaacucgacauaccgugucgucagcguacucacaguccuccaccaagacuggcuaaacggaaaagaauacaaauguaaagugagcaauaaagcacuccccgccccgauagagaaaaccauaucgaaagcaaaaggacaaccccgagaaccacaagucuacacccuacccccaucccgcgaagaaaugaccaaaaaccaaguaucacuaaccugccucgucaaaggcuucuaccccucagacaucgccguagaaugggaaucaaacggacaacccgaaaacaacuacaaaaccaccccacccguccucgacuccgacggcucauucuuccucuacuccaagcucacagucgacaaaucccgauggcagcaaggaaacgucuucuccugcagcguuaugcacgaagcccuccacaaucacuacacacaaaaaucccucagccugagccccggcaaa

SEQ ID NO: 58761 - RNA, 1353 nt, Artificial Sequence
  derived and/or modified sequence opt11 from anti-influenza_Chain
gaaguccaacucguagaauccggcgccgaagucaagaaacccggcagcuccgucaaagucagcugcaaagcaucaggaggaacauucucguucuacuccaugagcuggguccgccaagcccccggccaaggccucgaauggaugggcggcaucauccccauguucggcaccacaaacuacgcccaaaaauuccaaggccgcgucaccauaaccgcagucgaaucaaccuccaccgcauacauggaagucuccagccuccguucugaagauacagcugucuauuacugcgcccgaggcgacaaaggaaucuacuacuacuacauggacgucuggggaaagggcaccaccgucaccgucucgucagcaagcacaaaaggacccuccgucuucccacucgcccccucauccaaaucaacaucaggaggcacagccgcucucggcugccucgucaaagacuacuuccccgaacccguaacagucagcuggaacuccggcgcccucaccagcggcguccacaccuuccccgccguccuccaaucauccggccuauacagccucagcucaguggucacugucccauccagcucccuaggaacucaaaccuacaucugcaacgucaaccacaaaccguccaacacaaaaguagacaaacgggucgaacccaaauccugcgacaaaacccacacuugcccacccugccccgcaccugaacuucucggaggccccuccgucuuccucuucccacccaaacccaaggacacccuaaugauaucccgaaccccagaagugaccugcgucgucguggaugucagccacgaagaccccgaagucaaauucaacugguacgucgauggcguagaaguccacaacgccaaaaccaaaccccgagaagaacaguacaacucaaccuacagagucgucuccguccucaccgugcuacaccaagacuggcucaacgguaaagaauacaagugcaaagucuccaacaaagcccucccagcucccaucgaaaagacaaucagcaaagcaaaaggccaacccagagaaccacaaguuuacacccucccacccucacgcgaagaaaugacuaaaaaccaagucucccuaaccugccucgucaaaggcuucuaucccuccgacauagccgucgaaugggaaucaaacggccaacccgaaaacaacuacaaaaccaccccacccguccucgacuccgacggcuccuucuuccucuacuccaaacuaaccgucgacaaaucccgcuggcaacaaggcaacguauucucuugcuccgucaugcacgaagcccuacacaaccacuacacccaaaaaucacucagccucucccccggcaaa

SEQ ID NO: 58762 - RNA, 1356 nt, Artificial Sequence
  derived and/or modified sequence opt11 from anti-influenza_Chain
caaguccaacucguucaauccggcggaggauuagucaaacccggcggauccuuacgccuauccugcgccgcauccggcuucaccuucuccuccuacucaaugaacuggguccgccaagcccccggcaaaggucuagaaugggucuccuccaucuccuccucauccucauacaucuacuacgucgacucagucaaaggccgcuucacaaucucucgagacaacgccaaaaauucccuauaccuccagaugaacagccuccgcgccgaagacaccgcuguauacuacugcgcccguggcggaggcagcuacggugcuuacgaaggcuucgacuacuggggacaaggcaccuuagucaccguauccuccgccucuaccaaaggccccuccgucuucccccucgcccccucauccaaauccaccucaggcggcaccgcggcacugggcugccucgucaaagacuacuucccagaaccagucaccguaagcuggaacucaggcgcacucacgucaggcguccacaccuuccccgccguccugcaaucauccggccucuacucccucuccucggucgucaccgucccauccuccucccuaggaacacaaacguacaucugcaaugucaaccacaaaccuucaaacacaaaagucgacaaacgagucgaaccuaaguccugcgacaaaacccacaccuguccacccugccccgcccccgaacuccucggcggccccuccguauuccuauucccacccaaacccaaagacacccuaaugauaucucgcacccccgaaguaacaugcguuguagucgacgucucacacgaagaccccgaagucaaauucaacugguauguagacggagucgaaguccacaacgccaaaaccaaaccucgcgaagaacaauacaacuccaccuaccgagucgucucuguccucaccguucuacaccaagacuggcucaacggcaaagaauacaaaugcaaaguguccaacaaggcccuccccgcccccaucgagaaaacaauaucaaaagccaaaggccaaccgagagaaccccaaguguacacccugccacccucacgcgaagaaaugaccaaaaaccaggucucccugaccugccucgucaaaggcuucuaccccucugacaucgccgucgaaugggaauccaacggacaaccugaaaauaacuacaaaaccacacccccaguccucgacuccgacggaucuuucuuccucuacucaaaacuaacugucgacaaauccagauggcaacaaggcaacgucuucagcugcuccguaaugcacgaagcccuacacaaccacuacacacaaaaaucgcuauccuuaucccccggcaaa

SEQ ID NO: 58763 - RNA, 1356 nt, Artificial Sequence
  derived and/or modified sequence opt11 from anti-influenza_Chain
cagguccagcuaguccaauccggcgccgaaguaaaacaacccggcgcuuccgucaaagucucauguaaagccuccggcuacacauucaacgccuacuauauccacugggucagacaggcacccggacaaggucucgaauggauggguuggauaaaccccaacuucggcggaacccacuacgcgcgcaaauuccaaggaagaguuacaaugacgcgcgacgccuccaucaacaccgccuacauggaacucgacaggcucauaagcgacgacaccgccguauacuacugcguacgcuggcgagcagcagcuguaaucauggaccaauucuacaaaauggacgucuggggccaaggcacccucguaacugucagcuccgcuuccaccaaaggccccucagucuucccccuagcacccugcagccgcagcaccuccgaaagcaccgccgcccucggcugccugguuaaagacuacuuccccgaaccggucaccgucuccuggaacagcggagcccuaacauccggcguccacacauuccccgcuguccuccaaucaagcggccucuacucacuauccuccgucgucacaguccccuccucuagccucggaacgaagaccuauaccugcaacguagaucacaagcccuccaacacaaaagucgacaaaacacgagaauccaaauacggcccaccaugccccucuugccccgcccccgaguuccucggaggccccuccgucuuccucuucccacccaaacccaaggacacccucaugauaucacgcacacccgaaguuacaugcgucguagucgacgucucccaagaagaucccgaaguccaguucaacugguacgucgacggcgucgaaguccacaacgcuaaaacaaaaccccgcgaagaacaauucaacucaaccuaccgcgucguauccguccuuaccguccuccaccaagacuggcucaacggaaaagaauauaagugcaaaguauccaacaaagggcucccuucaucaaucgaaaagaccaucuccaaagccaaaggccaaccacgagaaccacaagucuacacccucccacccgcccaagaagaaaugaccaaaaaccaaguaucccuaaccugccucguaaaaggauucuaccccucagacaucgccgucgaaugggaauccaacggccaacccgaaaacaacuacaaaacaaccccgcccguccucgacuccgacggcaguuucuuccucuacucacgacuaaccguagacaaaucccgcuggcaagaaggaaacgucuucucaugcucggucaugcacgaagcucugcacaaccacuauacucagaaaucacucucacuaucacucggcaaa

SEQ ID NO: 58764 - RNA, 1356 nt, Artificial Sequence
  derived and/or modified sequence opt11 from anti-influenza_Chain
gaaguccaacucguccaauccggcgcagaagucaagaaacccggcgcaucugucaaagucuccugcaaagccuccggcuauaucuucaccggcuacuacauccacuggguacgccaagcccccggccaaggccucgaauggaugggacgcaucgaccccaacggagcuggcacaaccuacgcacaaaaauuccaaggccgagucacacucacaauggacaccagcaucacaaccgcauacauggaacuaucccgacuccgcuucgacgacaccgccaucuacuacugcgcacgcugggacuggaacuucgaccuauaccuaggcugguucgaccccuggggacaaggaacccccgucaccgucgccuccgccuccacuaaaggccccuccgucuuccccuuagcaccgucauccaaauccacuucaggaggcaccgcagcccuaggaugccucguaaaagacuacuuccccgaacccgucaccguauccuggaacuccggcgcccuaaccuccggcguacacaccuucccagccguccuccaaagcucaggccucuacuccuuauccuccgucgucacuguccccucuucaucucuaggaacacaaacauacaucugcaaugucaaccacaaaccaucaaacaccaaagucgacaagaaagucgaaccuaaauccugcgacaaaacccacacaugcccacccugcgcccccgaacuccucggaggccccuccguauuccuguucccacccaaacccaaagauacacucaugaucucccgcacacccgaagucacaugugucgucgucgacguaucucacgaagaccccgaagucaaauucaacugguacguagacggcgucgaaguccacaacgccaaaaccaaaccccgagaagaacaauacaacuccaccuaucgcguaguuagcguacuaacaguccuccaccaagacuggcucaacggcaaagaauacaaaugcaagguauccaacaaagcccuccccgcacccaucgagaaaacaauauccaaagccaaaggacaaccccgagaaccccaaguauacacacucccaccaucucgcgaagaaaugaccaaaaaccaaguuucccugacaugccucguuaaaggauucuaccccucugacaucgccgucgaaugggaaucuaacggacaacccgaaaacaacuacaaaacaaccccacccguccucgacuccgacggcucauucuuccuauacuccaaacucacugucgacaagucccgcuggcaacaaggcaacguuuucuccugcuccguuaugcacgaagcacuccacaaccacuacacucaaaagucccucucccuuucaccaggcaaa

SEQ ID NO: 58765 - RNA, 1356 nt, Artificial Sequence
  derived and/or modified sequence opt11 from anti-influenza_Chain
caaguccaacucguccaauccggcgcagaagucaaacaaccaggggccucagucaaagucuccugcaaagccuccggcuacaccuucaacgccuacuacauucacuggguccgccaagcucccggccaaggccucgaauggaugggcuggauaaaccccaacuucggcggcacccacuacgccagaaaauuccaaggccgcgucaccaugacacgcgacgcauccauaaauaccgccuacauggaacuagaccgccucauaucugacgacacagcugucuacuacugcguccgcuggagagccgccgcagucaucauggaccaauucuacaaaauggacguauggggccaaggcacacucgucaccgucuccuccgccuccaccaaaggccccucaguauucccccucgcaccuugcuccagauccacaucagaaagcaccgccgcacucggaugccucgucaaagacuacuuucccgaacccgucacagucucauggaacuccggcgcccucaccuccggcguccacaccuuccccgccguccuccaaagcucaggacuauacucccucucauccgucgucaccguaccauccucaagccuaggcacgaaaacauauaccugcaacguagaccacaaacccuccaacaccaaagucgacaaaacccgcgaauccaaauacggacccccaugccccagcugcccagcccccgaguuccuaggcggccccagcgucuuccuauucccucccaaacccaaggacacacuaaugaucucccgcacccccgaaguuaccugcgucgucgucgacgucucccaagaagaccccgaaguccaauucaacugguacgucgacggcguagaaguccauaacgccaaaaccaaaccccgcgaagaacaauucaacucuacauaccgcguaguaucgguacuaaccguacuccaccaagacuggcuaaacggaaaggaguacaaaugcaaggucucaaacaaaggccuccccuccuccaucgagaaaaccauaagcaaggcaaaaggucaaccacgugaaccacaagucuacacccucccacccgcccaagaagaaaugaccaaaaaccaagucucacuaaccugccucgucaaaggcuucuaccccucagacaucgccgucgaaugggaaagcaacggccaacccgaaaacaacuacaaaaccacucccccaguccucgacuccgacggaucauucuuccuguacucccgucucaccguugacaaaucccgcuggcaggaaggcaacgucuucuccugcucaguaaugcaugaagcccugcacaaccacuacacacaaaaaucccuuucacucucccuaggcaaa

SEQ ID NO: 58766 - RNA, 1356 nt, Artificial Sequence
  derived and/or modified sequence opt11 from anti-influenza_Chain
caaguacaacucguccaauccggaggaggccucgucaaacccggaggcucacuccgacuaucuugcgccgccuccggauucaccuuuuccagcuacucuaugaacuggguacgccaagcaccaggcaagggguuagaguggguaucauccaucuccucaucaucuagcuacauauacuaugucgauuccguaaaaggccgauucaccaucucucgcgacaacgccaagaacucccucuaucuccagaugaauagccuccgagcggaagacacagccgucuacuacugcgcacgcggcggcggauccuacggcgccuacgaaggcuucgacuacuggggucaaggcacacucgucacaguaucaucagccuccaccaaaggccccuccgucuucccccuagcccccagcucaaaauccaccucaggcggcaccgccgcccuaggcugccucgucaaagacuacuucccagaacccguaacagucuccuggaacuccggagcccucaccuccggaguccauacauucccagcaguucuucaauccuccggccucuacucccucuccucagucgucacaguucccucaucaucacucggcacccaaaccuacaucugcaacgucaaccacaaacccagcaacacuaaaguugacaaacgcgucgaaccaaaaucaugcgacaaaacccacacaugcccacccugccccgcgcccgaacuccucggcggacccuccguauuccucuucccucccaaacccaaagacacccucaugaucucccguacccccgaagucacaugcgucguagucgacguaucccacgaagaccccgaggucaaauucaacugguauguagacggcguagaaguacacaacgccaaaaccaaaccccgagaagaacaauacaacuccaccuaccgagucgucucaguacucaccguacuccaccaagacuggcuaaacggaaaagaauacaaaugcaaagucuccaacaaagcccuccccgcaccaaucgagaaaaccauaagcaaagccaaaggacaaccccgcgaaccccaagucuacacccuuccacccucacgcgaagaaaugaccaaaaaccaaguuucacuuaccugccucgucaaaggcuucuaccccuccgacaucgccguggagugggaaagcaacggacaacccgaaaacaacuacaaaaccaccccacccguacucgacucggacggcuccuucuuccucuacuccaaacucaccgucgacaaaucacgcuggcaacaaggcaaugucuucucuugcuccgucaugcacgaagcccuccacaaccacuacacccaaaaaucacucucccucucccccggaaaa

SEQ ID NO: 58767 - RNA, 1356 nt, Artificial Sequence
  derived and/or modified sequence opt11 from anti-influenza_Chain
gaaguccaacucguacaauccggcgccgaagucaagaaacccggcgccuccgucaaaguaucaugcaaagccucaggcuacauauucacagguuacuacauccacugggugcgccaagcccccggccaaggccuagaauggaugggccgcaucgaccccaacggcgccgguacuaccuacgcccaaaaauuccaaggacgagucacacucacaauggacacuuccaucaccacugccuacauggaacuaucccgacuucgcuucgacgacacugcuaucuacuacugcgcgagaugggacuggaacuucgaccucuaccucggcugguuugaccccuggggccaaggcaccccagucaccguugccuccgccuccaccaaaggcccaucagucuucccccucgcccccuccagcaaaagcacaucuggaggcaccgcggcacucggaugccucgucaaagacuacuuccccgaacccguuacagucuccuggaacuccggagcauuaacguccggaguccacaccuucccagccguccuacaaucauccggacuuuacucccucuccuccgucgucaccguccccuccuccucccucggaacccaaaccuacaucugcaacguaaaccacaaacccuccaacaccaaagucgacaagaaaguugagccaaaaucaugcgacaaaacucacacaugcccacccugcgccccagaacuacuaggcggacccuccguauuccucuucccacccaaacccaaagacacccugaugaucucccgaacccccgaaguaaccugcgucgucgucgacgucucccacgaagaccccgaagucaaauucaacugguacgucgacggugucgaaguccacaacgcaaaaaccaaaccccgcgaggaacaauacaacuccaccuaccgagucguuuccguucucaccguacuccaccaagacuggcucaacggaaaagaauacaaaugcaaagucucgaacaaagcccuccccgcacccaucgagaaaacaaucuccaaagccaaaggccaaccucgagaaccccaagucuacacccuaccucccucacgcgaagaaaugaccaaaaaccaagucucacucacuugccugguaaaaggcuucuaccccuccgacaucgcuguugaaugggaaucuaacggccaacccgaaaacaauuacaaaaccaccccacccguacucgacagcgacggcucauucuuccucuacuccaaacuaacaguagacaaaucacgcuggcagcaaggcaacgucuucucaugcucuguaaugcacgaagcauuacacaaccacuacacucagaaaucacucucacucucccccgggaag

SEQ ID NO: 58768 - RNA, 1359 nt, Artificial Sequence
  derived and/or modified sequence opt11 from anti-influenza_Chain
caaguacaacucguccaauccggagcagaagucaagaaacccggcagcagcguccgcgucuccugcaaagcaucaggcuccaucuucagaaacuacgccauguccuggguacgccaagcacccggccaaggacuagaauggaugggcggcauaaucgcaauauucggaaccccaaaauaugcccaaaaauuccaaggccgcgucaccauaaccgcugacgaaagcacaucaacagucuacauggaacucuccggacuccgcuccgaagacaccgcaauguacuacugcgcaagaaucccccacuacaacuucggcucuggcuccuacuucgauuacuggggccaaggcacccucguaacagucucauccgccuccaccaaaggucccuccgucuucccccucgcccccuccuccaaauccaccuccggcggaaccgccgcccucggaugccuaguuaaagacuacuucccagaaccagucaccgugucauggaacucaggcgcacucaccuccggcguccacacauuccccgccguacuccaaucauccggccuauacucccucucuucagucgucaccguccccuccuccucacucggcacacaaacauacauaugcaacguaaaccacaaacccagcaacaccaaagucgacaaaagagucgaacccaaauccugcgacaaaacccauaccugcccacccugccccgcccccgaacuccucggcggccccucagucuuccuguucccacccaaaccaaaagacacccucaugauuuccagaacccccgaagucacaugcguagucgucgacgucucccacgaagaccccgaagucaaauucaauugguacgucgacggcgucgagguccacaacgccaaaaccaaaccccgcgaagaacaauacaacuccacauaccgcgucguguccguacucaccguacuccaccaggacuggcuaaacggcaaagaauacaaaugcaaagucuccaacaaagcccuaccagccccaauagagaaaaccauauccaaagccaaaggccaaccccgcgaaccacaagucuacacucucccacccucacgugaagagaugaccaaaaaccaagucucccugaccugccucguaaaaggauucuaccccucagacauagccgucgaaugggaauccaacgggcaaccagaaaacaacuacaaaacaacacccccuguacucgacucagauggcuccuucuuucucuacucaaagcucacaguugacaagucccgcuggcaacaaggcaacgucuucuccugcuccgucaugcacgaagcacuccacaaccacuacacccaaaagucccucucacucucccccggcaaa

SEQ ID NO: 58769 - RNA, 1359 nt, Artificial Sequence
  derived and/or modified sequence opt11 from anti-influenza_Chain
caaguccaacucguacaauccggagccgaaguaaagaaacccggugccuccguaaaaguguccugcaaagccagcggauacaucuucacuggauacuacauacacuggguccgacaagcccccgggcaaggccucgaauggaugggccgcaucgaccccaacggaagcggcaccaccuacgcgcaaaaauuccaaggcagagucacccucaccauggacaccuccauuaccaccgcguacauggaacucucccgccuacgcuucgacgacaccgccaucuacuacugcgcccgaugggacuggaacuuugaccuauaucucggcugguucgacccauggggacaaggcacaccagucaccgucgccuccgcguccaccaaaggcccaucagucuucccccucgcccccagcucaaaauccaccuccggcggcacggcagcccucggaugccucgucaaagacuacuucccugaacccguaacagucucauggaacuccggagcccucaccagcggcguccacaccuuccccgcuguacuccaaucaucagggcuauacucccucuccucagucgugaccguccccucaucuucacucggcacacaaaccuacaucugcaacguaaaccacaaaccauccaacaccaaaguagacaagaaagucgaacccaaauccugcgacaaaacccacaccugucccccaugccccgcacccgaacuacucggaggcccauccguauucuuauucccacccaaacccaaagacacacuaaugaucucccgcacccccgaaguaaccugcgucguaguagacgucucccaugaagacccagaaguaaaauucaacugguacgucgacgggguagagguccacaacgcaaaaaccaaaccccgagaagaacaauacaacucaaccuaccgaguagucuccguccugaccguacuccaccaagacuggcucaacggcaaagaauacaaaugcaaagucucgaacaaagcccuacccgccccaaucgagaaaaccaucuccaaagccaaaggccaacccagggaaccucaaguauacacacucccaccaucccgcgaagagaugaccaaaaaccaaguaucccucacuugccuagucaaaggcuucuacccaagcgacaucgccgucgaaugggaguccaacggccaacccgaaaacaacuacaaaaccaccccacccguccuagacuccgacggcuccuucuuccucuacuccaaauuaaccgucgacaaaucccgcuggcaacaaggcaacguauucucaugcucagucaugcacgaagcccuacacaaccacuacacucaaaaaucgcucucccucucaccaggaaaa

SEQ ID NO: 58770 - RNA, 1359 nt, Artificial Sequence
  derived and/or modified sequence opt11 from anti-influenza_Chain
gaaguccaacugguccaaucaggagccgaaguaaagaaaccuggagccuccgucaaagucucaugcaaagcaucaggauacauauuuaccggcuacuacauccacuggguccgccaagcucccggccaaggacucgaauggaugggccgcaucgaccccaacggcgcagguaccacauacgcccaaaaauuccaaggccgaguaacccuaacuauggauacauccaucaccaccgccuacauggaacucucacgccuacgcuucgacgacacugcaaucuacuacugcgcccgcugggacuggaacuucgaccucuaccugggcugguucgaccccuggggacaaggaacccccgucacagucgccuccgccagcacaaaaggccccuccguauucccacuagccccauccuccaaaagcacaucaggcggaaccgcagcccucggcugccucgucaaagacuacuucccagaacccguuaccgucuccuggaacuccggcgcccuaacauccggcguccacaccuucccagccguccuucaaucuagcggccucuacucacucuccuccgucgucaccguccccuccucaucccucggaacccaaaccuacaucugcaacgucaaccacaaacccuccaacaccaaagucgacaagaaagucgaacccaaaucuugcgacaaaacccacaccuguccucccugccccgccccagaacuacucggaggccccuccguauuucucuucccacccaaaccaaaagacacucuaaugaucucccgcacaccagaagucacaugcgucgucgucgacgucucccaugaagaccccgaaguuaaauucaacugguacgucgacggcguagaaguacacaacgcuaaaaccaaaccccgcgaagaacaguacaacucgacauaccgcgucgucuccguccucacaguucuucaccaagacuggcuaaacggaaaagaauacaagugcaaagucuccaacaaagcccuccccgccccaaucgagaaaacgaucagcaaagccaaaggccagccccgcgaaccccaaguauacacccuaccaccaagccgcgaagaaaugaccaaaaaucaagucucacucacaugccuagucaaaggauucuaccccagcgacauagccgucgaaugggaauccaacggccaacccgaaaacaacuacaaaaccacacccccaguacucgacagcgacggcuccuucuuccuauacucaaaauuaacagucgacaaguccagguggcaacaaggcaacgucuucucauguucagucaugcacgaagcccuccacaaccacuacacccaaaaaucccucucccucucacccggcaaa

SEQ ID NO: 58771 - RNA, 1359 nt, Artificial Sequence
  derived and/or modified sequence opt11 from anti-influenza_Chain
caaguacaacucguccaauccggcgcagaagucaagaaaccuggcgccuccguaaaagucucuugcaaagccuccggcuacaccuucaacgcccaucacaugcacuggguacgccaagccccaggacaaggccucggcuggaugggcuggaucgaccccaacaacgauggcacaaucuacgcacagaaauuccaaggccgcguaacacucacaauggacacauccauacacacagcauacauggaacucuccggacuacgcuacgacgacaccgcaaucuacuacugcguccgaugggccuggaacuucgacuucuuccucggaugguucgaccccuggggccaaggcacccuagucaccguagccuccgccuccaccaaaggaccauccgucuucccccuagcccccucgagcaaaucaaccuccggcggaacugccgcacuaggaugccucgucaaagacuacuuccccgaacccgucaccguaucguggaacuccggcgcccucaccuccggcguccacacauuucccgcuguccuccaaucauccggccucuacucccucucaagcgucgucaccguucccucaaguucccucggaacacaaacauacaucugcaacgucaaccacaaaccauccaacacaaaagucgauaagaaagucgaacccaaaagcugcgacaaaacccacacaugucccccaugccccgcccccgaacuccuaggcggacccuccgucuuccuauucccacccaaacccaaagacacacuaaugaucucccgaacacccgaagucacaugcguaguagucgacgucagccacgaagaccccgaagucaaauuuaacugguacgucgacggaguagagguacacaacgccaaaaccaaaccccgcgaagaacaauacaacuccacauaccgaguugucucaguacuaacaguccuccaccaggacuggcucaacggcaaagaguacaaaugcaaagucucuaacaaagcccuuccagcccccaucgaaaagacaaucucaaaagcuaaaggccaaccccgcgaaccccaagucuacacccucccaccaagccgggaagaaaugaccaaaaaccaaguaucgcuaacgugccucgucaaaggcuucuaccccuccgauaucgccgucgaaugggaaucgaacggccagcccgaaaacaacuacaaaaccaccccgccuguucucgacucagacggcuccuucuuccuauacucaaaacucaccgucgacaaaucacgcuggcaacaaggcaacgucuucucuugcucagucaugcacgaagcccuacacaaccacuacacccaaaaaucccucucccuaucacccggcaaa

SEQ ID NO: 58772 - RNA, 1359 nt, Artificial Sequence
  derived and/or modified sequence opt11 from anti-influenza_Chain
gaaguccagcuggugcaauccggagcugaagucaagaaaccaggagaaagccucaaaaucucaugcaaaguaucaggauauagcuucacgucacaauggaucggcuggguccgacaaaugcccggaaagggacuagaauggaucggcaugauguaccccggcgacuccgacacaaucuacucccccucauuccaaggccaaguaaccauaucagcugacaacuccaucucaacagccuaccuccaauggucaucccuaaaagcauccgacaccgccauauacuacugugccagcggacccggauacucuggauaccacuacggcugguucgacacauggggccaaggaacacucgucaccgucucauccgcaucaacuaaaggcccaagcgucuucccccuagcccccuccagcaaauccaccucuggaggcaccgcagcccucggcugccuggucaaagacuauuuccccgaacccguuaccgucuccuggaacagcggcgcccuaaccucaggcguccacaccuuccccgccguccuccaaucaucaggacucuacucccucuccucggucgucaccgucccguccuccagccugggcacgcaaaccuacaucugcaaugucaaccacaaacccuccaacaccaaagucgacaagaaagucgaacccaaauccugcgacaaaacccacaccuguccacccugccccgcccccgaacuccuaggcggccccuccgucuuccucuucccacccaaacccaaagacacccucaugaucucccgcacccccgaaguaaccugcgucgucguagacgugucacacgaagaccccgaagucaaauucaacugguacgucgacggcguagaaguacacaaugccaaaaccaaaccccgcgaagaacaauacaacuccaccuaccgcguuguaagcguacucacaguacuacaccaagacuggcucaacggcaaagaauacaaaugcaaaguauccaacaaagcccuacccgcccccaucgagaaaacaauaucaaaagccaaaggccaaccacgcgaaccacaagucuacacacuacccccaucccgagaagaaaugaccaaaaaccaggucucacugaccugccucgucaaaggauucuacccauccgacaucgcaguagaaugggaauccaacggccaacccgaaaacaacuacaaaaccaccccuccgguccucgacuccgacggcucauucuuccucuacagcaaacucaccgucgacaagucccgcuggcaacaaggaaacguauucucaugcuccguaaugcacgaagcccuacacaaccacuacacacagaaaucacucucccucucucccggcaaa

SEQ ID NO: 58773 - RNA, 1359 nt, Artificial Sequence
  derived and/or modified sequence opt11 from anti-influenza_Chain
gaaguccaacuuguccaguccggcgcugaagucaagaaacccggcgaaucacucaaaauauccugcaaaguaucuggcuacuccuucaccucacaauggaucggcuggguccgacagaugcccggaaaaggccucgaauggauuggcaugauguacccaggcgacgcugacgccaucuacucucccagcuuccaaggacaagucacaauauccgccgacaacuccaucuccacggcauaccuucaaugguccucccuaaaagccuccgauaccgcaaucuacuacugcgcuucaggccccgguuacagcggcuaccacuacggcugguuugacaccuggggacaaggcacccucguuaccguauccucagccucaacaaaaggccccucuguauucccccucgcacccucauccaaaucaaccuccggcggcaccgccgcccucggaugccucgucaaagacuacuuccccgaaccagucacggucucguggaacuccggagcucucaccuccggcguacacaccuuccccgccguacuccaauccuccggacuauauuccuuauccagcgucgucacaguccccuccucaucacucgguacccagaccuacaucugcaacgucaaccacaaacccuccaacacuaaaguagauaagaaaguggaacccaaauccugcgacaaaacccacacaugcccacccugccccgcccccgaacuccucggcggccccuccgucuuccuauuuccacccaaacccaaagacacccucaugaucucccguaccccagaagucaccuguguagucgucgacgucucacacgaggaccccgaagucaaauucaacugguaugucgacggcguugaaguacacaacgccaaaaccaagccacgcgaagaacaauacaacuccaccuacagaguugucuccguccuaacuguccuccaccaggacuggcuaaacggcaaagaauacaaaugcaaagucucaaacaaagcccuccccgccccuaucgagaaaaccaucuccaaagcaaaaggccaacccagagaaccccaagucuacacccucccacccucuagagaagaaaugaccaaaaaccaggucucacuaaccugccucgucaagggcuucuacccauccgacaucgccgucgaaugggaauccaacggccagcccgagaacaacuacaaaacaaccccacccguccucgauuccgacggcagcuucuuccuauacagcaaacucaccgucgacaaaucacgauggcagcaaggcaacgucuucuccugcagcgucaugcacgaagcccuucacaaccacuacacccaaaaaucccucucccucucucccggcaag

SEQ ID NO: 58774 - RNA, 1359 nt, Artificial Sequence
  derived and/or modified sequence opt11 from anti-influenza_Chain
gaaguacagcuaguacaauccggagccgaagucaaaaagcccggagaaucucucaaaauauccugcaaggucuccggcuacuccuuuaccucccaauggauaggcuggguccgacaaaugcccggaaaaggccuagaauggauaggaaugauguacccaggcgaaucagaaaccaucuacucaccuuccuuccaaggccaaguaaccauaagcgccgacaacagcaucucuaccgccuacuuacaauggagcucccuaaaagccuccgauaccgcaaucuacuacugcgccuccggacccggcuacagcggcuaccacuacggaugguucgacaccuggggccaaggcacccuggucacagucucauccgccuccaccaagggcccauccguauucccccucgcccccuccucuaaauccacauccggcggcaccgcagccuuaggaugccucgucaaagacuacuuccccgaaccagucaccguuuccuggaacuccggcgcccuaaccuccggcguacacaccuucccagccgugcuacaguccagcggccucuacucccuauccuccgucguaaccguaccauccuccucccucggcacccaaaccuacaucugcaaugucaaccacaaacccucaaacaccaaagucgacaagaaagucgaaccaaaauccugcgacaaaacacacacaugcccucccugccccgcccccgaacuccucggaggucccucugucuuccucuucccaccgaaaccaaaagacacccucaugaucucccgcacccccgaaguaacaugugucguagucgacgucucgcaugaagacccagaagucaaauucaacugguacgucgacggcguagaaguacacaacgccaaaacaaaaccacgcgaagaacaauacaacucaacauaccgagucguauccguacucacaguacuccaccaagacuggcucaacggcaaagaauacaaaugcaaagucuccaacaaggcgcuaccagcccccaucgagaaaaccaucagcaaagccaaaggccaaccccgcgaaccccaaguauacacacuaccacccagccgcgaagaaaugaccaaaaaccaagucucacucacuugccuagucaaaggcuucuaccccuccgacaucgccguggaaugggaaucaaacggccaacccgaaaacaacuacaaaaccacacccccaguccucgacuccgacggaucauucuuccucuacuccaagcuaaccguagacaaaucccgcuggcaacaaggcaacgucuucagcugcuccguaaugcacgaagcccuacacaaccacuacacccaaaaaucccucucccucucccccggcaaa

SEQ ID NO: 58775 - RNA, 1359 nt, Artificial Sequence
  derived and/or modified sequence opt11 from anti-influenza_Chain
gaaguccaacucguccaaucaggcgccgaggucaagaaacccggcgaaucacuuaaaauaucgugcaaaguauccggcuacuccuucacaucccaauggaucggcuggguacgccaaaugcccggcaaaggccuagaauggaucggcaugauguaccccggcgacgccgacaccaucuacucccccagcuuccagggacaagucaccaucuccgcagacaacuccauauccacugccuaccuccaaugguccucacucaaagcauccgacaccgcuauuuacuacugcgccuccggccccggcuacucaggcuaccacuacggcugguucgacaccuggggacaaggaacccucgucaccgucuccagcgccuccaccaaaggaccauccguauucccacuggcucccuccucaaaaucaaccucuggcggcaccgcagcccucggcugccucguaaaagacuacuuccccgaacccgucacaguaucauggaacucaggcgcacuaacuuccggcguucacacauuccccgcaguccuccaaagcuccggccuuuacucccuaucauccgucguaaccgucccuuccagcucccuugguacccaaaccuacaucugcaacgucaaccacaaacccuccaacaccaaaguagacaagaaaguagaacccaaaagcugcgacaaaacacauaccugcccacccugccccgcacccgaacuccucggcggccccagcgucuuccuauucccacccaaacccaaagacacacucaugaucucccgaacccccgaaguaaccugcgucgucgucgacgucucgcacgaagaccccgaagucaaauucaacugguacgucgacggagucgaaguccacaacgccaaaaccaaaccccgcgaagaacaauacaacuccaccuaccgcgucgucucuguccucaccguacuccaccaagacuggcuaaacggcaaagaguacaaaugcaaaguaagcaacaaagcgcuccccgcaccaauagagaaaacaaucucaaaagcaaaaggacaaccccgcgaaccccaagucuacacccuacccccaucccgcgaagaaaugaccaaaaaccaagucucacuaaccugccucguuaaaggcuucuacccaagcgacauagccgucgaaugggaauccaacgggcaaccagaaaacaacuacaaaaccacuccucccguccucgacagugacggcuccuucuuccuauauuccaaacucacuguagacaaauccagauggcaacaaggcaacgucuucucaugcuccgucaugcaugaagcccuacacaaccacuacacccaaaaaucccuaucccucucccccggcaaa

SEQ ID NO: 58776 - RNA, 1359 nt, Artificial Sequence
  derived and/or modified sequence opt11 from anti-influenza_Chain
gaagugcagcuaguccaauccggcgccgaaguaaagaaacccggcgaaucccuaaaaaucucaugcaaaguuucaggcuacuccuucacgucccaauggaucggaugggucagacaaaugcccggaaaaggacucgaauggaucggcaugauguaccccggcuccuccgacacuaucuauuccccuuccuuccaagggcaagucacaaucuccgcagauaacuccaucuccaccgcauaccuacaauggucuucacucaaagccuccgacacugcaaucuacuacugcgcuuccggacccggauacuccggcuaccacuacggcugguucgacacuuggggccaaggcacccucguaaccgucuccuccgcaucuaccaaaggccccuccgucuucccacuagcaccauccuccaaaucaaccucuggcggcaccgccgcccucggaugccucgugaaagacuacuuccccgaacccgucaccgucuccuggaacuccggcgcccucaccucaggcguccacacauuccccgccguccuccaaagcagcggucucuacucgcuauccucugucguaaccgucccauccuccucccucgguacacaaacauacaucugcaacguaaaccacaagcccagcaacaccaaaguagacaagaaaguagaaccaaaaucaugcgacaaaacccacacaugcccacccugccccgcgcccgaacuccucggcggccccagcgucuuccucuucccucccaaacccaaagacacccucaugaucucucgaacccccgaaguaaccugcgucgucgucgacgucucccacgaagaccccgaaguuaaauucaacugguacguagauggagucgaaguacacaacgccaaaacaaaaccacgcgaagaacaauacaacuccaccuaccgcgucgucucaguucuaaccguccuccaccaagacuggcucaacgguaaagaauacaaaugcaaagucuccaacaaagcccucccagcacccaucgaaaagaccaucagcaaagcaaaaggccaaccccgcgaaccgcaagucuauacccucccaccaucccgagaagaaaugaccaaaaaccaagucucucuaaccugccucgucaaaggguucuacccaucagacauagccgucgaaugggaauccaauggccaacccgaaaacaacuacaaaaccacaccacccguccucgacuccgacggcuccuucuuccuauacagcaaacuaaccgucgacaaaucacgcuggcaacaaggcaacgucuucucgugcuccgucaugcacgaagcacuacacaaucacuacacccaaaaaucccucucucucucgcccggcaaa

SEQ ID NO: 58777 - RNA, 1359 nt, Artificial Sequence
  derived and/or modified sequence opt11 from anti-influenza_Chain
gaaguacaacuaguccaauccggcgccgaaguaaaaaaacccggcgaaucucuaaaaaucagcugcaaagucucaggauacuccuucaccucccaauggaucggcuggguccgccagaugcccggcaaaggccucgaauggaucggcaugauguaccccggcgacucagacgcaauauacucaccaucauuccaaggccaaguaacaaucuccgccgacaacuccaucuccaccgccuaccuccaauggucuucacucaaagcaucagacacagcaaucuacuacugcgccuccggacccggauacucaggauaccacuacggcugguucgacaccuggggccaaggcacacuaguaaccgucucuuccgccucaacaaagggccccagcguauucccccucgcacccuccuccaaauccacauccggcggaaccgccgcccuuggcugccucgucaaagacuacuuccccgaacccgucacaguauccuggaacuccggcgcacucacuagcggaguacacacauuccccgccguccuccaauccagcggccucuacucacucagcuccguagucaccguccccuccucaucacucggaacacagaccuacaucugcaacgucaaccacaaacccucgaacaccaaagucgacaaaaaagucgaacccaaaagcugcgacaaaacacacacuugccccccaugccccgcacccgaacuccucggcggccccucagucuuccuauucccccccaaaccuaaagacacccuaaugaucucccgcacccccgaagucacaugcguagucgucgacgucucccacgaagaucccgaagucaaauucaacugguacguagacggcgucgaaguccacaacgccaaaacgaaaccacgcgaagaacaauacaacucaaccuaccgcgucgucuccguccugacaguucuccaccaagacuggcucaacggcaaagaauacaaaugcaaagucuccaacaaagcccucccagcccccauagaaaaaaccauauccaaagccaaaggccaaccgcgcgaaccccaaguuuauacacucccaccaagccgcgaagaaaugaccaaaaaccaagucucccucacaugccuagucaaagguuucuaccccucagacauagcaguagaaugggaaucaaacggacaacccgaaaacaacuacaaaaccaccccccccguacucgacucagacggaagcuucuuccuuuacuccaaacucaccguugacaaaucccgcuggcaacaagguaacgucuucucaugcagcguaaugcacgaagcccuacacaaccacuacacccaaaaaagccuaucccucucccccggaaaa

SEQ ID NO: 58778 - RNA, 1359 nt, Artificial Sequence
  derived and/or modified sequence opt11 from anti-influenza_Chain
gaaguucaacucguccaauccggcgcagaagucaaaaagccaggcgaaucacuaaaaaucuccugcaaagucuccggcuacagcuucaccucucaauggaucggauggguacgccaaaugccaggaaagggacucgaauggaucggcaugauguaccccggcgacacugacaccaucuacuccccaucauuccaaggccaggucacaaucucagccgauaacuccaucuccaccgccuaccuccaaugguccagccuuaaagcauccgacacagccaucuacuacugcgccagcggaccaggauacagcggcuaccauuacggaugguucgacaccuggggccagggcacacucguaaccgucuccucagccucuaccaaaggccccuccgucuucccccuagcaccauccucaaagucaacauccggcggaaccgccgccuuaggcugccuagucaaagacuacuuccccgaacccgucacaguaagcuggaacuccggcgcacuaaccuccggaguccacaccuuucccgccguccuccaauccuccggacucuacucccuaucaucaguaguuaccguccccuccucaucacucggcacccaaacauacaucugcaacguaaaccacaaacccuccaacaccaaagucgacaagaaagucgaacccaaauccugcgacaaaacccacaccugucccccuugccccgcaccugaacuccucggcggccccucugucuuccucuucccacccaaacccaaagacacccuuaugaucuccagaaccccagaagucacaugcguagucguagacgucucccacgaagaccccgaagucaaauucaacugguacgucgacggcgucgaaguccacaacgccaaaaccaaaccaagagaggaacaguacaacuccacauaccgcgucguauccguccucacgguccuccaccaagacuggcucaacggcaaagaauacaaaugcaaagucuccaacaaagcccuccccgccccaaucgagaaaaccaucuccaaagcaaaaggacagccccgcgaaccucaagucuacacccucccuccaucccgagaagaaaugaccaaaaaccaaguaucacucacuugccuagucaaaggguucuaccccuccgacaucgccguagaaugggaauccaacggccaacccgaaaauaauuacaaaacuaccccacccgugcucgauagcgauggcuccuucuuccucuacuccaaacucaccgucgacaaaucacgcuggcaacaaggcaacgucuucuccugcuccguaaugcacgaagcucuacacaaucacuacacccaaaaaucccucucccucucccccggcaaa

SEQ ID NO: 58779 - RNA, 1359 nt, Artificial Sequence
  derived and/or modified sequence opt11 from anti-influenza_Chain
gaaguccagcucguccaguccggugcagaagucaaaaaaccaggugagagccuaaaaaucuccugcaaaguauccggcuacuccuucacaucucaauggauuggauggguacgccaaaugccaggcaaaggacucgaauggaucggaaugauguaucccggcgaaucagacaccaucuacucccccuccuuccaaggacaagucacaauuucagcagacaacuccauauccaccgccuaccuccaaugguccucauuaaaagccuccgacaccgcaauuuacuacugcgccucaggccccggcuacuccggauaccacuacggaugguucgacaccuggggacaaggcacccucgucaccgucucuuccgccuccacgaaaggacccuccgucuucccccucgcccccagcuccaaaucaaccagcggcggcaccgcagcacucggcugccucguaaaagacuacuuccccgaacccgucaccgucuccuggaacucaggagcccugaccucaggcguccacacauucccagcaguacuccaauccuccgggcuauacucacucuccuccgucgucaccguccccuccuccagccuuggcacccagacauacaucugcaacgucaaccacaaaccaagcaacaccaaagucgacaaaaaagucgaacccaaauccugcgacaaaacucacaccugcccucccugccccgccccagaacuccucggcggccccuccgucuuccucuucccccccaaacccaaagacacccugaugaucucccgaacccccgaagucaccugcgucgucgucgacguaucccacgaggaccccgaaguaaaauucaacugguacgucgacggcgucgaaguacacaacgccaaaaccaaaccccgugaagaacaauacaacucuacauaccgcguaguaucuguacuaaccguccuccaccaagacuggcuaaacggcaaagaauacaaaugcaaagucuccaacaaggcccuccccgcgcccaucgaaaaaaccaucuccaaagcuaaaggccaaccacgcgaaccccaagucuacacccuaccccccucccgcgaagagaugacaaaaaaccaaguaucccuaaccugccucgugaaaggauucuacccguccgacaucgccguagaaugggaauccaacggacaaccugaaaacaacuauaaaaccaccccccccguccuagacucagacggcuccuuuuuccucuacagcaaacucaccgucgacaaaucccgauggcaacaaggaaacgucuucuccugcuccgucaugcacgaggcgcuacacaaccacuacacccaaaaaucucucucacuuucccccggaaaa

SEQ ID NO: 58780 - RNA, 1359 nt, Artificial Sequence
  derived and/or modified sequence opt11 from anti-influenza_Chain
cagguccaacucguccaaucaggcgccgaaguaaagaaacccggaagcuccguccgaguaucaugcaaagccucaggcucgaucuuccguaacuacgcaauguccuggguaagacaagcccccggccagggacuggaauggaugggcggcaucauagccauauuuggcacacccaaauacgcgcaaaaauuccaaggccgcguaaccaucaccgcugaugaauccacaucgaccguauauauggaacuauccggacuacgcuccgaagacaccgccauguauuacugcgcccgaauaccccacuacaacuucggcuccggcagcuacuucgacuacuggggacaaggaacucucguaaccgucuccucagccucaacaaaaggccccuccguauucccgcucgcccccuccuccaaaucaacaagcggaggcaccgccgcccucggaugccuagucaaagacuacuuccccgaacccgucacagucucauggaacagcggcgcccucaccucaggcguccacaccuuccccgcaguacuccaaucaucaggccucuacagccuaucaucaguagucaccguccccuccuccuccuuaggaacccaaaccuacaucugcaacgucaaccacaaacccuccaauaccaaagucgacaaaagagucgaacccaaauccugcgauaaaacccacacaugcccacccugcccugcccccgaacuacucggcgggccaagcgucuuccucuuucccccuaaacccaaagacacccugaugaucucccgaaccccagagguaaccugcguaguagucgacguaucccacgaagaccccgaaguaaaauucaacugguacgucgacggaguagaaguccacaacgccaaaacaaaaccacgcgaagaacaauauaacuccaccuaccgcguagucuccguacuaaccguccuucaccaagacuggcucaacggaaaagaauacaaaugcaaaguaucaaacaaagcccuaccagcccccaucgagaaaacaauaucuaaagccaaaggccaaccacgcgaaccucaaguauacacccucccacccucccgcgaagaaaugaccaaaaaucaagucucauuaaccugccucgucaaaggauucuaccccucagacaucgccgucgaaugggaaagcaacggccaacccgaaaacaacuacaaaacaacgccucccguacucgacagcgacggcucuuucuuccuauacucuaaacucaccguagacaaaucccgcuggcaacaaggcaacgucuucuccugcuccguaaugcacgaagcccuccacaaccacuacacccaaaaaucacucucccuaucccccggcaaa

SEQ ID NO: 58781 - RNA, 1359 nt, Artificial Sequence
  derived and/or modified sequence opt11 from anti-influenza_Chain
cagguccaacucguucagucuggcgccgaagucaagaaaccaggagccuccguaaaagucucuugcaaagccucaggcuacaucuucaccggcuacuacauccacuggguccgccaggcacccggucaaggacuagaguggaugggccgcaucgaccccaacggcuccggaaccaccuacgcccaaaaauuccaaggccgaguaacccucaccauggacaccuccaucacaacugccuacauggaacucucacgccuccgcuucgacgacaccgcaaucuacuacugcgccagaugggauuggaacuucgaccucuaccuaggcugguucgacccauggggacaaggcacacccgucaccguagcaagcgcaagcacuaaaggccccuccgucuucccucucgcacccuccagcaaaucaaccucaggagggacagccgcacucggcugccucgugaaagacuacuuccccgaacccgucaccguuagcuggaacuccggcgcccucacauccggcguccacaccuuccccgccguccugcaauccucaggucuauacucccucuccuccguagucaccguccccucauccucgcucggaacccagacauacaucugcaacguaaaccacaaacccagcaacaccaaaguagacaagaaagucgaaccuaaaucgugugacaaaacccacaccugucccccgugccccgccccggaacucuuaggcggacccuccgucuuccucuucccacccaaacccaaagacacccucaugaucucacgcacccccgaaguaaccugcgucgucguugacguaucccacgaagaccccgaagucaaauucaacugguacguugacggugucgaaguccacaacgccaaaaccaaaccccgagaggaacaauacaacuccacuuaccgcguagucuccgugcucaccguacugcaccaagacuggcucaacggcaaagaauacaaaugcaaagucucaaacaaagcacuccccgcccccaucgagaaaacaauaagcaaagccaaaggccaaccccgcgaaccacaagucuacacccuaccacccuccagagaagaaaugaccaaaaaccaagucucacuaacaugccuugucaagggcuucuaccccuccgacauagccgucgaaugggaaagcaacggccaacccgaaaacaacuacaagaccacacccccaguccucgacucagacggcuccuuuuuccucuacuccaaacucaccgucgacaaaucccgcuggcaacaaggcaacguauucuccugcucuguaaugcacgaagcccuacacaaccauuacacccaaaaaucucuaucacuuuccccgggaaaa

SEQ ID NO: 58782 - RNA, 1359 nt, Artificial Sequence
  derived and/or modified sequence opt11 from anti-influenza_Chain
gaaguccaacucguacagucaggcgccgaaguaaagaaacccggagccagcgucaaagucuccugcaaagcauccggauacaucuucaccggcuacuacauccacuggguccgacaagcccccggacagggccucgaauggaugggccgcaucgaucccaacggcgccggcaccaccuacgcccaaaaauuccaaggccgcguaacccucaccauggacaccagcaucacaacagccuacauggaacucucacggcuccgauucgacgacacagccaucuacuacugugccagaugggacuggaacuucgaccucuaccucggcugguucgacccauggggacaagguacacccgucacugucgccuccgcaagcaccaaaggccccucagucuucccccucgcacccucaucaaaguccacauccggaggcacagccgcccucggcugccucgucaaagacuacuuccccgaacccgucaccgucuccuggaacucgggagcgcuaacaagcggaguccacacauuccccgccguacuacaauccuccggccucuacucauuaucaucuguagucaccguccccucaucaucccuaggaacccaaaccuacauaugcaacguaaaccacaaacccuccaauaccaaagucgacaagaaaguagaacccaaaagcugcgacaaaacccacacaugcccaccaugcccugcccccgaacuccucggcggacccucaguauuccucuucccacccaaacccaaagacacacuuaugaucucacguacccccgaaguaacaugcguagucguagacgucucucacgaagaccccgaagucaaauucaauugguacgucgacggcgucgaaguccacaacgccaagaccaagccccgagaagaacaauauaacuccaccuaucgcguugucucaguccuaaccguacuacaccaagacuggcucaacggcaaagaauacaaaugcaaagucuccaacaaagcccugcccgcacccauagaaaagacuaucuccaaagccaaaggccaaccccgugaaccccaagucuacacccucccacccucccgagaagaaaugaccaaaaaccaagucucccuuaccugccucgucaaaggcuucuaccccucagacaucgccgucgaaugggaauccaauggccaacccgagaacaacuacaaaaccaccccucccguccucgacuccgauggauccuucuuccucuacuccaaauugaccgucgacaaaagcagauggcaacaaggcaacgucuucuccugcuccguaaugcacgaagcccuucacaaccacuacacgcaaaagucacucucccucucccccggaaaa

SEQ ID NO: 58783 - RNA, 1359 nt, Artificial Sequence
  derived and/or modified sequence opt11 from anti-influenza_Chain
caaguccaacucguucaauccggcgccgaggucaagaaaccaggagccagcguaaaaguuucuugcaaagccuccggcuauacauucaaugcucaccacaugcacuggguccgccaagcccccggacaaggccucggcuggaugggauggauagaccccaacaacgacggaaccaucuacgcccaaaaauuccaaggccgcgucacacucaccauggacacuagcauacacacugcauacauggaacuauccggccuccgcuacgacgacaccgccauauacuacugcguccgcugggcauggaauuucgacuucuuucucggcugguucgaccccuggggccaaggaacgcuagucacagucgccucagcauccaccaaaggccccagcgucuuuccccucgcacccuccagcaaauccaccuccggaggcacagcagcccucggcugccucgucaaagacuacuuccccgaacccgucaccgucuccuggaacuccggagcccuaaccuccggcguacauaccuucccagccguccuacaaucauccggccucuacucccuauccucagucguaaccguaccaucauccucacucggaacccaaaccuacaucugcaacguuaaccacaaacccucaaacaccaaagucgacaagaaaguagaacccaaauccugcgacaaaacccacacuugcccacccugccccgcccccgaacuacucggaggccccuccgucuuccucuucccacccaaacccaaagacacccucaugauaucacgcacccccgaaguuaccugcgucgucgucgacgucagccacgaagaccccgaagucaaauucaacugguacgucgacggcgucgaaguccacaacgccaaaaccaaaccccgggaggaacaauacaacuccaccuaccgcguagucucuguccucaccguacuccaucaagacuggcucaacggcaaagaauacaaaugcaaaguaucaaacaaagcccuucccgccccaauagagaaaacuaucagcaaagccaagggccaaccacgagaaccccaaguauacacccuacccccaucacgcgaagaaaugaccaaaaaccaagucucacucacaugccucgucaaaggcuucuacccuuccgacaucgccgucgaaugggaauccaacggccaacccgaaaacaacuacaaaacuaccccacccguacuggacuccgaugguuccuucuuccuauacuccaaacucacaguagacaagucuagauggcaacaaggaaacguuuucuccugcuccgucaugcacgaagcacuccacaaccacuacacccaaaaaucccuuucucuuucccccggaaaa

SEQ ID NO: 58784 - RNA, 1359 nt, Artificial Sequence
  derived and/or modified sequence opt11 from anti-influenza_Chain
gaaguccaacucguccaauccggcgccgagguaaaaaaaccaggcgaaucacucaaaaucuccugcaaagucuccgguuacuccuucaccucccaauggaucggauggguacggcaaaugcccggaaaaggacucgaauggaucggaaugauguacccuggcgacuccgacacaaucuacagccccagcuuccaaggacaggucacaaucucagcagacaacuccaucucuacagccuaccuccaauggagcagccucaaagcauccgacaccgccauauacuacugcgcuuccggaccgggcuacuccggauaucacuacggcugguucgacacauggggccaaggcacacuagucaccgucuccuccgccucaaccaaaggaccaagcguauucccacuggcgcccagcagcaaaagcaccuccggcggcacagccgcacuuggcugccuggucaaagacuacuuccccgaacccgucaccgucuccuggaacuccggcgccuuaacauccggcguccacaccuucccagcgguccuccaaucaucaggacuauacucccucuccucagucguaaccgucccaucauccucgcucggcacccaaaccuacauaugcaacgucaaccacaaaccauccaacaccaaagucgacaaaaaagucgaacccaaauccugcgacaaaacacacaccugcccacccugccccgcuccggaacuacucgguggaccauccguauuccuauuccccccaaaaccaaaagacacccucaugauuucacgcacacccgaagugaccugcgucguagucgacguaucccacgaagacccagaaguaaaauucaacugguacguagacggcgucgaaguccacaacgcuaaaaccaaacccagagaagaacaauacaauagcacauaucgcguagucuccguccuuaccguacuccaccaagacuggcucaacggcaaagaauacaaaugcaaaguguccaauaaagcccuccccgcccccaucgaaaagacaaucucuaaagccaaaggacagccccgcgaaccccaagucuacacccuaccccccagccgagaagaaaugaccaaaaaccagguaagccucaccugccugguuaaaggcuucuaccccuccgacaucgcagucgagugggaauccaacggacaacccgaaaacaacuacaaaacuacgccgcccguccucgacuccgacggcuccuucuuccucuacucaaaacuaaccgucgacaaauccagauggcaacaaggcaacgucuucuccugcucagugaugcacgaagcccuacacaaccacuacacacaaaaaucccuaagccugagccccggcaaa

SEQ ID NO: 58785 - RNA, 1359 nt, Artificial Sequence
  derived and/or modified sequence opt11 from anti-influenza_Chain
gaaguccaacuaguacaauccggcgcagaagucaaaaaacccggugaaucccuaaaaaucucaugcaaaguaagcggcuacuccuucaccucccaauggaucggcuggguccgacaaaugccaggcaaaggccuagaauggauaggcaugauguacccuggugacgccgacgccaucuauuccccauccuuccaaggucaagucacaaucuccgccgacaauagcaucagcacagccuaucuccaaugguccucccucaaagccucagacaccgccaucuacuacugcgccuccggcccaggauacuccggcuaccacuacgguugguucgacacauggggacaaggcacccuagucaccgucagcuccgcuucaacaaaaggccccucaguauucccccuagcccccuccuccaaauccaccucaggagggaccgccgcccucggaugccuagucaaagacuacuuccccgaacccguaaccgucuccuggaacucaggcgcccucaccagcggcguccacaccuucccagccguccuccaaucaucaggccucuacucucucucaucagucguaaccguaccaucauccucccuaggaacccaaacauacaucugcaacgucaaccacaaaccuuccaacaccaaagucgacaaaaaagucgagcccaaauccugcgacaaaacccacaccugcccaccaugccccgccccagaacuccucggcggccccucagucuuccuuuucccccccaaaccaaaagacacccuuaugaucucccgaaccccagaagucacaugugucgucgucgacguaucacacgaagaccccgaaguaaaguuuaacugguacgucgacggcgucgaaguccacaacgcaaaaaccaaaccccgagaagaacaauacaacucaaccuaccgcgucgucucagucuuaaccguccuccaccaagacuggcucaauggcaaagaauacaaaugcaaagucuccaacaaagcccuacccgcacccauugaaaaaaccaucuccaaagccaaaggacaaccacgcgaaccccaaguguacacacucccccccucucgcgaggaaaugaccaaaaaccaagucucccucacgugccuaguaaaaggcuucuaccccuccgacaucgccgucgaaugggaauccaacggccaaccagaaaacaacuacaaaaccaccccccccguccucgacuccgacggcuccuucuuccucuauucaaaacucaccgucgacaaaagccgauggcaacaaggcaacguauucagcugcucuguaaugcacgaagcccuccacaaccacuacacacaaaaaucccucucccuuucacccggcaaa

SEQ ID NO: 58786 - RNA, 1359 nt, Artificial Sequence
  derived and/or modified sequence opt11 from anti-influenza_Chain
gaaguccagcucguccaaucaggagcagaagucaagaaacccggcgaaucccucaaaauaucuugcaaagucuccggcuacuccuucaccucccaauggaucggauggguccgccagaugccuggcaaaggacucgaauggauagggaugauguaccccggcgaauccgaaaccaucuauucucccucuuuccaaggccaaguaacaaucuccgccgauaacuccauauccaccgcguaccuccaauggucuucacucaaagcaucagacaccgccaucuacuacugcgcauccggccccggauacagcggcuaccacuauggcugguucgacaccuggggacagggcacccucgucacagucuccuccgccuccacaaaaggccccuccgucuuuccccucgcccccuccagcaaaagcaccuccggcggaacagccgcucucggcugccucgucaaagacuacuuuccugaacccgucacggucuccuggaacaguggggcccuaaccucaggcguacacacuuuuccagcaguccuacaauccuccggccuauacucucuauccagcgucgucaccguacccucuuccucccucggaacucaaacauacaucugcaaugucaaccacaagccauccaacaccaaagucgacaagaaagucgaaccuaaaucaugcgacaaaacccacacaugcccacccugccccgccccugaacuccuaggcggcccauccguauuccucuucccgcccaaacccaaagacacccuaaugaucucccggacccccgaaguaaccugcgucgucgucgacgucucacacgaggaccccgaagucaaauucaacugguaugucgacggagucgaaguccacaacgcgaaaacaaaaccccgagaagaacaauacaauuccaccuaccgcgucgucagcguucucaccguccuccaccaagacugguuaaacggcaaggaauacaaaugcaaaguauccaacaaagcccuccccgcccccaucgagaaaaccaucucuaaagccaagggccaaccccgcgaaccccaagucuacacccucccacccagccgcgaagaaaugaccaaaaaccaagucucccucacaugccuagucaaaggcuucuaccccucagacaucgcaguugaaugggaauccaacggccaacccgaaaacaacuacaaaaccaccccucccguccucgacuccgacggcucuuucuuccuuuacucaaagcuaaccguugacaaaucucgguggcaacaaggcaacgucuucuccugcuccgucaugcacgaagcgcuccacaaccacuauacccaaaaaucacucucccuauccccaggcaaa

SEQ ID NO: 58787 - RNA, 1359 nt, Artificial Sequence
  derived and/or modified sequence opt11 from anti-influenza_Chain
gaaguccaacucguacaguccggagccgaagucaagaaacccggcgaaucacuaaaaauauccugcaaagucucaggcuacucauucaccucccaauggaucggcuggguacgucaaaugccaggcaaaggccucgaauggaucggaaugauguaccccggcgacgccgacacaauauauucccccuccuuccaaggacaggucaccaucucugccgacaacucuaucucaaccgcauaccuccaauggucuucccucaaagccuccgacaccgccaucuacuacugcgccaguggcccaggauacagcggcuaccacuauggcugguucgauacuuggggacaaggaacacucgucacaguaucauccgccuccaccaaaggccccuccgucuucccccucgccccauccucaaaauccaccuccggaggaaccgcagcccucggcugccucguaaaagauuacuuccccgaacccguaaccgucucuuggaacuccggcgcccuaaccucgggaguccacaccuuccccgccguccuccaaucauccgggcucuacagccucuccucggucguaaccguccccuccuccucacucggaacucaaaccuacaucugcaaugucaaccacaaaccaagcaacaccaaagucgacaagaaagucgaacccaaaagcugcgacaaaacccacacaugcccacccugccccgcccccgaacuccuuggcggccccuccgucuuccuuuucccacccaaacccaaagacacccucaugaucucccgaacccccgaagucacuuguguagucgucgacguaucacacgaagaccccgaagucaaauucaacugguacgucgacggcguagaaguccacaacgccaaaaccaaaccccgcgaagaacaauacaacuccaccuaccgggucgucucgguacucacaguucuccaccaagacuggcuaaacggaaaagaauacaaaugcaaagucucaaacaaagcccucccagcacccaucgagaaaaccaucucaaaagccaaaggccaaccacgcgaaccacaaguauauacccucccgcccucacgagaagaaaugaccaaaaaccaagucucccuaaccugccucgucaaaggcuucuaucccuccgacaucgcaguagaaugggaauccaacggccaacccgaaaacaacuacaaaaccacgccacccguacuagacagcgacggcaguuucuuccucuacuccaaacuaaccgucgacaaauccagauggcaacagggcaacgucuucuccugcuccgucaugcacgaagcccuccacaaccacuacacccagaaaagccucucacucucgccaggcaaa

SEQ ID NO: 58788 - RNA, 1359 nt, Artificial Sequence
  derived and/or modified sequence opt11 from anti-influenza_Chain
gaaguacaacuaguccaauccggcgccgaagucaaaaaacccggagaaucccucaaaaucagcugcaaagucuccggcuacagcuucaccucccaauggauuggauggguccgccagaugcccggcaaaggccucgaauggaucggaaugauguacccaggcuccagcgacaccauauauuccccauccuuccaaggacaaguaaccauauccgcugacaacagcaucuccacugcauaccuacaaugguccucccuuaaagccuccgacaccgccaucuacuacugcgccuccggcccaggauacuccggcuaccacuacggaugguucgacacauggggccaaggaacccucgucaccguauccagcgcaucaacuaaaggccccuccgucuucccacucgcccccucaagcaaauccaccuccggcggcaccgccgcccucggcugccucguaaaagacuacuucccagaaccaguaacagucuccuggaacagcggcgcacuaacaucaggcguacacaccuuccccgcaguccuccaauccagcggccuauacucccucucauccguaguaaccgucccauccuccucccucggcacccaaacauacaucugcaacguaaaccacaaacccuccaacaccaaaguagacaaaaaaguugaacccaaauccugcgacaaaacacacacaugcccacccugccccgccccagaacuccucggcggcccuagcgucuuccuauucccacccaaaccaaaagacacccucaugaucucucgcacccccgaaguuaccugcguagucguagacgucucccacgaagacccagaaguuaaauucaacugguacgucgacggcguugaaguccacaacgcuaaaaccaagccgcgagaagaacaauauaacucuaccuaccgagucgucaguguccucaccguccuccaccaagacuggcucaacggaaaagaauacaaaugcaaagucuccaacaaagcccuccccgccccaaucgaaaaaaccaucuccaaagcaaaaggccaaccccgcgaaccccaagucuacacccuaccgcccucccgcgaggaaaugacgaaaaaccaagucucccuuacaugccugguuaaaggauucuacccuucagacaucgccgucgaaugggaaucaaacggacaacccgaaaacaacuacaaaaccacaccccccguccuagacuccgacggcuccuucuuccucuacuccaaacucaccgucgacaaaucacgcuggcaacaaggaaacgucuucuccugcuccgucaugcacgaagcccuccacaaccacuacacacaaaaaagccucucccucuccccaggcaaa

SEQ ID NO: 58789 - RNA, 1359 nt, Artificial Sequence
  derived and/or modified sequence opt11 from anti-influenza_Chain
gaaguacaacucguucaauccggcgcagaagucaagaaaccaggcgaaagccuuaaaaucucaugcaaagucuccggcuacuccuucaccucacaauggaucggcuggguacgccaaaugcccggaaaaggccuagaauggaucggcaugauguacccaggcgacucagacgccaucuacucacccucauuccaaggccaagucaccaucucagcagacaacagcaucuccaccgccuaccuccaaugguccucccucaaggccuccgacaccgccauauacuauugcgccuccggccccggcuacuccgguuaccacuacggcugguucgacacauggggacaaggaacccuagucaccgucagcuccgccagcacaaaaggacccucagucuucccacuagccccaucaagcaaaucaacaucaggcggcacagccgcccucggcugccucgucaaagacuacuuccccgaaccagucacggucucuuggaacuccggcgcacucaccucaggaguccacaccuucccagccgugcuucaguccucuggacucuacucacucucauccgucgucacaguccccaguuccucacucggcacacaaaccuacauuugcaacgucaaccacaaaccuuccaacacaaagguggacaagaaagucgaacccaaauccugcgacaaaacacacacaugcccaccuugccccgcacccgaacuacucggcggcccauccgucuuccucuucccacccaaaccuaaagacacacucaugaucucccgcacacccgaagucacaugcguagucgucgacgucucucacgaagaccccgaaguaaaauucaacugguacguagacggcgucgaaguccacaacgcaaaaaccaaaccacgagaagaacaauacaacuccacauaucgcguagucuccguccucaccguccuacaccaagacuggcucaacggaaaagaauacaaaugcaaaguuagcaacaaagcccucccggccccuauagagaaaaccaucucaaaagccaaaggccaacccagagaaccccaagucuacacacucccgcccuccagagaagaaaugaccaaaaaccaaguaucucuuaccugccucgucaaaggcuucuaccccucagacauagcagucgaaugggaauccaacggccaacccgaaaacaacuacaaaacaaccccacccguccuggacuccgacggcucauucuuccuuuacuccaaacucaccgucgacaaaucgcgauggcaacaaggaaacgucuucucaugcuccguaaugcacgaagcccuccacaaccacuacacccaaaaaucccuaucacucagccccggcaaa

SEQ ID NO: 58790 - RNA, 1359 nt, Artificial Sequence
  derived and/or modified sequence opt11 from anti-influenza_Chain
gaaguccaacucguucaaagcggcgcagaggucaaaaaacccggagagucccuaaaaaucuccugcaaagucuccggauacucauucaccucacaauggaucggcugggugaggcaaaugcccggaaaaggacucgaauggaucggcaugauguacccaggcgacaccgacaccauauacuccccaucauuccaaggacaagucacaaucucagccgacaacucuauauccaccgccuaccuccaaugguccucucucaaagccuccgacacagccauuuacuacugcgccuccggucccggcuacucaggcuaccacuacggcugguucgacacauggggccaaggcacauuagucaccguaucaucagcuuccacaaaaggaccaucaguuuucccccucgcccccucauccaaauccaccuccggaggaaccgccgcccucggcugccucguaaaagacuacuuccccgaacccgucaccgucucauggaacuccggcgcccucaccagcggcguccacaccuucccagcuguacuccagucauccggccucuacagccucaguucagucgucaccguccccuccucaucccucggcacacaaaccuacauaugcaacguaaaccauaaacccucaaacaccaaggucgacaaaaaagucgaacccaaaucgugcgacaaaacacacacaugcccgcccugccccgcacccgaacuacucggcggccccuccgucuuccucuucccccccaaacccaaagacacacucaugauauccagaacccccgaggucaccugcguggucgucgacguaucccacgaagacccagaagucaaauucaacugguacgucgacggcgucgaaguacacaacgccaaaaccaaaccccgugaggaacaauacaacagcacuuaccgaguaguuuccguccucaccguccuccaccaagacuggcucaacggaaaagaauacaaaugcaaaguaucaaacaaagcccuccccgcaccaauagaaaaaacaaucuccaaagccaaaggacaaccccgagaaccccaaguauacacgcucccccccucccgugaagaaaugaccaaaaaccaagucagccucaccugccucguuaaaggcuucuaccccuccgacauagcuguugaaugggaaucaaacggccaacccgaaaacaacuacaaaaccacaccccccguacucgacuccgacggauccuucuuccucuacucaaaacucacaguagacaaaucccgcuggcaacaaggcaacguauucuccugcuccgucaugcacgaagcccuccacaaccacuacacccaaaaaagccuuucccuuucacccggaaaa

SEQ ID NO: 58791 - RNA, 1359 nt, Artificial Sequence
  derived and/or modified sequence opt11 from anti-influenza_Chain
gaaguucaacucguucaguccggcgcugaagucaaaaaaccaggcgaaucccuaaaaauuuccugcaaagucuccggcuacuccuucacaucccaauggaucggcuggguacgccaaaugcccggcaaaggccucgaauggauaggcaugauguaccccggcgaauccgacaccauauacuccccaucauuccaaggacaagucaccaucuccgcggacaacucgaucagcacagcauaccuccaaugguccucacuaaaagccagcgacaccgcuauauacuacugcgccuccggccccggcuacuccggcuaccacuacggcugguucgacacaugggggcaaggcacccucgucaccgucuccuccgcguccaccaaaggacccucaguauuuccccuagcccccuccagcaaauccaccagcggcggcaccgccgcccuagguugucucguaaaagacuacuuccccgaacccguaacagucucauggaauucuggcgcccucaccuccggaguccacaccuucccagcaguccuccaaagcuccggacuauacucccucuccuccguagucaccgucccaucauccucccucggaacacaaaccuacaucugcaacgucaaccacaaacccuccaacaccaaagucgacaaaaaagucgaacccaaaucuugcgacaaaacccacaccuguccccccugcccagcccccgaacuccucggaggccccucugucuuccuauucccccccaaacccaaagacacacuaaugauaucacgcacaccagaagucaccugcgucgucguugacguaagccacgaagaccccgaagucaaauucaacugguacgucgacggcguagaaguccacaacgcaaaaaccaaaccccgcgaagaacaauacaacagcaccuaccgagucgucagcguccuaaccguccugcaccaagacuggcucaauggcaaagaauacaaauguaaggucucaaacaaagcccuacccgccccaaucgaaaaaaccaucucaaaagccaagggccaaccccgagaaccccaagucuacacacuucccccuuccagggaagaaaugacgaaaaaccaaguaucccugacaugccucgucaaaggcuuuuaccccucagacauagccgucgaaugggaaagcaacggccaacccgaaaacaacuacaaaacaacgccccccguccucgacucugacggcucauucuuccucuacucaaaacuuaccgucgacaaaucccgcuggcaacaaggaaacguauucuccugcuccgucaugcacgaagcccuccacaaccacuacacccaaaaaucgcucagccuaucaccaggaaaa

SEQ ID NO: 58792 - RNA, 1365 nt, Artificial Sequence
  derived and/or modified sequence opt11 from anti-influenza_Chain
cagguacaacucgucgaauccggaggaggcgucguccaaccaggccgcucccuccgccuaucaugcgcagccuccggcuucgcauuucacaaucgcgccaugcacuggguccgacaagcccccggcaaaggacuagaaugggucgcucucaucuacuucgacggcuccaagcaauacuacgcagacagcguaaaaggcagauucacaaucucacgagacaauuccaaaaacaccgucuuucuucaaaugaacucacuccguccagaagacacagccgucuacuacugcgcaguccccggccccaucuucggcauauuucccccauggucauacuucgaccacuggggccaaggcauccuggucacuguauccuccgccucuaccaagggcccaucagucuucccacucgcccccuccuccaaauccacauccggcggcacagcagcccucggcugccucgucaaagacuacuuccccgaaccaguaaccgugucauggaacucaggcgcccucaccuccggcguccauaccuuccccgcaguccuccaguccuccggccucuacucccuauccuccgucguaaccguccccagcucaucacuaggaacccaaacauacaucugcaacgucaaccacaaaccauccaacacgaaagucgacaagaaagucgaaccaaaauccugcgacaaaacccacacaugcccucccugccccgcccccgaacuccucggcggacccuccgucuuccuauucccgcccaaaccaaaagacacccucaugauauccagaacccccgaaguaaccuguguaguaguugacguaucucaugaagaccccgaagucaaauucaacugguacguagacggcguagaaguacacaaugcaaaaacaaaaccccgcgaagaacaauacaacagcaccuaccgcgucguauccguccucacagucuuacaccaagacuggcucaacggcaaagaauacaaaugcaaaguuuccaacaaagcccugcccgcccccauagaaaagaccaucuccaaagccaaaggacaaccaagagaaccccaggucuauacccugccucccucccgagaagaaaugaccaaaaaccaaguauccuuaaccugccucgugaaaggcuucuaccccuccgacauagcagucgaaugggaaucaaacggucaacccgaaaacaacuacaaaaccacgccacccguccucgacuccgacggaucuuucuuccucuacuccaaacucacagucgauaaaucccgcuggcaacaaggcaacgucuucucaugcagcguaaugcacgaagcucuccacaaccacuacacccaaaagucccucucccucucacccggcaaa

SEQ ID NO: 58793 - RNA, 1365 nt, Artificial Sequence
  derived and/or modified sequence opt11 from anti-influenza_Chain
gaaguccaacucgucgaauccggcggaggcgucguccaacccggccgaucccuucgccucuccugugccgccuccggauuugccuuccacaaccgcgccaugcacugggugcgccaagcccccggcaaaggacucgaaugggucgcacucaucuauuucgauggcuccaaacaauacuacgcugacuccgucaaaggccgcuuuacaauaucccgcgacaacuccaaaaacaccgucuuccuacaaaugaacucacuacgacccgaagacacagccgucuacuacugcgccguccccgggcccaucuucggcaucuucccucccuggucauacuucgaccacuggggccaaggcauccuagucaccgucuccuccgccucuaccaaaggccccucagucuucccccuagcaccauccuccaaaagcacauccggcggcacagccgcacugggcugccucguaaaggacuacuuucccgaacccguaaccgucucauggaacuccggcgcacuaaccuccggaguccacacauuccccgccguccuccaaagcuccggacucuacucacucuccuccgucgucaccgucccaucauccucccuaggaacccaaaccuacaucuguaauguaaaccacaaaccaucaaacacaaaaguugauaagaaaguagaaccuaaauccugcgacaaaacccauaccugcccacccugccccgcacccgagcuccucggcggacccagugucuuccuauucccacccaaacccaaagacaccuuaaugaucucaagaacccccgaaguuaccugcgucgucgucgacgucucccacgaagaccccgaagucaaauucaacugguacguugacggaguagagguccacaacgccaaaaccaaaccacgcgaagaacaauacaacuccacauaucgcgucguaagcguacucacagugcuacaccaggacuggcucaacggcaaagaauacaaaugcaaagucuccaacaaagcccuccccgcaccaaucgagaaaacuaucuccaaagccaagggccaaccacgcgaaccacaagucuacacccuacccccaucacgagaagaaaugaccaaaaaccaagucucacucacgugccucguaaaaggcuucuaccccuccgacauagcagucgaaugggaaucaaacggccaaccggaaaacaacuacaaaacaacacccccaguacucgacucagacggguccuucuuccucuacuccaaacucacuguagacaaaucccgauggcaacaaggaaacgucuucuccugcucaguaaugcacgaagcccuccacaaccacuacacccaaaaaucccucucccuuucccccggcaaa

SEQ ID NO: 58794 - RNA, 1365 nt, Artificial Sequence
  derived and/or modified sequence opt11 from anti-influenza_Chain
gaaguccagcuaguccaauccggcggcggcgucguucaacccggcaaaagccuccgccucuccugcgccgccuccggccucaccuuuuccuccuacgccguccacuggguccgacaagcccccggcaaaggccuggaaugggucacccucaucuccuacgacggcgccaaccaauacuacgccgauuccguaaaaggccgcuucaccaucucccgggauaacagcaaaaacacagucuaccuccaaaugaacucucuccgucccgaagacaccgccgucuacuacugcgccguacccggcccaguauucggcaucuucccgcccuggucauacuucgacaacuggggccaaggcauccuaguaacaguaucaucugcauccacuaaaggcccaucagucuucccccucgcccccucaagcaaauccaccuccggcggcaccgcagcccuaggcugccucguuaaagacuauuuccccgaacccguaaccgucagcuggaacucaggcgcccuaaccagcggcguacacaccuuccccgcaguccuacaaagcucaggccucuauucccucagcuccgucgucacaguacccucauccucccucggcacccagacauacaucugcaacguaaaccauaaacccuccaacacaaagguagacaagaaagucgaacccaaauccugcgacaaaacacauacaugcccaccaugcccggccccugaacuccucggcggccccuccguauuccucuucccaccaaaacccaaagacacccuaaugauaucacgcacacccgaaguaaccugcgucguagucgacguuucgcacgaagaccccgagguaaaauucaacugguacgucgacggcgucgaaguucacaacgccaaaacaaaaccucgcgaagaacaauacaacuccacauaccgcgucgucucaguccucacaguccuucaccaagacuggcucaauggcaaagaauacaaauguaaaguauccaacaaagcccucccagcccccaucgagaaaaccauaucgaaagccaaaggccaacccagagaaccacaggucuacacacuaccacccucacgagaagaaaugaccaaaaaccaagucucccuuaccugccuagucaagggauucuaccccucagacaucgccgucgaaugggaaucaaacggacaacccgaaaacaacuacaaaacaacacccccaguccuagacuccgacggguccuucuuccucuacucaaaacucaccgucgacaaaucacgcuggcaacaaggaaacgucuucucaugcucagucaugcacgaagcccuccauaaccacuacacccaaaaaucacuuucacuuucacccgguaaa

SEQ ID NO: 58795 - RNA, 1365 nt, Artificial Sequence
  derived and/or modified sequence opt11 from anti-influenza_Chain
caaguccaacucgucgaaucuggaggcggcgucguacaacccggcaaaucccuacgacuauccugcgcagccuccggacucacauucuccuccuacgcuguccacuggguccgacaagccccaggaaaaggccucgaauggguaacacucaucuccuacgacggcgccaaccaguacuacgcugacucaguaaaaggccgcuucacaaucucacgagacaacuccaaaaacaccguauaccuucaaaugaacucacuccgcccagaagacaccgccgucuacuacugcgccguccccggccccgucuucggcauuuuucccccauggucauacuucgacaacuggggccaaggcauccuagucaccgucagcuccgccuccacaaaaggacccucagucuucccccuagcccccucaagcaaauccacaucaggcggcaccgccgcacucggaugccucgucaaagacuauuuccccgaaccagucacaguauccuggaacucaggcgcucucacguccggcguccacaccuuccccgcgguacuacaaucuuccggccucuacucccucagcuccguagucaccguccccuccuccucacuaggcacccagaccuacaucugcaauguaaaccacaaacccucaaacaccaaagucgauaagaaaguagaaccaaaauccugcgacaaaacccacacaugcccucccugccccgcacccgaacuccucggcggccccuccgucuuccucuuucccccgaaacccaaagacacacucaugauaucccgcacccccgaaguaaccugcgucgucguagacgucucccacgaagacccagaagucaaauucaacugguacgucgacgguguagaaguccacaacgccaaaaccaaaccccgcgaagaacaauacaacucaaccuaccgcguagucuccguccucacaguccuccaccaggacuggcuuaacggcaaagaauacaaaugcaaagucuccaacaaagcccuccccgccccaauagaaaagacaauaaguaaagcaaaaggacaaccccgagaaccacagguauacacacucccaccaucacgcgaagaaaugaccaaaaaccaagucucccuaacaugccuagucaaaggcuucuaucccuccgacaucgccgucgaaugggaauccaacggccaacccgaaaacaacuacaaaaccaccccaccaguacucgacuccgacggcuccuucuuccucuacuccaaacucaccgucgacaaaucccgcuggcaacaaggaaacgucuucuccugcucagucaugcaugaagcccuacacaaccacuacacccaaaaaucccuaagccuaucacccggcaaa

SEQ ID NO: 58796 - RNA, 1365 nt, Artificial Sequence
  derived and/or modified sequence opt11 from anti-influenza_Chain
caaguccaacucgucgaaucaggcggcggagucguccaaccaggcaaaucaccccgccuauccugcgccgcuucuggacccacauucuccucauacgccguucacuggguccgccaagcccccggcaaaggccucgaaugggugacccucaucuccuacgacggcgcaaaccaauacuacgcagacuccgucaaaggacgauucaccaucagccgagacaacuccaaaaacaccgucuaccuucaaaugaacucccuccgccccgaagacacugcaguauacuacugcgccguucccggccccgucuucggaaucuucccacccuggucauauuucgacaacuggggccaggguauccuggucaccgucuccuccgccuccaccaaaggucccuccgucuucccccucgcccccuccucaaaauccaccuccggaggcacagcagcccucggaugccuaguuaaagacuacuuucccgaaccugucaccguaucauggaacucaggagcccucaccucaggaguccacaccuuccccgccguacuccaauccucuggccucuacucccucuccuccgucguaaccguacccucauccucccuuggaacucaaacuuacaucugcaacgucaaccacaaacccuccaauacaaaaguugacaagaaagucgagcccaaauccugcgacaaaacccacacuugcccacccugcccagcccccgaacuucucgggggcccauccgucuuccucuucccgcccaaacccaaagacacccucaugauuucccgcacacccgaagucacuugcgucgucgucgacgucucucacgaagaccccgaagucaaauucaacugguacgucgacggcgucgaaguacacaacgcaaaaaccaaaccacgggaggaacaauacaacucuaccuaucgagucgucagcguauuaaccguccugcaccaagacuggcuaaacggcaaagaauacaaaugcaaagucucaaauaaagcccuccccgcccccaucgagaaaacuaucucuaaagcaaaaggccaacccagagaaccacaaguauacacccucccacccucucgagaagaaaugaccaagaaccaagucucccuaaccugccuagucaaaggauucuauccaucggacaucgccguagaaugggaauccaacggccaacccgaaaacaacuacaaaaccacaccucccguacucgacucagacggcuccuucuuccuauacucaaaacucacaguggacaaaucaagauggcaacaaggcaacgucuucucuuguucagucaugcacgaagcacuccacaaccacuacacccaaaaaucccucucccucucacccgguaaa

SEQ ID NO: 58797 - RNA, 1365 nt, Artificial Sequence
  derived and/or modified sequence opt11 from anti-influenza_Chain
gaaguccaacucguagaaucaggcggcggcgucguccaacccggcaaaucacuccgacuauccugcgccgccucgggccuaaccuucuccucuuacgccguacacuggguccgccaagcccccggcaaaggccuggaauggguaacccuaauaucauacgacggcgccaaccaauauuacgcagacuccgucaagggccgcuucaccaucucccgcgacaacagcaaaaauaccguauaccuccaaaugaacucacuucgaccagaagacaccgcagucuacuacugcgccguaccuggccccgucuucggcaucuuucccccuugguccuacuucgacaacuggggccagggcauccucgucaccgucuccucugccuccacaaaaggccccagcgucuucccccuagccccuuccucaaaaucaaccuccggcggcacagccgcacuuggcugccucguuaaggacuacuucccugaacccgucaccgucucuuggaacuccggcgcccucaccuccggcguacacaccuucccagcuguacuccagagcuccggccuuuacucccuaucaucaguagucaccguucccucgucuucucucggaacacaaacauacaucugcaacguaaaccacaaacccuccaacaccaaagucgacaagaaagucgaaccaaaauccugcgacaaaacccacacgugcccacccugccccgcccccgaacuccucggcggccccucaguauuccuuuucccacccaaacccaaagauacccuaaugaucagccgcacccccgaagucaccuguguaguaguagacgucucccacgaagaccccgaagucaaauucaacugguacguagacggaguugaaguccacaacgcgaaaacaaaaccccgagaagaacaguacaacuccaccuaccgaguagucuccguccuuacgguccuacaccaagacuggcucaacggaaaagaauacaaaugcaaagucucaaacaaagcacuccccgcccccaucgagaaaaccaucucaaaagcuaaaggccaaccccgcgaaccccaagucuacacacuacccccaucacgcgaagagaugaccaaaaaccaagucucccucacaugccuagucaaaggauucuaccccuccgacaucgccguggaaugggaaucaaacggacaaccugaaaacaacuacaaaacaaccccacccguucucgacucagacggcucauucuuccuuuacuccaaacucaccgucgacaaaucccgauggcaacaaggcaacguauucucaugcuccgucaugcacgaagcccuacacaaccacuacacacaaaagucccuuucccuaucccccgguaag

SEQ ID NO: 58798 - RNA, 1365 nt, Artificial Sequence
  derived and/or modified sequence opt11 from anti-influenza_Chain
cagguccaacucguccaauccggcgccgaacuuaaacgucccggagcaagcgucaaagucuccugcaaaacuucuggcuacagcuucaacaacuacggaauaaauuggguccgccaagcccccggccagggacuagaauggauggguuggaucuccgccuacaccggaaacacucacuacgccaaaaacuucgaaggccgcgucacacucacaaccgacaccuccacaucaaccgccuacauggaagugcgcucucuccguuccgacgacuccgccgucuacuucugcgcacgcgcaaugauccaaggagucguaacccucuaccuacggcccggagacuacuggggucaaggcacucucgucaccguaagcagcgccuccacuaaaggccccucaguauucccacucgcccccuccuccaaauccaccucaggaggcacagccgcccucggaugccucguaaaagacuacuuccccgaacccgucacaguuuccuggaacucaggcgcacucacauccggcguccacaccuuccccgccguccuccaaucauccggccuauauucacuaucauccguaguaaccguacccucauccucccuaggcacccaaacuuauauaugcaacgucaaccacaaacccucaaacaccaaagucgacaagaaagucgaacccaaaagcugcgacaaaacccacacaugcccucccugccccgcccccgaacuccucgguggacccucugucuuccucuucccgcccaaacccaaagacacccucaugaucagcagaacccccgaagucacaugcgucgucgucgacgucucacacgaagacccugaagucaaauucaacugguacgucgacggcgucgaaguacacaacgccaagacaaagccucgcgaagaacaauacaacucaacauaccgcgucgucagcguccucaccguccuccaccaagacuggcugaacggcaaagaauacaaaugcaaaguaagcaacaaagcacucccagcucccaucgagaaaaccauaucaaaagcaaaaggacagccccgagaaccccaaguauacacccuacccccaucccgcgaagaaaugaccaaaaaccaagugucacucacaugccucguuaaaggcuucuaccccucagacaucgccgucgaaugggaauccaacggacaaccagaaaacaacuacaaaaccaccccacccgucuuagacucagacggcuccuucuuccuauacuccaaacuuacaguagacaaaucccgauggcaacaaggcaacgucuucuccugcuccguaaugcaugaagcgcuccacaaccacuauacacagaaaucccuaucccucucccccggcaaa

SEQ ID NO: 58799 - RNA, 1365 nt, Artificial Sequence
  derived and/or modified sequence opt11 from anti-influenza_Chain
caaguucaacucgucgaauccggcggcggaguaguacaacccgggcgaucccucagacuauccugcgccgcauccggcuucgcauuccacaacagagccaugcacuggguacgucaagcaccaggaaaaggccucgaaugggucgcccuaauuuacuucgacggcucaaagcaauacuacgccgacucagucaaaggccgcuucaccauaucccgcgacaacagcaaaaacacaguauuccuccaaaugaacucacuucgacccgaagacaccgccgucuacuacugcgcaguccccggccccaucuucggcaucuucccacccugguccuacuucgaccacuggggacaaggcauccucgucaccgucucaagcgcauccacaaaaggccccuccguauuuccacucgccccaucaaguaaauccaccuccggcggaacagccgcccucggcugccucgucaaagacuacuuccccgaacccgucacagucuccuggaacucuggcgcacucaccagcgguguccacaccuucccagcaguccuccaauccuccgggcuauacagccuuucuagcguagucacaguaccaagcucaucccugggaacccaaacuuacaucugcaacgucaaccacaaaccauccaacaccaaaguagauaagaaagucgaacccaaaucaugcgacaaaacccacacuugcccaccaugccccgcccccgaacugcucggcggacccuccgucuuccucuucccacccaaacccaaagacacccucaugaucagccgaacccccgaagucacuugcgucgucguagacgucucccacgaagaccccgaaguaaaauuuaacugguacgucgacggcgucgaaguccacaacgccaaaaccaaacccagagaggaacaauacaacuccaccuaucgcguagucuccguacuaaccguccuucaccaagauuggcucaacggcaaagaguacaagugcaaagucucuaacaaagcccucccagcccccaucgagaaaaccauaucaaaggccaaaggccaaccacgagaaccacaagucuacacccuaccacccagccgcgaagaaaugaccaaaaaccaagucucccuaacaugccuaguaaaaggcuucuaccccuccgacauagccgucgaaugggaauccaacggacaacccgaaaacaacuacaaaaccacaccucccguacuagacuccgacggauccuuuuuccuauacuccaagcucaccgucgacaaaagccgcuggcagcaaggaaacguauucucaugcuccgucaugcacgaagcccuccacaaucacuacacccagaaaagccuuucacucuccccaggcaaa

SEQ ID NO: 58800 - RNA, 1365 nt, Artificial Sequence
  derived and/or modified sequence opt11 from anti-influenza_Chain
gaaguccagcuagucgagucaggagguggcgucguccaacccggccgaucccuccgccucuccugcgccgcaucuggauucgcauuccacaaccgagcaaugcacuggguacgccaggcccccggcaaaggccucgaauggguugcacucauuuacuucgacggcagcaagcaauacuacgccgacucaguaaaaggccgauucacaaucucacgugacaacuccaaaaacaccgucuuccuacaaaugaacucccuccgccccgaagacaccgcagucuacuacugcgccguccccgggccaauauucggcaucuucccacccugguccuacuucgaccacuggggucaaggcauccuugucacagucucuuccgccucaaccaaaggacccucagucuucccccucgcccccuccuccaagagcacguccggcggaacagccgcacucggcugccucgucaaagacuacuuccccgaacccgucacuguaucauggaacuccggagcccuaaccuccggcguccacaccuuccccgccguccuccaauccuccggccuuuacucacuuucuucuguagucacugugcccuccuccucacuaggcacccaaacauauaucugcaacgucaaccacaagcccucaaauaccaaaguagacaagaaagucgaaccgaaauccugcgacaaaacccacacaugcccgccgugcccagccccagaacuacucgguggccccuccgucuuccuauucccacccaaacccaaagacacccucaugaucucccgaacccccgagguaacaugcguagucguagacgucagccacgaagaccccgaaguaaaauucaacugguacgucgacggagucgaaguacacaacgcuaaaacgaaaccccgugaagaacaauacaacuccaccuaccgagucgucucaguacuaaccguccuccaccaagauuggcucaacggcaaagaauacaaaugcaaagucuccaacaaagcacucccagcacccaucgagaaaaccauuucaaaagccaaaggacaacccagagaaccacaagucuacacacuacccccauccagagaagaaaugaccaaaaaccaagucucucuaaccugccucgucaaaggauucuaccccuccgacauagcugucgaaugggaauccaacggccaacccgaaaacaacuacaaaaccaccccacccguccuagauucagacggcuccuucuuccucuacucgaaacuuacagucgacaaaucccgcuggcaacaaggaaacgucuucuccugcagcgucaugcacgaagcccuccacaaccacuauacacaaaaaucccucucacuaucccccgguaaa

SEQ ID NO: 58801 - RNA, 1365 nt, Artificial Sequence
  derived and/or modified sequence opt11 from anti-influenza_Chain
gaaguccagcuaguccaauccggcggaggcguuguacaacccggcaaaucccugcgucuuuccugcgcagcauccggacucacauucuccucauacgcaguucauuggguccgacaggcacccggcaaaggccucgaaugggucacccuaaucucauacgacggcgcaaaccaauacuacgccgacuccguaaaaggacgcuucaccauaucccgcgacaacucuaaaaacaccgucuaccuccaaaugaacucacuacgucccgaagacaccgccguuuacuacugcgcuguacccggacccguauucggcauauucccacccuggucuuacuucgacaauuggggccagggcauucucgucaccgucuccuccgccuccaccaagggccccucaguauucccccucgcacccagcucaaaauccaccucaggcggcaccgccgccuuaggcugccucgucaaagacuacuuccccgaacccguaaccguauccuggaacuccggagcccuaacaucuggcgugcacaccuucccagccguccuacaauccucaggccucuacucccuauccucagucgucacaguccccuccuccucccucgguacccaaacuuacaucugcaacgucaaccacaaacccucaaacaccaaggucgacaagaaagucgaaccaaaaucuugcgacaaaacccacacaugucccccaugccccgcccccgaacuacucggcggcccauccgucuuccuauucccacccaaacccaaagacacccuuaugaucucccgcacccccgaagucacaugcguugucgucgacguuucucacgaagaccccgaagucaaauucaacugguacgucgacggcgucgaaguccacaacgccaaaaccaaaccccgcgaggaacaauacaacuccacauaccgagucguaucaguccuuaccguucuccaccaagacuggcuaaacggaaaagaauacaaaugcaaagucuccaacaaagcacuccccgcccccaucgaaaagaccauuucaaaagccaaaggacaaccacgagaaccacaagucuacacucuacccccauccagagaagaaaugaccaaaaaccaagucucacuaacaugccucguuaaaggcuucuaccccagcgacaucgccgucgaaugggaauccaacggccaacccgaaaacaacuacaaaaccacuccucccguccucgacucugacggcuccuucuuccucuacucaaaacucaccgucgacaaaagccgauggcaacaaggcaacguauucuccugcuccgucaugcacgaagcccuacacaaccacuacacccagaaaucccucucccucagccccggcaaa

SEQ ID NO: 58802 - RNA, 1365 nt, Artificial Sequence
  derived and/or modified sequence opt11 from anti-influenza_Chain
cagguacaacuugucgaauccggaggaggcgucguacaacccggaaaaucccuccgccucagcugcgcagccucaggccucaccuucucaagcuacgccguccacuggguccgccaagcgcccggaaaaggccucgaaugggucacccuaauuucauaugacggcgccaaccaauauuacgccgacuccguuaaaggacgcuucacaaucagccgcgacaacuccaaaaacaccgucuaccuucaaaugaacagcuuacgacccgaagacaccgccguauacuacugcgccgucccaggccccguauucggaaucuuuccacccugguccuacuucgacaacuggggacaaggcauccuagucaccgucucauccgcaagcacgaaaggccccuccguuuucccccuagccccaucuuccaaauccaccuccgguggcaccgcagcccuaggcugccucguaaaagacuauuucccagaacccgucacggucucguggaacucgggcgcccucacauccggaguccacacauuccccgccguacuccaauccuccggacucuacucacuaucauccgucgucacuguccccucauccucccuaggcacccaaaccuacaucugcaacgucaaccacaaaccauccaacaccaaagucgacaagaaagucgaacccaaauccugcgacaaaacccacaccuguccacccugccccgcccccgagcuccucggcggccccuccgucuuccucuucccacccaaacccaaagacacccucaugauaucucgcacccccgaaguaaccugcgucgucgucgacgucucacacgaagaccccgagguuaaauucaacugguacguagacggcgucgagguccacaacgcaaaaaccaaaccccgcgaagaacaauauaacuccaccuaccguguagucucaguacuaaccguucuccaccaagacuggcucaacggcaaagaauacaaaugcaaaguauccaacaaagcccuccccgcaccaaucgagaaaaccaucucaaaagccaaaggccaaccccgcgaaccccaagucuacacacuacccccuucccgagaagaaaugaccaaaaaccaagucuccuuaaccugccucgucaaaggcuucuaccccuccgacaucgcaguagaaugggaauccaacggacaacccgaaaacaacuauaaaacuaccccacccguccucgacagcgacggcuccuucuuucucuacucuaaacuaacagucgacaagucacgcuggcaacaaggaaacguauucucaugcagcgucaugcaugaagccuuacacaaucacuauacccaaaaaucccuaucccucucacccggcaaa

SEQ ID NO: 58803 - RNA, 1365 nt, Artificial Sequence
  derived and/or modified sequence opt11 from anti-influenza_Chain
caaguccaacuuguugaaucaggcggcggagucguccagcccggcaaaagcccccgccucuccugcgccgccuccggccccaccuucuccuccuacgccgugcacugggucaggcaagcccccggaaaaggccucgaaugggucacccuaauauccuacgacggagcuaaccaauacuacgccgacucaguaaaaggccgauucaccaucucccgcgacaauuccaaaaacaccgucuaccuccaaaugaacucccucagacccgaagacaccgcaguauacuacugcgccguacccgggcccgucuucggcaucuucccacccuggagcuacuucgacaauuggggacaaggcauacucgucacugucuccucagccuccacuaaaggacccagcguauucccccucgcccccucuagcaagucaaccagcggaggaaccgccgcccucggcugccucgucaaagacuacuuccccgaacccgucaccgucuccuggaacagcggcgcccucacauccggaguacacaccuuccccgccguccuccaauccaguggccuauacucccuaagcuccgucguaacaguacccucguccucccucggcacccagaccuacauauguaacgucaaccacaaaccaagcaacacaaaaguggacaagaaaguagaacccaaauccugcgacaaaacacauaccugcccucccugccccgccccagaacuccuaggcggccccagcgucuuccucuuuccacccaaacccaaagacacacucaugaucucccgcacccccgaaguuaccugcguagucguagacgucucucacgaagacccagaagucaaauucaacugguacgucgacggcguagaaguccacaacgccaaaaccaaaccacgagaagaacaauacaacucaaccuaccgaguagucucugugcuuaccguacuccaccaagacuggcuuaacggaaaggaauacaaauguaaaguauccaacaaggcucuccccgcccccaucgaaaagaccaucucaaaagccaaaggccaaccacgcgaaccccaagucuacacacucccacccucacgcgaagaaaugaccaaaaaccaagucucucuuaccugccuagucaaaggcuucuacccguccgacauagccguagaaugggaaucaaacggacaaccggaaaacaacuacaaaaccacacccccuguucucgacagcgacgguuccuucuuccuauacuccaaacucaccguugacaaaucacgauggcaacaaggaaacgucuucuccugcucagucaugcacgaagcccuucacaaccacuacacccaaaaaucccucucacucucccccggcaag

SEQ ID NO: 58804 - RNA, 1365 nt, Artificial Sequence
  derived and/or modified sequence opt11 from anti-influenza_Chain
gaaguccaacucguggaauccggcggcggcgucguacaacccgguaaaucccuccgccuuucaugcgcagccucaggccucaccuucuccuccuacgccguccacuggguccgacaagcacccggaaaaggacucgaaugggucacccuuaucucauacgacggcgcaaaccaauacuacgccgacucuguaaaagguagauucaccauaucccgggacaacuccaaaaacacagucuaccuacaaaugaacucccuacgccccgaagacaccgccgucuacuacugcgccgucccaggccccguauucggcauauucccucccuggucauacuucgacaacuggggccagggcauccuaguaaccgucucauccgccuccacaaagggacccucagucuucccccucgccccaucauccaaauccaccucuggaggcacagccgcccucggcugccuugucaaggacuacuuccccgaacccguaaccgucagcuggaacucaggcgcauuaacgagcggcguccacaccuucccagccguccuacaaagcuccgggcucuacucccucuccucaguaguaaccguccccuccuccucccuaggaacccaaaccuacaucugcaacgucaaccacaaacccucaaauacaaaagucgacaagaaaguugaacccaaaagcugugacaaaacacacaccugucccccaugcccagcccccgagcuacuaggcggccccucagucuuccucuucccacccaaacccaaagacacccucaugauaucucgcaccccggaagucacaugcgucguagucgacgucagccacgaagacccugaagucaaauucaacugguacgucgacggcgucgaaguacacaacgcuaaaaccaagccccgcgaagaacaguacaacagcaccuaccgcgucguauccguccucaccguccuacaccaagacuggcuuaacggcaaagaauacaagugcaaagucucaaacaaagcccuacccgcccccaucgagaaaaccaucaguaaagcaaaaggccaaccccgcgaaccccaaguauacacacucccucccucccgagaagaaaugaccaaaaaccaagucucacuuaccugccucgucaaaggcuucuaccccuccgacaucgccguagaaugggaauccaacggacaacccgaaaacaacuacaaaacuacacccccaguucuagacucagacggcucguucuuccuauacucaaaacuaaccguagacaaaucacgcuggcaacaaggcaacgucuucuccugcucagucaugcacgaagcacuccacaaccacuacacccaaaagucccucucccucucccccggaaaa

SEQ ID NO: 58805 - RNA, 1365 nt, Artificial Sequence
  derived and/or modified sequence opt11 from anti-influenza_Chain
caaguccaacucguccaauccggcgccgaacuaaaaagaccaggcgccuccgucaaaguaucuugcaaaaccuccggcuacuccuucaacaacuacggcaucaacuggguuagacaagcacccggacaaggccucgaauggaugggcuggauaagcgccuacacuggcaacacacacuacgccaaaaacuucgaaggccgcgucacccucaccaccgacaccucaacauccaccgccuacauggaaguccgaucgcuccgauccgacgacucagccgucuacuucugcgcacgagccaugauccaaggggucgucacacucuaccuucgccccggcgacuacuggggacaaggcacccuaguaaccgucuccuccgccuccaccaaaggacccuccgucuucccacucgcccccucaucaaaauccaccucaggaggcaccgccgcccucggcugccucguaaaagacuacuuccccgaacccgucacaguauccuggaacucaggggcccucaccuccggcguacacaccuuccccgcaguccuccaauccucuggacucuacucccuaucauccgucguaacuguacccucauccagccucggcacacaaaccuauaucugcaacguuaaccacaaacccuccaacacaaaagucgacaagaaagucgaacccaaaucuugcgacaaaacacauaccugcccucccugccccgcccccgaacuccuagggggccccucggucuuccucuucccacccaaacccaaagacacccucaugauaucccgcacccccgaagucacaugcguagucgucgacgucucccacgaggaccccgaaguaaaauucaacugguacguugacggcgucgaaguccacaacgcaaagaccaaaccacgcgaagaacaauacaacuccaccuacagagucguuagcguccucaccguucuccaccaagacuggcuuaacggcaaggaauacaaaugcaagguuuccaacaaagcccuuccagccccaaucgagaaaaccaucuccaaggccaaaggccaaccacgcgaaccccagguauacacccuaccacccagccgcgaagaaaugacaaagaaucaaguaucacugaccugccucgucaaaggauucuaccccucugacaucgccgucgaaugggaauccaacggccaacccgaaaacaacuacaaaaccaccccgccaguccuagauuccgacggauccuucuuccuauacuccaaacucaccgucgacaaaucccgauggcaacaaggaaaugucuucagcugcucaguaaugcacgaagcccuccacaaccacuacacccagaaaagccuaucccucucucccggcaaa

SEQ ID NO: 58806 - RNA, 1368 nt, Artificial Sequence
  derived and/or modified sequence opt11 from anti-influenza_Chain
gaaguccaacucguccaauccggcggaggcgucguacaaccccgccgcucccuaagacucucaugcgccgccucaggcuuuaccuucuccuccuacgccaugcacuggguacgccaagccccaggcaaaggccuagaaugggucgccguaauaucauaugacggacgcaacaaguacuacgcggacuccgucaaaggacgcuucacagucucccgcgacaacaguaaaaacacccuauaccugcaaaugaacucccuacgggccgaagacacauccgucuacuacugcgcccgcgaacuacucauggacuacuacgaccacaucgguuacucccccggaccuaccuggggucaaggaacacucguaacaguuucaagcgccagcaccaaaggcccauccgucuucccauuagcccccaguuccaaaucaaccuccggcggcaccgcagcccuaggcugccuuguaaaagacuacuuccccgaacccgucaccguuucauggaacuccggcgcccuaaccagcgguguccacaccuuccccgcagugcuccaaucuuccggccuuuacagccuauccuccgucgucaccguaccuucuucuucccucggcacccaaaccuacaucugcaacguuaaccacaaaccaucaaacaccaaaguagacaaacgcgucgaacccaaauccugugacaaaacccauaccugcccucccugccccgccccagaacuccuuggaggccccagcgucuuccuauucccacccaaacccaaagacacacucaugauaagccgcacacccgaagucacuugcgucgucgucgacgucucacacgaagaccccgaggucaaauucaauugguacgucgacggagucgaagugcacaacgccaaaaccaaaccccgcgaggaacaguacaacucgacauacagaguaguauccguccuaacaguccuccaccaagacuggcucaauggcaaagaauacaagugcaaggucuccaacaaagcccucccagccccaauugagaaaaccauauccaaggccaaaggccaaccccgcgaaccacaagucuacacccucccacccucccgcgaagaaaugaccaagaaccaagucucucuuaccugccucgucaaaggcuucuaccccucugacauagcagucgaaugggaaagcaacggccaaccagaaaacaacuacaaaacaacacccccaguccucgacuccgacggcucauucuuccucuacucgaagcuaaccguugacaaaucccgauggcaacaaggcaacguauucuccugcucagucaugcacgaagcccuacacaaccacuacacccaaaagucccuuucacucucaccagggaaa

SEQ ID NO: 58807 - RNA, 1371 nt, Artificial Sequence
  derived and/or modified sequence opt11 from anti-influenza_Chain
auggucauccaacgcaacuccauccuacuucuaaucauaaucuuugcauccuccauuuccacaugccgaagcaacgucaucgacgacaaccuuuucaaacaagucuacgacaauauccuagagcaagaguucgcacacgacuuccaagcguaccucuccuaccuauccaaaaacauagaauccaacaacaacauugacaaagucgacaaaaacggcaucaaagucauaaacguccuuucauucggcgccaaaggagacggcaaaaccuacgacaacaucgccuucgaacaagccuggaacgaagcauguucaucccggaccccaguacaauucgucguucccaaaaacaaaaacuaccuacuuaaacaaaucaccuucuccggaccgugccgcuccuccauaucagucaaaauauucggcagccucgaagccucauccaagauauccgacuacaaagaccgacgccucuggaucgccuucgacuccguccaaaaccuaguaguaggcggcggcggaaccauaaacggaaacggccaagucugguggcccuccucaugcaaaaucaacaagucacuccccugcagagacgccccgaccgcacuuacguucuggaacugcaagaaccugaaagucaacaaccucaaauccaagaacgcacaacaaauacacaucaaauucgaauccugcaccaacguagucgcauccaaucuaaugaucaacgcauccgccaaaucccccaacaccgacggcguccacgucuccaacacacaauauauccaaaucagcgacaccaucaucggcacaggcgacgacugcaucucaaucgucucaggaucccaaaacguacaagcgaccaacauaaccugcgggccaggucacggaaucuccaucggcucucucggcucaggcaacuccgaagccuacgucuccaacgucaccgucaacgaagcaaaaaucauuggagccgaaaacggaguccgcauaaaaaccuggcaaggaggcuccggccaagccuccaacaucaaauuccucaacguagaaaugcaagacgucaaauaccccaucaucaucgaccaaaacuacugcgaccgcgucgaacccugcauacaacaauucagcgccguccaagucaaaaacgucgucuacgaaaacauaaaaggaacaagcgccaccaaagucgcaauaaaauucgacugcucaaccaacuuccccugcgaaggaauaaucauggaaaacaucaaccucgucggcgaaucaggcaaacccucugaagcaaccugcaaaaacguccacuucaacaacgccgagcacgucacaccccacugcaccucgcucgaaaucucagaagaugaagcacuccuauacaacuac

SEQ ID NO: 58808 - RNA, 1371 nt, Artificial Sequence
  derived and/or modified sequence opt11 from anti-influenza_Chain
auggucauccaacgcaacagcauccuacuccucaucaucauauucgccuccucuaucuccacaugccgauccaacgucauagacgacaaccucuucaaacaagucuacgacaacauccucgaacaagaguucgcccacgacuuccaggccuaccuuuccuaccuauccaaaaacauagaaagcaacaacaacaucgacaaagucgacaaaaauggaauaaaagucaucaacguccucuccuucggcgccaaaggcgacggcaaaaccuacgacaacaucgccuucgaacaagccuggaacgaagccugcuccagcagaaccccgguccaauucgucguccccaaaaacaaaaacuaccuacugaaacaaauaaccuucucaggcccaugccgcuccuccaucagcgucaaaaucuucggcucccucgaagccagcucaaaaaucuccgacuacaaagacagacgacuauggaucgccuucgacucaguccaaaaccuagucgugggcggcggaggcaccauaaacgguaacggucaagugugguggccauccucgugcaaaaucaacaagagccuacccugccgcgacgccccaaccgcacucaccuucuggaacugcaaaaaccucaaagucaacaaccucaaauccaaaaacgcccaacaaauccacaucaaauucgaaucaugcacaaacguagucgccuccaaccucaugauuaacgcuuccgcgaaaucccccaacacagacggcguccacgucucaaacacccaauacauccaaaucuccgacaccaucaucggcaccggcgacgacugcauaucgaucguuuccggcagccaaaacguccaagcaaccaacauaaccugcggcccaggacacgguaucucaaucggaagccucggcuccggcaauagcgaagccuacgucucaaacgucaccgucaacgaagccaaaaucauuggagcggaaaacggcguccgcaucaaaaccuggcaaggcggcagcggccaagccagcaacaucaaauuccuaaacgucgagaugcaagacguaaaauacccgaucauaaucgaccaaaacuacugcgaccgcgucgagcccugcauccaacaauucuccgcaguacaagucaaaaacguagucuacgaaaacauaaaaggcacgucggcaaccaaagucgccaucaaauucgacugcuccaccaacuuccccugcgaaggcauaaucauggaaaacaucaaccucgucggcgaaucaggcaaaccaagcgaagcaaccugcaaaaacguccacuucaacaacgccgaacacgucacaccccacugcaccucacucgaaaucagcgaagacgaagcccuccuguacaacuac

SEQ ID NO: 58809 - RNA, 1380 nt, Artificial Sequence
  derived and/or modified sequence opt11 from anti-influenza_Chain
augaaacucuggcucaacuggaucuuccucgucacacugcugaacgacauccaaugcgaagucaaacucgucgaauccggcggcggccuaguccaaccaggcggcucccuacgccucuccugcgcaaccaguggcuucaccuucuccgauuacuacauguccuggguacgccagucccccggcaaagcccuagaauggcuuggauucaccagaucacgcguccucggcuacaccaccgacuacuccgccuccgucaaaggccgcuucaccaucucccgcgacaacucccaaucaauccucuaccuucaaaugaacucacuccgaggcgaggacuccgccaccuacuacugcgcacgagaccgccccauggacuacuggggccaagguaccuccguuaccguuuccuccgcaaaaaccaccccacccuccgucuacccccucgcccccggcuccgccgcccaaaccaacagcaugguaaccuuaggcugccucgucaaaggcuacuuccccgaacccguuacagucacauggaacucaggaucacucuccuccggcguacacaccuuccccgcaguucuccaauccgaccuguacacacucuccuccuccgucaccguccccucaucaaccuggcccucagaaaccguaaccugcaacgucgcccaccccgcauccucaacaaaagucgacaaaaagaucgucccaagagacugcggcugcaaaccaugcaucugcaccguccccgaggucuccuccgucuucaucuucccaccgaaaccaaaagauguccucaccaucacccucacacccaaaguaaccugcgucgucgucgacauauccaaagacgacccagaaguccaauucagcugguucgucgacgacgucgaaguccacacagcccaaacccaaccccgcgaagaacaauucaacucaaccuuccgcuccguaucugaacuccccauuaugcaccaagacugguuaaauggcaaagaguucaaaugccgagucaacagcgccgccuuccccgccccaaucgaaaagacaauauccaagacaaaaggccgccccaaagccccacaaguauacaccauaccaccaccaaaagaacaaauggccaaggacaaagucucccuaaccugcaugauaaccgacuucuuccccgaagacaucaccgucgaguggcaauggaacggccaaccagccgaaaacuacaaaaacacccaacccauaauggacaccgacggcuccuacuucguauacuccaaacucaacguccaaaagucaaacugggaagcaggcaacaccuuuaccuguucaguccuacacgaaggccuccacaaccaccacaccgaaaaaucccuaucacacuccccaggcaaa

SEQ ID NO: 58810 - RNA, 1380 nt, Artificial Sequence
  derived and/or modified sequence opt11 from anti-influenza_Chain
augaaacucuggcuuaacuggaucuuccuagucacccuacucaacgacauccaaugcgaagucaaacucgucgaaagcggcggcggccuuguccagcccggaggaucgcuccgccuauccugcgcaaccuccggcuucaccuucuccgacuacuacauguccuggguccggcaaucacccggcaaagcacucgaauggcuaggauucacccgaucccgaguccuaggcuacacuaccgacuacuccgccucaguuaaaggccguuucaccaucucccgcgacaacucgcaaucaauccuauaccuacaaaugaacucccuaagaggcgaagacucagcaacguacuacugcgcccgcgaccgcccuauggacuauuggggccaaggcaccagcgucaccguuuccucagccaaaacaaccccacccuccgucuacccccuagcccccggcuccgcagcccaaaccaacuccauggucacccuuggaugccucguaaaaggcuauuuccccgaacccgucaccgucaccuggaacucagguucccugucuucuggcguccacacauuccccgccguccuccaaucagaucucuacacauugucuagcuccguaacaguccccucauccaccuggccuuccgaaaccguuaccugcaacgucgcccacccagcauccucaacuaaagucgacaagaaaaucgucccacgugacugcggcugcaaacccugcaucugcaccguccccgaagucuccucggucuucaucuucccacccaaacccaaagacguccucaccaucacccucacccccaaagucacaugcgugguugucgacaucuccaaagacgaccccgaaguccaauucuccugguucguagacgacguagaaguccacaccgcccaaacacaaccccgcgaagaacaauucaacuccaccuuccgcuccgucuccgaacuccccaucaugcaccaagacuggcucaacggaaaagaauuuaaaugccgcguaaauuccgccgcguucccagccccaauagaaaagaccauauccaaaacuaaaggccgcccaaaagcaccccaaguauacaccaucccaccacccaaagaacaaauggccaaagacaaagucucccuaaccugcaugauaaccgacuucuuccccgaagacaucaccguagaauggcaauggaacggucaacccgcagaaaacuacaaaaacacccaacccauaauggacacagacgguuccuacuucgucuauagcaaacucaacguccaaaaauccaauugggaagccggaaacacauucacaugcucaguccuccacgaaggacuacacaaccaccacaccgaaaaaucacucucccacucacccggcaaa

SEQ ID NO: 58811 - RNA, 1386 nt, Artificial Sequence
  derived and/or modified sequence opt11 from anti-influenza_Chain
auggaauggucauggaucuuccucuuccuccuaagcggaaccgccggcguccacucggaaguccaacuccaacaauccggccccgaacucguaaaacccggcgccuccgucaaaauguccugcaaagccucaggcuauacauucaccucauacgucaugcacugggucaaacaaaaacccggacaaggccuagaauggaucggcuacaucaaccccuacaaugacggcacccgguacaacgaaaaauuccgugucaaagccacccuaaccuccgacaaaucgucauccacagcauacauggaacuaucaucacucaccuccgaagacuccgccgucuacuacugcgcgcggcguggccucaucacaacccccacccucgacuacuggggccaaggaacgacccucacaguaucauccgcgaaaaccaccccucccucagucuacccccucgcccccggaucagccgcacaaaccaacuccauggucacacucggcugccuagucaaaggcuacuuccccgaaccaguuaccguaacauggaacucuggcucccucucaucaggaguccacacauucccugcaguucuccaaucagaccucuacacccucuccagcuccgucaccguccccuccagcaccuggccauccgaaaccguaaccugcaacgucgcacaccccgcauccucaacaaaagucgacaagaaaaucgucccacgcgacugcggcugcaaaccaugcaucugcacaguccccgaagucuccuccgucuucaucuuucccccaaaacccaaagacguccuaacaauaacccucacccccaaaguaaccugcguagucgucgacauuuccaaagacgaccccgaaguccaauucagcugggucgacgacgucgaaguccacaccgcccaaacccaaccccgcgaagaacaauucaacagcaccuuccguagcgucuccgaacucccaauaaugcaucaagacuggcucaacggcaaagaguucaagugccgcgucaacagcgccgcguuccccgcccccaucgaaaagaccaucuccaaaaccaaaggacgcccaaaagcaccccaaguauacaccauuccaccacccaaagaacaaauggccaaagacaaagucucccuaaccugcaugaucaccgacuucuuccccgaagacaucaccgucgaauggcaguggaacggccaaccugccgaaaacuacaaaaacacccaaccaauaauggacaccgacggauccuacuucguuuacagcaaacucaacguacaaaaauccaacugggaagccggcaacaccuuuaccugcagcguucugcacgaaggccuccacaaccaccacaccgaaaaaucccucucccacuccccaggcaaa

SEQ ID NO: 58812 - RNA, 1386 nt, Artificial Sequence
  derived and/or modified sequence opt11 from anti-influenza_Chain
caaguccaacucguccagagcggcgccgaaguaaagaaacccggcgccuccgucaaaguauccugcaaaaccuccggauacaccuucaccgccuacaccauccacuggguccgccaagccccaggccaacgccucgaauggauggguuggaucaacgccggaaacggccacacaaaauacagccaacgcuucaaaggccgcgucacgauaacacgagacaccucugcaaggaccaccuacauggaacuacgcucccucacuucagaagacaccgcuuuauacuucugcgcacgaggcccugaaacauacuauuacgacaaaaccaacuggcuaaacucccacccagacgaauacuuccaacacuggggccacggcacccaaguaaccgucucuuccgcuuccaccaaaggacccuccgucuucccccucgcccccagcuccaaaucuaccucaggaggcaccgccgcccuaggcugccucguaaaagacuacuuccccgagccgguaacagucagcuggaacuccggagcccucaccucugguguacacaccuucccagccguccuccaauccuccggccucuacucacucucuucaguaguaaccgucccuuccuccagccuaggcacucaaaccuacaucugcaacgugaaccacaaacccucuaacaccaaagucgacaagaaagucgaacccaaaucaugcgacaaaacccacacaugcccucccugcccggcccccgaacugcucggaggccccagcguauuccucuucccacccaaaccaaaagacacccucaugaucucacgcaccccagaagugaccugcgucgucgucgacgucucccacgaagaccccgaagucaaauucaacugguacgucgacggcguagaagugcacaaugccaaaaccaaaccccgcgaagaacaauacaacuccaccuaccgagucgucuccguccucacuguccuccaccaggacuggcuaaacggcaaagaauacaaaugcaaagucuccaacaaagcccuuccagcaccaaucgaaaagaccauaucgaaagccaaaggccaaccacgcgagccccaaguauacacacucccacccucacgcgacgagcuaaccaaaaaccaaguaucccuuacaugccucguaaaaggcuucuacccuuccgacaucgccgucgaaugggaaucaaacggccagcccgaaaacaacuacaaaacaaccccucccguccucgacuccgacggaucauuuuuccucuacuccaaacucaccgucgauaaaucccgcuggcaacaaggaaacgucuucucgugcuccgucaugcacgaagcucuccacaaccacuacacccaaaaaucacucucccucucacccggcaag

SEQ ID NO: 58813 - RNA, 1386 nt, Artificial Sequence
  derived and/or modified sequence opt11 from anti-influenza_Chain
caaguccaacucguacaaucgggagcagaagucaagaaacccggcgcaucagucaaagucucaugcaaaacauccggcuacaccuucacagcuuacacuauccacuggguccgccaagcccccggccaacgccuagaauggaugggcuggauuaacgccgguaacggacacaccaaauacucacaacgcuucaaaggacgagucaccaucacccgagacaccuccgcccgcacuacuuacauggaacuacgaucacucaccuccgaagacaccgcccuuuacuucugcgcccgcggacccgaaaccuacuacuacgacaaaacaaacuggcucaacucccacccugacgaauacuuccaacacuggggacacggcacacaaguaaccguaucaucugccucaaccaaaggccccuccgucuucccccucgcccccuccuccaaauccacaucaggcggaacagcugcccucggcugucuagugaaagacuacuucccagaaccaguaacaguaagcuggaacuccggcgcccucacaagcggcguccauaccuuccccgccguccuccaaucauccggacucuacagccuauccuccgucgucaccguacccucaucaucccucggcacccagaccuacauuugcaacgucaaccauaaacccagcaacacaaaagucgacaagaaagucgaacccaaaucgugcgacaaaacccacacaugucccccaugccccgccccagaacuccuaggcggacccuccgucuuccucuucccucccaaacccaaagacacccucaugaucucacgaacccccgaaguaaccugcgucgucgucgacguaucccacgaagaucccgaagucaaauucaacugguacgucgacggcgucgaaguccacaaugccaaaaccaaaccccgagaagaacaauacaacuccacguaccgaguuguauccguccugacaguccuacaccaagacuggcucaacggaaaagaauacaaaugcaaaguaucaaacaaagcacuccccgcccccauagaaaagaccaucuccaaagccaaaggccaaccccgcgaaccucaagucuacaccuugccacccucccgcgacgaacucaccaaaaaccaggucagccucacaugccuagucaaaggauucuauccuuccgacauagccguagaaugggaauccaacggacaacccgaaaacaacuacaaaaccaccccucccguacuagacucagacggcucauucuuccuuuacuccaaacuaaccgucgacaaaucacgcuggcaacaaggcaacgucuucuccugcagcguaaugcacgaagcacuacacaaccacuacacccaaaaaucccucucacucucccccggcaaa

SEQ ID NO: 58814 - RNA, 1386 nt, Artificial Sequence
  derived and/or modified sequence opt11 from anti-influenza_Chain
auggaaugguccuggaucuuccucuuccuccucucuggcacugcaggcguccacuccgaaguacaacuccaacaguccggacccgaauuagucaaaccaggcgccuccgucaaaauguccugcaaagcaagcggauacaccuucaccucuuacguuaugcauuggguaaaacaaaaacccggccaaggccucgaauggauuggcuacaucaaccccuacaacgacggaacccgcuacaacgaaaaauucagaguaaaagccacccucaccagcgacaagucauccagcacagccuacauggaacucucaucacucacuucagaagacagcgccgucuacuacugcgcccgccgcgggcucaucaccaccccaacacucgauuacuggggccaaggcaccacccucaccgucuccucagccaagaccacaccgcccucaguauacccccucgcacccggaucagccgcccaaaccaacucaauggucacacugggcugccucgugaaaggauauuuccccgaacccguaaccgucacauggaacucaggcagccucucaucaggcguacacaccuucccagccguccuccaaucggaccuauacacccucuccuccuccgucaccguccccuccagcaccuggcccuccgaaaccguaaccugcaacgucgcacaccccgcaucauccacaaaagucgacaaaaagaucgucccacgagacugcggcugcaaaccaugcaucugcaccguacccgaagucuccucaguauucaucuucccacccaaacccaaagacguccuaaccaucacccuaacccccaaggugaccugcgucguagucgacaucagcaaggacgaccccgaaguccaguucucaugggucgacgacguagaaguccacacugcacaaacccaacccagagaagaacaguucaacucaaccuuccgauccgucucagaacuccccaucaugcaccaagauuggcucaacggaaaagaguucaaaugccgcgucaacuccgcggcauuccccgcccccaucgagaaaaccaucuccaaaacaaaaggccgccccaaagcaccacaagucuacacaaucccaccacccaaagaacaaauggccaaagacaaagucucccuaaccugcaugaucaccgauuucuuccccgaagacaucacagucgaauggcaauggaacggacaacccgccgaaaacuacaaaaacacacaacccaucauggacaccgacggcuccuacuucguauacuccaaacucaacguccaaaaauccaacugggaagccggcaacaccuuuaccugcuccguccuccacgaaggccuccacaaccaccacacagaaaaaucccucagccacucccccggcaaa

SEQ ID NO: 58815 - RNA, 1398 nt, Artificial Sequence
  derived and/or modified sequence opt11 from anti-influenza_Chain
augcucccauccaccguccaaacccucacccuccuacucacaucaggcggaguacuccucucccucuacguaagcgcaucacuauccuaccuacucuacucugacguccuccucaaauucuccuccaccaaaacaaccgccccaacaauguccuuagaaugcacuaacgcuuccaacgcacaaaccguaaaccacucagccaccaaagaaaugaccuucccgccacccgaacccgaauggacauacccccgccucucaugccaaggcuccacauuccagaaagcacuccucaucucaccccacagauucggcgaaauaaaaggcaacuccgcuccccuaaucauccgcgaacccuucguagccugcggccccaaagaaugccgccacuucgcccucacacacuacgccgcacaacccggaggauacuacaacgguacgcgcaaagaccgaaacaaacuccgucaccucgucuccgucaaacuuggaaaaauaccaacagucgaaaacucaaucuuccacauggccgccugguccggauccgccugccacgacggccgcgaguggaccuacaucggcgucgacggacccgacaacgacgcccuugucaaaaucaaauacggagaagccuacaccgacaccuaccacucauacgcacacaacauacuccgaacacaagaauccgccugcaacugcaucgggggagacugcuaccucaugaucaccgacggcuccgcaucgggcauauccaaaugccgauuccucaaaauccgcgaaggccgcauuaucaaagaaauacuacccaccggccgagucgaacacaccgaagaguguaccugcggcuucgcaucaaacaaaaccauagaaugcgccugccgcgacaacuccuacaccgccaagcgacccuucguaaaacucaacgucgagacggacaccgccgaaauacggcucaugugcaccaaaaccuaccucgacacgccacgacccgacgacggcucuaucgccggcccaugcgaaucaaacggcgacaaauggcugggaggaaucaaaggaggcuucguccaccaaaggauggccucaaaaaucggccgaugguacucacgaacaaugucaaaaaccaaccgcaugggcauggagcuauaugucaaauacgacggcgaccccuggacagacucagacgcacucacacuaucaggcgucaugguauccaucgaagaacccggcugguauagcuucggcuucgaaaucaaagauaagaaaugcgacguaccaugcaucggaaucgaaaugguacacgacggcggcaaagacacauggcacagcgccgccacagcaauauacugccucaugggcuccggacaacuccugugggauacaguaaccggcgucgacauggcccuc

SEQ ID NO: 58816 - RNA, 1398 nt, Artificial Sequence
  derived and/or modified sequence opt11 from anti-influenza_Chain
augcuucccucaaccguccaaacucucacucuacuucuaacaagcggcggaguucuccuaucccuauacgucuccgccagccucuccuaccuccuauacucugacguacuccuaaaauucuccagcaccaagaccacagcaccaacuaugucacuagaaugcacaaacgccucaaacgcacaaaccgucaaccacucagccacuaaagaaaugaccuucccaccacccgaacccgaauggacauacccccgccuauccugccaaggcuccacuuuccaaaaagcacuccucaucucaccccaccgauucggugaaaucaaaggcaacucagcaccccucauaauacgagaacccuucguagccugcggacccaaagaaugccgacacuucgcccuaacacacuacgccgcacaacccggcggcuacuacaacggaacgcgcaaagaucgcaauaaacuccgacaccuagucuccguuaaacuugguaaaauucccacagucgagaacucaaucuuccauauggccgccugguccggcuccgccugccacgacggcagagaauggacauacaucggcgucgacggcccagacaacgacgcacucguaaaaaucaaauacggagaagccuacacagacacauaccacucauacgcccacaacauccuacguacccaagagagcgcaugcaacugcaucggaggcgacugcuaccuaaugaucaccgacggauccgccucuggaaucuccaaaugccgcuuccucaaaauccgcgaagggagaaucaucaaagaaauccuacccacuggccgagucgaacacaccgaagagugcacaugcggcuucgcaagcaacaaaaccaucgaaugcgccugccgagacaacucuuacaccgccaaacgccccuucguaaaacuaaacgucgaaaccgacaccgccgaaauccgacucaugugcaccaagaccuaccucgacacaccacgacccgacgacggcucaaucgccggcccuugcgaauccaacggagacaaauggcucggaggcaucaaaggcggcuuuguccaccaacgcauggcaagcaaaaucggcagaugguacucccgcacgauguccaaaaccaaccgcaugggcauggaacuauauguaaaauacgacggcgaccccuggaccgacucagacgcccucacgcucuccggaguaaugguauccaucgaagaaccaggaugguacuccuucggcuucgaaaucaaagacaagaaaugcgacguaccaugcauaggcauagaaaugguucacgacggaggcaaagacacauggcacuccgccgccaccgccauauacugccuaaugggcucaggccaacuccuaugggacacagucacaggagucgacauggcccua

SEQ ID NO: 58817 - RNA, 1407 nt, Artificial Sequence
  derived and/or modified sequence opt11 from anti-influenza_Chain
auggacuggaccuggagauuccucuucgucgucgccgccgcaaccggcguccaaucccaaguacaacugguacaaucaggggcagaaguaaaaaaacccggcucauccgucaaagucucaugcaaagccucgggaggaacccuaaacaacuacgccaucuccuggguccgccaagcccccggacaaggccucgaauggaugggcgggaucucccccaucuuuggcacccucaacuacgcagaacguuuccaagggagagucaccaucacagccgacguauucaccaacaccgucuauauggaacucuccucucuacguuccgaagauacagcaguuuacuucugcgcccgaggcugcggcuacaacugcuacuacuucgacggauggggacaaggcacacucguaaccgucucuagcgccagcaccaaaggccccucggucuucccccucgcacccucauccaaaucaacuucaggaggcaccgccgcccucgggugccucgucaaagacuacuuccccgaacccgucaccgucucauggaacuccggcgcccucaccuccggcguccacaccuuccccgcaguccuccaaucaagcggccucuacucccucuccuccguaguaaccguccccuccuccucucuuggcacccaaaccuacaucugcaacgucaaccacaaacccuccaacacaaaagucgacaaaaaagucgaacccaaauccugcgauaaaacccacacaugcccacccugcccagcccccgaacuacuuggcggccccucagucuuccuuuucccacccaaacccaaagacacccucaugaucagccgcacccccgaaguaaccugcguagucgucgacgucagccacgaagaccccgaagucaaauucaacugguacguagacggcguagaaguacauaacgccaaaaccaaaccccgagaagaacaguacaacucaaccuaccgugucgucuccguacuaacuguccuccaccaagacuggcucaacggcaaagaauacaaaugcaaagucagcaacaaagcccucccagcccccaucgaaaaaaccauauccaaagcaaaaggccaaccucgcgaaccccaaguauacacacucccacccuccagagacgaacucaccaaaaaccaagucucccuaaccugccucguaaaaggauucuaccccuccgacaucgcagucgaaugggaaucgaacggacaaccggaaaacaacuacaagaccacuccccccguccucgacucagacggaucauucuuccucuauuccaagcucaccgucgacaaaucccgcuggcaacaaggaaacguauucagcugcuccguaaugcacgaaggucuacacaaccacuacacacaaaaaucccuuucccucucaccaggcaaa

SEQ ID NO: 58818 - RNA, 1407 nt, Artificial Sequence
  derived and/or modified sequence opt11 from anti-influenza_Chain
auggacuggaccuggcgcuuccucuucguagucgccgccgccacaggcguccagagccaaguucaacugguccaaucaggugcagaaguaaagaaaccuggcagcuccgucaaagucucaugcaaagcaucuggcggcacccuaaacaacuacgcaaucuccuggguccgacaagcccccggccaaggccucgaauggaugggaggcauaucaccaaucuucgguacccuaaacuacgcugaacgauuccaaggcagagucacaaucaccgccgacguauucacaaacaccgucuauauggaacucucaucccugcgguccgaagacaccgcugucuacuuuugcgcccggggcugcggauacaacugcuacuacuucgacggcuggggccaaggcacccucguaaccguaucauccgccucaaccaaaggccccuccgucuucccgcucgccccauccagcaaauccacuuccggcggcaccgccgcccucggcugucuaguaaaagacuacuuccccgaaccaguaaccguuuccuggaacucuggugcacucaccuccggcguccacaccuuccccgccguccuccaaagcuccggacucuacucccucagcuccgucgucaccguccccagcucaucgcuagggacccaaaccuacauaugcaacguaaaccacaaacccuccaacacuaaagucgacaagaaaguggaacccaaaucaugcgauaaaacccacacaugcccacccugccccgcccccgaacuacuaggcggccccucagucuuccucuucccuccgaaacccaaagacacacucaugauauccagaacccccgaagucacaugcgucgucguagacguaucucacgaagacccagaaguaaaauucaacugguacguagacggcguagaagugcacaacgccaaaaccaaaccccgcgaagaacaauacaacucaaccuaccgagucgucagcguccucaccguccuccaccaagacuggcucaacggaaaggaauacaaaugcaaagucucuaacaaagcacuccccgcccccauagagaaaaccaucuccaaagccaaaggccaaccacgggaaccccaagucuacacccuacccccaucccgagacgaacucaccaaaaaccaaguaucccucacuugucuagucaaaggcuucuacccgucagacaucgccgucgaaugggaaucaaacggccaaccagaaaacaacuacaaaaccaccccaccaguacuagacucagacggcagcuucuuccucuacagcaaacucaccgucgacaaaucccgauggcaacaaggaaacgucuucuccugcuccgucaugcacgaaggacuccacaaccacuacacccaaaaaucccucucacucucccccggaaaa

SEQ ID NO: 58819 - RNA, 1407 nt, Artificial Sequence
  derived and/or modified sequence opt11 from anti-influenza_Chain
auggacuggaccuggcgcuuccuauucgucgucgccgccgccaccgguguccaaucgcaaguccaacucguacaauccggcgccgaagucaagaaaccaggcucauccgucaaaguaagcugcaaagcauccggcggcacccugaacaacuacgccaucuccuggguccgccaagcccccggucaaggccuugaauggaugggaggcaucucccccaucuucggcacacucaacuacgccgaacgcuuccaaggaagagucaccaucacugcggacgucuucaccaacaccguauacauggaacucuccucccuccgcagcgaagacacagcaguauacuucugugcacgcggcugcggcuacaacuguuacuacuucgacggcuggggccaaggcacccucgucaccguauccucagccucaaccaaaggcccauccgucuucccacucgcacccucauccaaauccaccagcggcggaaccgccgcacucggcugccucgucaaggacuacuuccccgaacccguaaccgucuccuggaacagcggcgcgcuaaccuccggagugcacaccuuccccgccguccuccaaucauccggccucuacagccuauccuccgucgucacgguucccagcucaucccucggcacucagaccuacauuuguaacgugaaccacaagcccuccaacaccaaggucgacaagaaagucgaacccaaauccugcgacaaaacccacacaugcccgccaugcccagcccccgaacuccucggagggcccucaguguuccucuucccacccaaacccaaagacacacucaugaucagccgaaccccagaaguuaccugcgucgucgucgacgucucacacgaagaccccgaagucaaauucaacugguacgucgauggcgucgaaguccacaacgccaaaacaaaaccucgcgaagaacaauacaacagcaccuaccgagucgucuccguucuaacaguccuacaccaagacuggcuaaacggcaaagaauacaaaugcaaagucucaaacaaagcccuccccgccccaaucgaaaagacaauauccaaagccaaaggccaaccccgcgaaccacaagucuacacccuacccccaucccgcgacgaacugaccaaaaaccaggucagccuaaccugccucguuaaaggcuucuaccccuccgacauagcaguagaaugggaaagcaacggccaaccagaaaacaacuacaaaacaacacccccuguucuagacagcgacggcucuuucuuccuauacuccaaacucaccgucgacaaaucaagauggcaacaaggcaacgucuucucaugcuccgucaugcacgaaggccuccauaaccauuacacccaaaaaucccuuagccuaucccccggcaaa

SEQ ID NO: 58820 - RNA, 1413 nt, Artificial Sequence
  derived and/or modified sequence opt11 from anti-influenza_Chain
gacggcgucaaaccccuuauccuccgagacugcucaguggccggcuggcuucugggcaaccccaugugcgacgaguucaucaacguccccgaaugguccuacaucgucgaaaaagcaaaccccgccaacgaccucugcuaccccggcaacuucaacgacuacgaagaauuaaaacaccuccucucacgcaucaaccacuucgagaaaauccaaaucaucccuaaaucauccuggagcgaccacgaagccuccagcggcgucucauccgccugccccuaccaaggcacccccuccuucuuccgcaacgucguauggcucaucaagaaaaacaacaccuacccaaccaucaaacggagcuacaacaacaccaaccaagaagaccuacucauacucuggggcauccaccacucaaacgacgccgccgaacaaaccaaacuauaccaaaacccaaccacuuacaucucagucggcaccuccacccuuaaccaacgccucgucccaaaaaucgcuacccgaagcaaagucaacggccaaaacggccgcauggacuucuucuggaccauccucaagcccaacgacgcuauaaacuucgaaagcaacggcaacuucauagcccccgaauacgccuacaaaaucgucaagaaaggcuacauucccgaagcaccccgggacggacaggccuacguacgaaaagacggcgaauggguucuccucucaacauuccuucgcucggacaaaacacauaccugcccacccugccccgccccagaacuacuugguggaccauccgucuuccucuucccacccaaacccaaagacacccucaugaucucgcgcacgccagaagucaccuguguugucguagacgucucccacgaagacccagaagucaaauucaacugguacguagauggcgucgaaguccacaacgcaaagacaaaaccccgagaagaacaguacaacucuaccuaccgcgucguauccguccuaaccguucuccaccaagacuggcucaacggcaaagaauacaaaugcaaggucuccaacaaagcacuacccgcacccaucgagaaaacuaucuccaaggccaaaggucaaccacgggaaccgcaagucuacacacuaccucccucacgcgaagaaaugaccaaaaaccaaguaucacuaacaugccuugucaaaggcuucuaccccagcgauauugccgucgaaugggagucaaacggccagcccgaaaacaacuacaaaaccaccccacccguccuagacagcgacggcuccuucuuccucuacucgaaacucaccgucgacaagucacgcuggcaacaaggaaacguauucucuugcuccgucaugcacgaagcacuacacaaccacuacacacaaaaaucacuaucacucucccccggcaaa

SEQ ID NO: 58821 - RNA, 1413 nt, Artificial Sequence
  derived and/or modified sequence opt11 from anti-influenza_Chain
gauggcguaaaaccccucauccuacgcgacugcucagucgcaggcugguuacucggcaaccccaugugcgacgaguucaucaacguacccgaauggucauauauagucgaaaaggcgaaccccgcaaacgaccuuuguuaccccggaaacuucaaugacuacgaagaacucaaacaucuacucucccgcauaaaccacuucgagaaaauacagaucauccccaaaucauccugguccgaccaugaagccuccucuggcgucuccuccgccugcccauaccaaggcacaccaucuuucuuccgaaacgucgucuggcuaaucaagaaaaacaacaccuacccaacaaucaaacgcagcuacaauaacaccaaccaagaagaccuucuaauccucuggggcauacaccacucaaacgacgccgcugaacaaacaaaacuauaccaaaacccaacaaccuacauauccgucgguaccaguacucucaaccaacgccuaguacccaaaaucgccacccggucaaaagucaacggccaaaacggccgcauggacuucuuuuggaccauccucaaaccaaacgacgcaauaaacuucgaaucaaacggcaacuucaucgcaccagaauacgcauacaaaaucgucaagaaaggcuacauccccgaagcaccccgcgacggccaagcauacguccgcaaagauggcgaaugggucuuacuguccacauuccuccgcuccgauaaaacucacacaugcccacccugccccgcgcccgaacuacuaggcggccccucagucuuccuauucccucccaaacccaaagacacacucaugaucucccgcacacccgaaguaacaugcgucgucguugacguaucgcacgaagacccagaagucaaauucaacugguacguugacggcguagaaguacacaacgcaaagaccaaaccccgcgaagaacaauacaacuccaccuaccgaguugucuccguacucacaguacuccaccaagacuggcucaacggaaaagaauacaaaugcaaaguauccaacaaagcacuccccgcccccaucgagaaaaccaucuccaaagccaaaggccagccccgcgaaccccaagucuacacacuaccacccuccagggaagaaaugaccaaaaaccaagucucccucacaugccuugucaaaggcuucuaucccuccgacaucgccgucgaaugggaaagcaacggacaacccgaaaacaacuacaaaaccaccccucccguacucgacucugacggcuccuucuuccuauacagcaaacucacagucgacaagagccgcuggcaacaaggcaacguauucucaugcucagucaugcacgaagccuuacacaaccacuauacccaaaaaucccucucuuuaucccccggaaaa

SEQ ID NO: 58822 - RNA, 1416 nt, Artificial Sequence
  derived and/or modified sequence opt11 from anti-influenza_Chain
auggacuggacauggcgcuuccuauucgucgucgccgccgccaccggcguacaaugccaaguccagcucguccaaucaggcgccgaagucaaaaugcccggcuccuccguuaaaguuucaugcaagaccucaggcguauucuucuccucucacgccaucuccuggguccgccaagcacccggccaaggacuagaauggaugggcgggaucucccccauguucggcaccacccacuaugcccaaaaguuccaaggccgaguaaccauaacagccgaccaaucaaccaccaccgccuacauggaacuaaccucccucacaucugaagacacagccguauacuauugcgccagagauggcgcaggcucguacuauccccuaaauugguucgaccccuggggacaaggcacucucgucacagucuccuccgcaucgaccaaaggaccaagcgucuucccccuggcccccucaucuaaauccaccuccggcggaaccgccgcccuuggaugccuagucaaggacuacuuccccgaacccgucaccgucuccuggaacuccggagcccuaacuuccggcguacacaccuuccccgccguacuccaauccucaggccucuacucacucuccucagucguuaccguacccaguuccagccucggcacccaaaccuacauaugcaacguaaaccacaaacccuccaacacaaaaguugacaaacgcgucgaacccaaguccugcgacaaaacccacacaugcccacccugccccgccccagaacuccucggcggcccauccgucuuccucuucccucccaaacccaaagacacccuaaugaucucacgcacccccgaagucacaugcguagugguagacgucucacacgaagaccccgaggucaaauucaacugguacguagacggcguagaaguccacaacgcaaaaaccaaaccccgcgaggaacaauacaacuccaccuaccgcgucguauccguccucaccguccuacaccaagacuggcucaacggaaaagaauauaaaugcaaagucucaaacaaagcgcuacccgccccuauugagaaaacaaucucaaaagccaaaggccaaccacgagaaccccaagucuacacacugccaccaucccgcgacgaacuuaccaaaaaccaagucucacuaacaugucucgucaaaggcuucuaccccagcgacauagcugucgaaugggaauccaauggucaaccggaaaacaacuacaaaaccacaccacccguucuugacuccgacgguucauucuuccuauacucaaagcucacaguagacaaaagccgcuggcaacaaggcaacguauucuccugcagcgucaugcacgaaggacuccacaaccacuacacccaaaaaucacuaucacuaucccccggcaag

SEQ ID NO: 58823 - RNA, 1416 nt, Artificial Sequence
  derived and/or modified sequence opt11 from anti-influenza_Chain
auggacuggaccuggcgauuccucuucgucgucgccgcagccacaggcguacaaugucaaguacaacucguccaauccggcgccgaagucaaaaugcccggcagcucagucaaagucucaugcaaaacauccggcgucuucuucuccucccaugccaucucauggguaagacaagcaccuggccaaggccucgaguggaugggcggcauaucccccauguucggcaccacacacuacgcccaaaaauuccaaggccgugucacaauaaccgccgaccaauccacaaccaccgccuacauggagcuaacaagccucaccuccgaggauaccgcaguauacuacugcgcccgagacggugccggcucauacuacccucuaaacugguucgaccccuggggacaaggaacccuaguaacagucucaucagccucaaccaaaggccccuccgucuucccccuugcccccagcucaaaauccaccuccggcggaaccgccgcccuugguugccucguaaaggacuacuuccccgaaccagucacagucucauggaacuccggcgcccucaccuccggaguccauaccuucccagccguacuccaaucauccggccuauacucacucucaagugucgucacaguccccuccuccucccucgguacccaaaccuacaucugcaacgucaaccacaaacccuccaacaccaaaguagacaaacgcgucgagcccaaauccugcgacaaaacacacacgugcccaccaugccccgcacccgaacuccucggcggccccucgguauuccucuucccacccaaacccaaagacacccucaugaucucacgaaccccugaaguaaccugcguuguagucgacgucagccacgaagaccccgaagucaaauucaacugguacgucgacggcgucgaaguccacaacgcuaaaacuaaacccagagaagaacaauacaacagcacauaccgaguugucucaguccuaacaguccuccaucaagacugguuaaacggcaaagaauacaaaugcaaaguauccaacaaagcccuucccgccccaaucgagaaaaccaucucgaaagccaaaggccaaccccgagaaccacaaguauacacccucccacccagccgcgacgaacucaccaaaaaccaagucucccuaacaugccuagucaaaggcuucuaccccagcgacaucgccgucgaaugggaaagcaacggccaacccgaaaacaacuauaaaaccacucccccaguacucgacuccgacggcucuuucuuccucuacuccaaauugaccgucgacaaaucccgauggcaacaaggcaacgucuucuccugcuccgucaugcacgagggccuacacaaccacuacacccaaaaaucccucucucugucaccaggaaaa

SEQ ID NO: 58824 - RNA, 1416 nt, Artificial Sequence
  derived and/or modified sequence opt11 from anti-influenza_Chain
auggacuggacauggcgauuccuauucgucgucgcagcugccaccggcguccaaugccaaguacaacucguccaaucuggggccgaagucaaaaugcccggauccuccgucaaagucucuugcaagaccucaggcgucuucuucucaucccacgccaucucauggguacgccaagcccccggacaaggucuagaauggaugggcggcaucagccccauguucggcaccacccacuacgcacaaaaauuccaaggccgcgucaccaucacagccgaccaaucuaccacuaccgcguacauggaacuuaccucacuaaccucagaagacacugccguuuacuacugcgcccgagacggcgccggcucguacuacccccucaacugguucgacccauggggccaaggcacccucgucaccgucagcuccgccucaacaaaaggacccagcguauucccccucgcccccucaagcaaaagcaccuccggaggaacagccgcccucggaugccucgucaaagacuacuucccagaacccgucacugucuccuggaacucaggagcacuaaccuccggcguucacacuuuuccugccguacuccaaagcucaggccuguacucccucagcuccguagucaccgucccuagcucaucacucggcacacaaaccuacaucugcaacgucaaccacaaacccucuaacaccaaagucgacaaacgagucgaaccuaaaucaugcgacaaaacacacaccugucccccaugccccgcccccgaacuccuaggcggccccucagucuuccucuucccacccaaacccaaagacacacucaugaucucuagaacucccgaaguaacaugcguaguugucgacguaucucacgaagaccccgaaguaaaauuuaacugguacgucgacggcgucgaaguacacaacgcaaaaaccaaaccacgcgaagaacaauacaacagcacauaccgagucguaucgguccucaccguacuacaccaagacuggcucaacggcaaagaauacaaaugcaaagucuccaacaaagcccucccggcccccaucgaaaagacaaucucaaaagccaaaggccaaccucgcgaaccacaggucuacacccucccuccauccagagacgaacucaccaaaaaccaagucagcuuaaccugccuagucaaaggcuucuaccccuccgacauugcagucgaaugggaaucaaacggccaaccagaaaacaacuacaaaaccacacccccaguacuagauuccgacggcucguucuuucucuacuccaaacuaacagucgacaagucccgauggcaacaaggcaacgucuucuccugcucaguaaugcacgaaggucuccacaaccacuacacacagaaaagccuaucccucagccccggcaaa

SEQ ID NO: 58825 - RNA, 1419 nt, Artificial Sequence
  derived and/or modified sequence opt11 from anti-influenza_Chain
augacagaaucagccaugacaucacgagccggcagaggacggggcgcagaccucguagcagccgugguccaaggacacgccgccgccucagacgccgcaggagaccuauccuucccggacggauucauauggggcgcagcaacagcagccuaccaaauagaaggagccuggagagaagacggaaggggccugugggauguauucagccacacaccaggaaaagucgcaagcggacacacaggcgacauagcaugcgaccacuaccaccgauacgccgacgacgucagacuaauggccggacucggagaccgaguauaccgauucagcguagccuggcccaggaucgucccagacggaaguggaccagucaacccagccggacuagacuuuuacgaccgacugguagacgaacucuuaggccacgguauaacacccuacccaacucuauaucacugggaccuaccacaaacacuggaagauagaggaggaugggccgcccgagacacagcguaccgcuucgcagaauacgcccucgcaguacacagacgccuaggcgaccgaguccgaugcuggaucacccucaacgaacccugggucgccgccuuccucgcaacacaccguggagcaccgggcgcagccgacgucccacgauuccgagcaguacaccaccuacuccuaggccacggccuaggacuacgccuacgauccgccggcgccgggcaacucggccuaacauuaucacuauccccagugauagaagcgcgaccaggcguacguggaggcggacgccgagucgacgcccuggcaaacagacaguuccuagacccagcccuccgcggccgcuaccccgaagaaguacuaaaaauaauggcaggacacgccagacuaggacauccagggcgcgaccuggaaacgauacaccaacccguugaccugcuagguguaaacuacuacagccacgucagacuagcagccgaaggcgaacccgcgaaccgacucccaggcucagaaggaauacgauucgaacgacccaccgccgucacagcauggcccggcgacagaccagacggacuccgaacacuccugcuccgccucucgcgcgacuaccccggcgucggacuaaucauaaccgaaaacggcgccgcguucgacgacagagcagacggcgaccgaguacacgaccccgaacgcauuagauaccucaccgccacacucagagcaguacacgacgccauaauggcaggagcagaccuccgaggguacuucgucuggagcguacucgacaacuucgaaugggccuacggcuaccacaaacguggaaucguauacguggacuacaccacaaugaggcgaauaccacgcgaaucagcacuaugguauagagacguagugcgaagaaacgggcucagaaacggagaa

SEQ ID NO: 58826 - RNA, 1419 nt, Artificial Sequence
  derived and/or modified sequence opt11 from anti-influenza_Chain
augacagagucagcgaugacaagcagagcaggaaggggaagaggagcggaccucgucgccgcaguaguacaggggcacgcggcagcaucggaugcggcgggggaccugagcuucccagacggauucauauggggcgcggcaacggcagcguaccaaauagagggggcauggagagaagacggaagaggacuaugggacguguucagccacaccccaggaaaaguggcaagcggacacacgggagacauagcgugcgaccacuaccacagauacgcggacgacguaagacucauggcaggacuaggagacagggucuaccgauuuagcgucgcauggccaagaauaguaccagacgggucaggcccagucaacccggcaggauuagacuucuacgacaggcuaguagacgaacuccuaggacacggcauuacgccauacccaacacuguaccacugggaccuaccacagacgcuagaagacagaggaggaugggccgcaagagacacagcauacagguucgcagaauacgcgcuagccguacaccgccgccuaggggacaggguacggugcuggauaacacucaacgaacccuggguggccgcauuccuggcaacacauagaggagcaccgggggcggcagacgugcccagauuccgcgcaguacaccaccuacugcuagggcacggacuagggcugagacuaagaagcgcaggagcaggacaacucggccuaacgcucagucuaagcccaguuauagaagcgagaccaggagugagaggagggggaagaagggucgacgcacuggcgaacagacaguucuuggacccggcacuacggggaagguaccccgaagaaguauuaaaaauaauggcgggacacgcacgacuaggacauccagggagagaccuagaaacaauacaccaacccguggacuuacuaggaguaaacuacuacagccacgugaggcuagcggcagaaggagaaccagcgaacaggcugccagggagcgaaggaauaagauucgaaagaccgacagcaguaacggcauggccaggagacagaccagacggccucagaacacugcugcuaagacuaucaagggauuacccagggguuggauuaauaauaacggaaaacggagcggcauucgacgaccgggcagacggagacaggguacacgaccccgaacgaauaagauaccuaaccgcgacgcuaagagccguacaugacgcaauaauggcgggagcagaccugcggggguauuucguauggagcguacuagacaacuucgagugggcauacggauaccacaaaagagggauagucuacguggacuacaccacaaugagaaggauaccacgggaaagcgcccuaugguacagggacguagugagaagaaacggacuaaggaauggagaa

SEQ ID NO: 58827 - RNA, 1422 nt, Artificial Sequence
  derived and/or modified sequence opt11 from anti-influenza_Chain
cuaucccgcaucaaccacuuugagaaaauacaaaucauccccaaauccuccugguccgaccacgaagcauccagcggcguauccuccgccugccccuaccaaggaacacccagcuucuuccgcaacgucgucuggcucaucaaaaagaacaacacauacccaaccauaaaacgcagcuacaacaacaccaaccaagaagaccuacuaauccucuggggcauacaccacucaaacgacgccgccgaacaaacaaaacucuaccaaaaccccacgaccuacauaagcgucggcacauccacccuaaaccaacgccugguccccaaaaucgccaccagauccaaaguuaacggccagaacggccgaauggacuucuuuuggacuauccuaaaacccaacgacgccaucaacuucgaaucaaacggcaacuucaucgcacccgaauacgccuacaagauagucaaaaagggcgacuccgccaucguaaagucagaaguugaauacggaaacugcaacaccaaaugccaaaccccaaucggagccaucaacuccucaaugcccuuccacaacauacacccccuuaccaucggcgaaugccccaaauacgucaaaucaaacaagcuaguccucgccaccggccuccgcaacucaccacucggcuacauccccgaagcaccacgagacggccaagcauacguacgcaaagacggcgaauggguccuacucucaaccuuccuaagguccgacaaaacccauaccugcccacccugccccgcuccugaacuccucggaggaccaucagucuuccucuucccaccuaaaccaaaagacacccucaugauaucacgaacgcccgaaguaaccuguguaguaguagacguaucccaugaagaccccgaagucaaauucaacugguacgucgacggagucgaaguccacaacgccaaaacuaaaccgagagaagaacaauacaacuccaccuaccgcgucgucucaguccuaaccguacuccaccaagacuggcuaaacggcaaggaauacaaaugcaaagucuccaauaaggcacucccagcccccaucgagaaaacaauauccaaagccaaaggccaaccccgcgaaccccaaguuuacacccuaccucccucacgcgaagaaaugaccaaaaaccaagucucccuaaccugccucgucaaaggauucuaccccuccgauauagcgguagaaugggaaagcaacggacaacccgaaaacaacuacaaaacaaccccacccguccucgacagcgauggcucuuucuuccuauacuccaaacuaaccgucgacaaaagccgcuggcagcaaggcaacguauucucaugcagcgucaugcacgaagcccuccacaaccacuacacacaaaaaucacucucacucagccccggcaaa

SEQ ID NO: 58828 - RNA, 1422 nt, Artificial Sequence
  derived and/or modified sequence opt11 from anti-influenza_Chain
cucucccgaaucaaccacuucgagaaaauccaaaucauccccaaaagcagcugguccgaccacgaagcauccucgggcgucuccuccgcaugccccuaccaaggcacccccucauucuuccggaacgucguuuggcucaucaagaaaaacaacaccuaccccaccaucaaacguucauacaacaauacaaaccaagaagaccuucuaauccuguggggcauccaccacuccaacgacgccgcagaacaaaccaaacucuaccaaaaccccacaaccuacaucuccgucggaaccucuacacucaaccaacgccucguaccaaaaaucgccacucgcuccaaagucaacggccaaaacggaagaauggacuucuucuggaccauccuaaaacccaacgacgccauaaacuucgaaucuaacggcaacuucaucgcgcccgaauacgccuacaaaaucgucaagaaaggcgacuccgccaucguaaaaucagaagucgaauacggcaacugcaacaccaaaugccaaaccccuauaggugcaauaaacuccuccaugcccuuccauaacauacacccccucaccauaggagaaugccccaaauacgucaaauccaacaaacucguccuugccacaggacuccguaacucaccacucggauacauacccgaagcuccccgagacggccaggccuacgucagaaaagacggcgaauggguucuccucuccacuuuccuacgcucagacaaaacacauaccugcccacccugccccgcucccgaacuacuaggcggacccuccguauuccuauucccucccaaacccaaagacacccucaugauaucccgcacucccgagguaacaugcgucgucgucgacgucucacacgaagaccccgaaguaaaauucaacugguacgucgacggugucgaaguacacaacgccaaaaccaaaccccgcgaagaacaauacaacuccacauaccgcguagucucaguacucaccguccuccaccaagacuggcucaacggcaaagaauacaaaugcaaaguuuccaacaaagcccuacccgcaccgauagagaaaaccaucuccaaagccaaaggccaaccaagagaaccccaaguauacacccucccgcccucgcgagaagaaaugaccaaaaaccaagucucccucacuugccucgucaaaggauucuaccccuccgacaucgcagucgaaugggaauccaacggccaacccgaaaacaauuacaaaaccaccccacccguccuagacuccgacgguuccuucuuccucuacuccaagcucaccguagacaaaucccgcuggcaacagggcaacgucuucagcugcucggucaugcacgaagcccuccacaaccacuacacccagaaaucacucucacucucccccggaaaa

SEQ ID NO: 58829 - RNA, 1428 nt, Artificial Sequence
  derived and/or modified sequence opt11 from anti-influenza_Chain
auggaguucggccucucauggguauuccucguagcccuacuacgaggaguccaaugccaaguccagcuagucgaaucaggcggcggcguaguccaaccaggccgaucccuccgccuaucgugcgcagccucaggcuucacauucucccgauuuggcauccacuggguccgccaagcccccggcaaaggccucgaauggauggcuguaaucugguacgacggaucaaacaaauucuacgccgacuccguaaagggacgauucacaauaucccgagacaacagcaaaaacacagucuaccuccaaaugaacucccuacgcgccgaagacaccgcagucuacuacugugccaaagauucccgcggauacugcuccuccaucaucugcuucgaaggcggccucgacaacuggggccaaggcacacucgucaccguauccuccgcuagcacaaaaggccccucagucuucccucucgcccccuccuccaaaagcaccuccggcggaaccgccgcccucggcugccugguaaaagacuacuucccagaaccagucaccguaucauggaacaguggagcacuuacaucuggcgugcacaccuuuccugccguacuccaaagcuccgggcuauacucccucagcuccgucgucaccgucccgucauccagccucggcacccaaaccuacaucuguaacgugaaccacaaacccucaaacacaaaagucgacaaacgaguggaaccaaaauccugcgacaaaacacacaccuguccacccugccccgcccccgaacuccucggcggacccuccgucuuccuauucccacccaaacccaaagacacccucaugaucucccgaacucccgaaguaaccugcgucgucgucgacgucucacacgaagaccccgaagucaaauucaacugguacgucgacggaguagagguccacaacgcaaaaaccaaaccccgagaggaacaauacaacucaaccuacagagucguauccguccucacaguccuccaccaagauuggcucaacggcaaagaauauaaaugcaaagucuccaauaaagcccuacccgcccccaucgagaaaaccauaucgaaagccaaaggacaaccucgagaaccacaagucuacacccuaccacccucccgcgacgaacuaaccaaaaaccaagucucacucacaugccuugucaaaggcuucuaccccuccgacaucgccguagaaugggaaucgaacggccagcccgaaaacaacuauaaaacaaccccgcccguacucgacuccgacggcagcuucuuccucuacucaaaacuaacaguagacaaaucccgcuggcaacaaggcaacguauucagcugcuccguaaugcacgaaggccuccacaaccacuacacacaaaaaucacuaagccuaucccccggcaaa

SEQ ID NO: 58830 - RNA, 1428 nt, Artificial Sequence
  derived and/or modified sequence opt11 from anti-influenza_Chain
auggaguucggccucuccuggguuuuccuagucgcacuccuccgcggaguccaaugccaaguccaacuugucgaaucaggaggcggagucguacaaccaggccgcucccuccgucuauccugcgccgcuuccgguuucaccuucucacgcuucggaauccauuggguccgacaagcccccggcaaaggccuggaguggauggccguaaucugguacgacggcuccaacaaguucuacgcagacuccgugaaaggccgcuucaccaucagccgcgauaacuccaaaaacacgguuuaccuacaaaugaacucccuccgagccgaagacacagccgucuacuacugugccaaagacucacgcggcuacugcuccucaauaauaugcuucgaaggcggccucgacaacuggggccagggcaccuuaguaaccgucuccucagccucuaccaagggacccucaguauucccccuagcacccaguagcaaaagcaccucaggcggaaccgccgcccuaggcugccuagucaaagauuacuucccggaacccguuaccguuuccuggaacuccggagcccucaccagcggcgugcacacauuccccgccguccuacaaagcuccggccuauacucccucuccuccguagucaccguccccuccuccucacuaggcacccaaaccuacaucugcaacgucaaccacaaacccuccaacaccaaaguagacaaacgcgucgaacccaaaucuugcgacaaaacucacacgugcccuccuugcccagccccagaacuccuuggaggccccucagucuuccuuuucccacccaaacccaaagacacccugaugaucagucgaacccccgaggugaccugcguagucgucgacgucucccacgaagaccccgaaguaaaauucaauugguacgucgacggcgucgagguacacaacgcaaaaaccaaaccccgugaagaacaauacaauuccaccuaccgagucguaagcguacuaacaguccugcaccaagacuggcuuaacggcaaagaauacaaaugcaaagucuccaacaaagcacuaccagcaccaauagagaaaacaauaagcaaagcaaaaggacaaccccgagaaccacaagucuauacacucccacccucacgcgacgaacuaaccaaaaaccaaguaagccuaaccugccucgucaaaggcuucuaccccuccgacaucgccgucgaaugggaauccaacggacaacccgaaaacaacuacaaaaccacaccacccguauuagacucagacggaucauucuuccucuacucaaaacuaaccgucgacaaaucccgcuggcaacaaggcaacguauucagcugcuccgucaugcacgaaggccuucacaaccacuacacacaaaaaucccucucacucucccccggcaaa

SEQ ID NO: 58831 - RNA, 1428 nt, Artificial Sequence
  derived and/or modified sequence opt11 from anti-influenza_Chain
auggaguucgggcucagcuggguauuccuugucgcccuucuuagaggcguccaaugccaaguccagcuaguugaaucaggaggcggcgucguacaacccggccgaucccuccgacuaucaugcgccgccuccggcuucacauucucccgguucggcauccacuggguacgccaagccccuggaaaaggacuggaauggauggccguaaucugguacgacggaucaaacaaauucuaugcagacuccgucaaaggccgcuucaccauaucgcgcgacaacagcaaaaacaccguauaccuccaaaugaacucccuccgagccgaagacaccgccguauacuacugcgcaaaagacucacgcgguuacugcuccucaaucaucugcuucgaaggaggccucgacaacuggggucaaggcacccucguaacagucagcagcgcaagcaccaaaggcccaucagucuucccacuagcccccuccuccaaguccaccuccggugggacagcugcacucggcugccuagucaaagacuacuucccagaacccguaaccguaucauggaacucaggcgcacucacauccggaguccauaccuucccagccguacuccaauccucaggccucuacucccucuccuccguugucaccguccccuccucaucccuaggcacccaaaccuacauaugcaacguaaaccacaaacccucaaacacaaaagucgacaaacgcguugagccaaaaucaugcgacaaaacccacaccugucccccaugccccgccccagaacuccucggcggcccaucgguguuccucuucccucccaaacccaaagacacauuaaugaucucgagaacccccgaaguaaccugcgucguagucgacgucucccacgaagaucccgaagucaaauucaacugguacgucgacggcguagaaguccacaacgccaaaaccaaaccccgcgaagaacaauacaacagcaccuaccgcguagucucgguccuaacaguacuucaccaagacuggcuuaacggcaaagaauacaaaugcaaaguauccaacaaagcccuccccgcccccauagagaaaaccauaucaaaagcaaaaggccagccccgagaaccccaagucuacacccuaccacccucccgcgacgaacucaccaaaaaccaagucagccuaacaugccucgucaaaggcuucuacccauccgacaucgcagucgaaugggaaucuaacggccagcccgaaaacaacuacaagacaaccccaccaguccuagacucugacggcuccuucuuccucuacucaaagcugaccgucgacaaaucccgcuggcaacaaggcaacgucuucagcugcuccgucaugcacgaaggccuacacaaccacuacacccaaaagagcuugucacucagccccggcaaa

SEQ ID NO: 58832 - RNA, 1440 nt, Artificial Sequence
  derived and/or modified sequence opt11 from anti-influenza_Chain
augcccagcgucaaaauaggcauaaucggggcaggaucagcagucuucucgcuacgacucgugagcgaccuaugcaaaacccccggacuauccggcuccaccguaacacuaauggacauagacgaagaaagacuagacgcgauccucacaauagcaaagaaauacguagaagaagucggagccgaccuaaaauucgagaaaacgaugaaccucgacgacgucaucaucgacgccgacuucguaauaaacacggccauggucggcggccacaccuaccucgaaaaaguacgacaaaucggagaaaaauacggauacuaccgcgggaucgacgcacaagaguucaacauggucagcgacuacuacaccuucucgaacuacaaccaacucaaauacuucgucgacaucgcacgaaaaauagaaaaacucagcccaaaagcaugguaccuccaggccgccaaccccaucuucgaaggcaccacacugguaacacgcacaguacccauaaaagccgucggguucugccacggccacuacggaguaauggagaucguagaaaagcucggacucgaagaagaaaaagucgacuggcaaguagccggcgucaaccacggaauauggcugaaccgcuuccgauacaacggcgggaacgcauacccccuccucgacaaauggaucgaagagaaaagcaaagacuggaaaccggaaaaccccuucaacgaccaacucucaccagcggcgaucgacauguacagauucuacggcgucaugcccauaggcgacaccguaagaaacagcucauggagauaccaccgcgaccuagaaaccaaaaagaaaugguacggcgaaccguggggcggagccgacagcgaaaucggcuggaaaugguaccaagacacacugggcaaagucacagaaauaacaaagaaagucgcaaaauucaucaaagaaaaccccagcguacgccuaagcgaccugggcagcgucuuaggcaaagaccucagcgaaaaacaauucguccucgaagucgaaaagauccucgaccccgaacgaaaauccggcgaacaacacauaccauucauagacgcacuccuaaacgacaacaaagcccgcuucgugguaaacauaccaaacaaaggcaucauccacggcaucgacgacgacguaguaguggaagucccggccuuggucgacaaaaacggcauacaccccgagaaaaucgaaccaccacuaccagaccgcguagugaaauacuaccuucgcccccgcaucaugcgcauggaaauggcccucgaagccuuccucaccggggacauccgaauaaucaaagaacuacucuaccgagacccuagaacaaaauccgacgaacaggucgaaaaagugaucgaagagauccucgcacuacccgaaaacgaggagaugcgcaaacacuaccuaaaaaga

SEQ ID NO: 58833 - RNA, 1440 nt, Artificial Sequence
  derived and/or modified sequence opt11 from anti-influenza_Chain
augccuagcgucaaaauaggaaucaucggcgccggcuccgcagucuucucccuacggcuagucagcgaccuaugcaaaaccccaggccugagcggguccaccgucacccucauggacauagacgaggaacgccucgacgcaauacugacaaucgcaaagaaauacguagaagaagugggagccgaccucaaauucgaaaagaccaugaaccucgacgacgugaucaucgacgcagauuucgucaucaacaccgccaugguaggaggacacacauaccucgaaaaagugcgccaaaucggagaaaaauacggcuacuaccgaggcaucgacgcccaagaguucaacaugguaucagacuacuacacguucagcaacuacaaccaacucaaauacuucgucgacaucgcacgcaaaaucgaaaaacucagccccaaagccugguaccuccaagccgccaauccgauauucgaaggaaccacccuagugacccgaacaguccccauaaaagccguaggauucugccacggacacuacggggucauggaaauaguagaaaagcucgggcucgaagaagaaaaaguagacuggcaagucgccggcgucaaccacggaauauggcuaaaccgcuuccgauacaacggaggaaacgccuacccacuacuugacaaauggauagaagaaaagagcaaagacuggaaaccugaaaaucccuucaacgaccaacuaagcccagcggccaucgacauguaccgcuucuacggcgucaugccaauaggcgacaccguccgaaacaguagcuggcgauaccaccgcgaccuagaaaccaaaaagaaaugguauggugaaccguggggcggagcagacagcgaaaucggauggaaaugguaccaggacacccuaggaaaagucacagaaaucaccaagaaaguagccaaauucaucaaagaaaaccccagcguccgacuaagcgaccucggaagcguccucggcaaagaccucagcgaaaaacaauucguacucgaagucgagaaaauccuagaccccgaacgcaaauccggggaacaacacauaccauucauagacgcccuccucaacgacaacaaagcccgcuucguaguaaacaucccaaacaaaggcaucauacacggcauagacgacgacgucguagucgaaguacccgcgcucgucgacaaaaauggaauccaccccgagaaaauagaaccaccccuacccgaccgcguagucaaguacuaccuaagaccccgaauaaugcgcauggaaauggcccuagaagccuuccucaccggagacauccgaauaauaaaggaacucuuauaccgcgacccccgcaccaaguccgacgaacaagucgaaaaaguaauagaagaaauccucgcgcuccccgaaaacgaagaaaugcgaaaacacuaccugaagcgc

SEQ ID NO: 58834 - RNA, 1443 nt, Artificial Sequence
  derived and/or modified sequence opt11 from anti-influenza_Chain
augaaauuuccaaaagacuucaugaucggcuauuccagcucgcccuuccaauucgaagcgggaaucccaggauccgaagaccccaauuccgacugguggguauggguccacgacccggaaaacacagccgccggccuggucuccggcgacuuccccgagaacggacccggcuacuggaaccuaaaccaaaacgaccacgacuuagccgaaaaacuaggcgucaacacaaucagagucggagucgaguggucccgcaucuucccaaaacccaccuucaacguaaaagucccaguggaacgcgacgaaaacggauccauuguccacgucgacguagaugacaaagccgucgaacgacuagacgaacucgccaacaaagaagccgucaaccacuacguagaaauguacaaagacugggucgagcgcgggcgaaagcuaauacucaaucucuaccacuggccccucccccuauggcugcacaaccccauaaugguccgccgaaugggacccgaccgagcacccuccggcuggcugaacgaagaaucagucgucgaguucgccaaauacgccgccuacauagccuggaaaaugggcgaacuaccaguaauguggucaaccaugaacgagccuaacguaguauacgaacaaggcuacauguucgugaaaggaggcuucccacccggauaccuaucacucgaggccgccgacaaagccagacgaaacaugauacaagcccacgcgcgcgccuacgacaacauuaaacgauucuccaagaaaccaguaggacuaaucuacgcauuccaaugguucgaacuccuagaaggacccgcggaagucuucgacaaauucaaaucuagcaaacuauacuacuucaccgacaucguguccaaaggcucgagcauaaucaacguagaauaccgccgcgaucucgccaaccggcucgacuggcuaggcgugaacuacuauucccgucuagucuacaaaauagucgacgacaaacccaucaucuuacacggauacggcuuccucugcacacccggcggcaucuccccggccgaaaauccaugcucagauuucggcugggaagucuaucccgaaggucucuaccuacuccucaaagaacuauacaaucgauacggcguggaccuaaucgucaccgagaacggcgucucagacucacgagacgcgcugcgaccagcauaccuagucucccacguauacagcguauggaaagcagcaaacgaaggaauaccagugaaaggguaccuccacuggucccuaaccgacaacuacgaaugggcccaaggauuccgccaaaaauucggccuaguaaugguagacuucaaaaccaagaaacgauaccuccgcccaucagcccuaguauucagggagaucgccacccacaacggaauacccgacgaacuacaacaccuaacccucauacaa

SEQ ID NO: 58835 - RNA, 1443 nt, Artificial Sequence
  derived and/or modified sequence opt11 from anti-influenza_Chain
augaaauuccccaaagacuucaugaucggauacucauccucacccuuucaauucgaagccggcauacccggaagcgaagacccaaacucagacugguggguauggguccacgacccagaaaacacggccgccggccuugucuccggcgacuuccccgaaaacggcccaggcuacuggaaccucaaccaaaacgaccacgaccuagccgagaaacucggcgucaacacaaucagagucggagucgaauggucccgaauuuuccccaaacccaccuucaacguaaaaguccccguagaacgcgacgaaaacggcagcaucguacacgucgacgucgacgacaaagccguggaaaggcucgacgaauuagccaacaaagaagccgucaaccacuacgucgaaauguacaaagacugggucgagcgaggacgaaaacucauacucaaucucuaccacuggccccuaccccuauggcuacacaacccaauaaugguacgccgcaugggccccgaccgagcgcccucgggcuggcucaacgaggaaucaguagucgaguucgccaaauacgccgccuacauagccuggaaaaugggagaacuaccggucauguggagcaccaugaacgagcccaacgucguauacgaacaaggauacauguucgucaaaggcggcuucccacccggauaccuuuccuuagaagccgcagacaaagcccgacgcaacaugauccaagcacacgcucgagccuacgacaacauuaaaagauucucaaagaaacccguaggccuaaucuacgccuuccaaugguucgaacuccuagaaggacccgcagaaguauucgacaaauucaaaucguccaaacucuacuacuucacagauaucgucucaaagggcucgagcaucaucaaugucgaauaccgucgagauuuagcaaaccgccucgacuggcucggugucaacuacuacucacgccuagucuacaaaaucguagacgacaagcccaucauacuccacggcuacggauuccucugcacgccaggcggcauaagccccgccgaaaaccccuguuccgacuucggaugggaaguauacccagaaggccuguaccuccuccuaaaagaacuauacaaccgauacggcguagaccucaucgucaccgaaaacggagucuccgacucacgcgacgcccugcgcccagccuaccuagucucacacgucuacuccgucuggaaagccgccaacgaaggcaucccagucaaaggcuaccugcacuggagccucaccgacaauuacgaaugggcccaaggcuuccgccagaaauucggacucgucauggucgacuucaagacgaagaaacgauaccuacgcccaagcgcacucguguuccgagagauagccacccacaacggcauacccgacgagcuacaacaccucacccuaauucag

SEQ ID NO: 58836 - RNA, 1464 nt, Artificial Sequence
  derived and/or modified sequence opt11 from anti-influenza_Chain
cacgcccaagacauccucgagaaaacccacaacggcaaacucugcgaccucgacggcgucaaaccacucauccuacgcgacugcuccgucgcaggauggcuccucggaaacccuaugugugacgaguucaucaacguaccugaauggagcuacaucguugaaaaagccaaccccgcaaacgaccuuugcuaccccggcaacuuuaacgacuacgaagaacucaaacaccuccucagccgcaucaaccacuucgagaaaauccaaaucaucccuaaauccucaugguccgaccacgaagcauccuccgguguauccucagccugucccuaccaaggcacccccuccuucuuccgcaacgucguauggcucaucaagaaaaacaacacauaccccaccaucaaacgcuccuacaacaauaccaaucaagaagaccuccucauacuauggggcauacaccacuccaacgacgccgccgaacaaacaaagcuguaccaaaaccccaccaccuacaucucaguaggaacaucuacccuaaaccaacgucucguccccaaaauagccacccgcuccaagguaaacggccaaaacggacgaauggacuucuucuggaccauccucaaacccaacgacgcaaucaacuucgaauccaacggaaauuucaucgccccagaauacgccuauaaaaucgucaagaaaggcuacauccccgaagcuccacgcgacggccaagccuacguccgcaaagacggcgaaugggucuuacucuccacuuuccuacgcuccgacaaaacccauaccugcccacccuguccugccccggaacuacuuggcggcccauccgucuuccuauucccucccaaacccaaagacacccucaugaucucacguacccccgaaguaaccugcgucgucgucgacgucucacacgaagaccccgaagucaaauucaacugguaugucgacggagucgaaguccacaacgccaaaaccaaaccccgagaagaacaauacaacuccaccuacagggucgucuccguccucaccguccuacaccaagacuggcuaaacggcaaagaauacaaaugcaaaguaucaaacaaagcucugcccgcccccaucgagaaaaccauauccaaagccaaaggccaaccccgcgaaccccaggucuacacacucccacccucccgcgaagaaaugaccaaaaaccaaguaucccucacgugccucguaaaaggcuucuaccccagcgacaucgcggucgaaugggaaagcaacggucaacccgaaaacaacuacaaaaccaccccgcccguccucgacucugacggcuccuucuuucuauacuccaaacuaacagucgauaaaucccguuggcaacaaggcaacguguucucaugcuccgucaugcacgaagcccuccacaaccacuacacccagaaaucacucagccuuucccccggaaaa

SEQ ID NO: 58837 - RNA, 1464 nt, Artificial Sequence
  derived and/or modified sequence opt11 from anti-influenza_Chain
cacgcccaagacauucucgaaaagacacacaacggcaaacucugcgaucucgacggcgucaaaccccuaauucuccgcgacugcuccguagccggauggcuccuaggcaaccccaugugcgacgaguucaucaacguccccgaauggagcuacauaguagaaaaagccaacccugcuaacgaccuaugcuaccccggcaacuucaacgacuacgaagaacucaaacaccuccucucacgaaucaaccacuucgagaaaauacaaaucaucccuaaaucgucauggagcgaccacgaagccagcucaggcguuuccuccgccugccccuaccaaggcacccccagcuuuuuccgcaacguuguuuggcucaucaagaaaaacaacaccuacccuacaaucaaacgaucauacaacaauaccaaccaagaagaccuucuaauacuauggggcauacaccacuccaacgacgcagcagaacaaacaaaacucuaccaaaaccccacgaccuacaucuccgucggcaccagcacacucaaccaacgccucguccccaaaaucgccacccgcagcaaagucaacggccaaaacggccgcauggacuucuucuggacaauccucaaacccaacgacgccauaaacuucgaauccaacggcaacuucaucgccccagaauacgccuacaaaaucguaaagaaaggcuacauuccagaagcaccuagagacggacaggcuuacgucagaaaagauggcgaauggguccuccucuccaccuuccuccgauccgacaaaacucauaccugcccacccugcccagcccccgaacuucucggcggccccuccgucuuccucuucccaccaaaacccaaagacacacucaugauaucccgcacccccgaaguaaccugcguagucguagacgucucacacgaagaccccgaggugaaauucaacugguacgucgacggugucgaaguccacaacgccaaaacaaaaccccgcgaagaacaauacaacagcacauaccgcgucguuuccguccucacaguacuccaccaagacuggcucaacggcaaagaguacaaaugcaaagucuccaacaaagcccuacccgccccuaucgagaaaacaauaucuaaagccaaaggccaacccagagaaccccaagucuacacacucccacccucccgcgaagaaaugaccaaaaaccaaguaucccuaaccugccucgucaaaggauucuaccccucagacaucgcaguagaaugggaaagcaacggacaacccgaaaacaacuacaaaacaacacccccaguccuagacuccgacggcuccuucuuccuauacagcaaacucaccgucgauaaaucaagauggcaacaaggcaacguauucuccugcuccgugaugcaugaagcccuccauaaccacuacacccagaaaucacucucccucagccccggcaaa

SEQ ID NO: 58838 - RNA, 1473 nt, Artificial Sequence
  derived and/or modified sequence opt11 from anti-influenza_Chain
augcucucauucccuaaaggcuucaaguucggcuggucacaaucgggauuccaauccgagaugggcaccccagggagcgaagaccccaacuccgacuggcaugucugggugcaugaccgcgaaaacaucguaagccaagucgucucaggcgaccuccccgagaacggacccggcuacuggggcaacuacaagcgauuccacgacgaagccgaaaagauaggacucaacgcaguccgaauaaacguagaauggagccgcaucuucccacgcccccuccccaaaccagaaaugcaaacgggcaccgacaaagaaaacagcccagugauaucuguggaccucaacgaauccaaacuccgugaaauggauaacuacgcaaaccacgaagcacucucccacuacagacaaauccuagaagaccugagaaaccgaggcuuccacaucguccuuaacauguaccacuggacccucccgaucuggcuccacgacccaauccgaguccggcgcggcgacuucaccggacccaccggcuggcucaacuccagaaccguauacgaguucgcgcgauucucugcauacgucgccuggaaacucgacgaccucgcguccgaauacgccaccaugaacgaacccaacgucgucuggggcgccggcuaugccuucccccgugccggauucccacccaacuaccuauccuucagacucuccgagauagcaaaauggaauaucauacaagcccacgcccgcgcauacgacgccaucaaauccgucuccaagaaauccgucggcauaaucuacgccaacaccuccuacuacccccuacgcccccaagacaacgaagcagucgaaaucgccgaacgccucaaccgcuggucauucuucgacucaaucaucaaaggcgaaaucacauccgaaggccaaaacguccgggaagaccuccgcaaccgacuagacuggaucggcgucaacuacuacacccgaaccgucgucaccaaagccgaauccggcuaccuaacacuacccggcuacggcgacagaugcgaaagaaacagccugucccucgcuaaccucccgacauccgacuucggcugggaguucuucccagaaggacucuacgacgugcuccugaaauacuggaacagauacggacuaccccuguacguaauggaaaacggcaucgccgacgacgccgacuaccagcgcccauacuaccucguaagccacauauaccaaguccaccgcgcacucaacgaaggagucgacguccgcgguuaccuacauuggagccucgccgacaacuacgaauggagcucaggcuucuccaugcgcuucggccuacucaaaguagacuaccuaacuaaaagacucuacuggcgccccuccgcgcuagucuacagagaaaucacacgcuccaacggcauccccgaagaacuagaacaccucaaccgcguacccccaauaaaaccccuccgccac

SEQ ID NO: 58839 - RNA, 1473 nt, Artificial Sequence
  derived and/or modified sequence opt11 from anti-influenza_Chain
augcucuccuuccccaaaggcuucaaauucggcuggucccaauccggcuuccaauccgaaaugggaacacccggaagcgaagaccccaacuccgacuggcacgucuggguccacgaccgagaaaacaucgucucccaaguugucucaggagaccuccccgaaaacggucccggcuacuggggcaacuacaaaagauuccaugacgaagccgagaaaaucggccuaaaugcaguccgcaucaacguagaauggucacgcaucuucccccgcccccuccccaaacccgaaaugcaaaccgguaccgacaaggaaaacagccccguaauauccgucgaccuaaacgaauccaaacuaagagaaauggacaacuacgcaaaccaugaagcacucucccacuaccgucaaauccucgaagaccuacgcaaccgaggcuuccacaucguccuuaacauguaccacuggacacuucccaucuggcuccacgaccccauacgaguccgacgaggcgacuucaccggccccacaggcuggcuaaacuccagaacagucuacgaauuugcccgcuucuccgccuacgucgccuggaaacucgacgaccuagccucagaauacgccaccaugaacgaacccaacguaguuuggggcgccggcuacgccuucccucgggccggcuucccacccaacuaccucuccuuccgccucuccgagaucgccaaauggaacaucauacaagcucacgcccgagcauacgacgccauaaaaucagucucaaagaaauccgucggaauaaucuacgcaaacaccucauacuacccccuccgcccccaagacaacgaagccgucgaaaucgccgaacgucuaaaccgauggagcuucuuugacucgauaauaaaaggcgaaauaacaucagaaggccaaaacguccgcgaagaccuccguaaccgacuagacuggauuggcgucaacuacuacacccgcaccgucgucaccaaagcggaaagcggcuaccucacccuccccggcuacggcgaccgcugcgaaagaaacucccucucacucgccaaccugccaaccuccgacuucggcugggaguucuucccagaaggccuauacgacguucuacucaaauacuggaaccgcuacggccuaccucuguacguuauggaaaacggcaucgcagacgacgcagacuaccaacgccccuauuaccucgucucccacaucuaccaaguccaccgagcucucaacgagggcgucgacguacgaggcuaccuccauuggucccuagcagacaacuacgaaugguccagcggcuucuccaugcguuucggccuccucaaagucgacuaccucaccaaacgcuuauacuggcgaccauccgcacucgucuacagggagaucacuagauccaacggcaucccagaagaacucgaacaccugaaccgagucccacccaucaaaccccuccgccac

SEQ ID NO: 58840 - RNA, 1494 nt, Artificial Sequence
  derived and/or modified sequence opt11 from anti-influenza_Chain
auggccucacaaggaacaaaacgaagcuacgaacagauggaaacagacggggaaagacagaacgccacagaaauaagagcgucaguaggcaaaaugauaggaggaaucgggcgcuucuacauucaaaugugcacggaacugaagcuaagcgacuacgaaggaagacugauacaaaauucccugacaauagaaaggaugguacucucggccuucgacgaacgaagaaacaaauaccuagaagaacacccaagcgcagggaaagacccaaagaaaaccgggggccccauauacagacgagucaacgguaaauggaugagagaacuaauccucuacgacaaagaagaaaucaggcgcauauggagacaagcgaacaacggcgacgacgcaaccgcaggccugacacacaugaugaucuggcacucaaaccuaaacgacgccacguaccaacgaacacgagcccuagugcggacgggaauggacccacgaaugugcucgcuaaugcaagggagcacgcucccacguagaagcggggcagcaggagcagcagucaaggggguaggaaccauggucauggaacugguccggaugauaaaaagaggcaucaacgaccgcaacuucuggcgaggagaaaacggcaggaaaacgcgcauagccuacgagaggaugugcaacauacuaaaaggcaaguuccagaccgcagcccagaaagcaaugauggaccaagucagagaaagccgagaccccgggaacgcggaguucgaagaccuaaccuuccucgccagaagcgcauugauacuaagggggucaguggcccacaaaagcugccuaccagcaugcguauacggcccagcaguagccagcggcuacgacuucgaacgugaaggguacagccuagugggcauagacccauuccggcuacuacaaaacagccaagucuacagcuuaauccgacccaacgaaaacccagcacacaaaagucaacuuguauggauggcaugccacagcgcagcauucgaagaccuccgaguccucuccuucauaaaaggaacaaagguaguaccgcggggcaaacuguccacaagaggaguacaaaucgcaucaaacgaaaauauggaaacaauggaaaguucaacccuagaacuacgaagccgcuacugggccaucaggacacggagcggaggcaacacaaaccaacaacgcgcaagcgccggccagauaucaauacaaccaaccuucagcguccagagaaaccuaccauucgaccgaacaacagugauggcggcguucaccggaaacacggaagggcggacgagcgacaugagaaccgaaauaauccgcaugauggaaagcgcccgaccggaagacguaucauuccagggcagaggcguauuugaacuaagcgacgagaaagcggccagccccauagucccgagcuucgacaugagcaacgaaggaagcuacuucuucggcgacaacgcggaggaauacgacaac

SEQ ID NO: 58841 - RNA, 1494 nt, Artificial Sequence
  derived and/or modified sequence opt11 from anti-influenza_Chain
auggccucacaaggaacaaagcgaucauacgagcaaauggaaacagacggagaaagacaaaacgcaacggaaauccgcgccagcguaggcaaaaugauagacggaaucggacgcuucuacauucaaaugugcacggaacucaaacuaagcgacuacgaaggcaggcucauacaaaacagucugacaauagaaagaauggugcucucggccuucgacgagagacgaaacaaguaccuagaagaacacccaagcgcgggcaaagacccgaagaaaacaggaggcccaauauacaaaaggguggauggaaaauggaugcgcgagcuagugcuauacgacaaggaagagaucagacgaauauggcgccaagcgaacaacggagacgacgcgaccgcaggacugacacacaugaugaucuggcacucaaaccugaacgacacaacguaccaacggacccgagcccuagugagaacgggaauggacccgcgaaugugcagccucaugcaagggagcacacucccgcgaagaaguggcgcagcaggggcagccgugaaaggagugggaacaauggucauggaacucauaagaaugauaaaaaggggaaucaacgauagaaacuucuggcgcggagaaaacggaagaaaaacgaggucagccuacgaaaggaugugcaacauacucaagggcaaauuccagaccgcagcccaacgagcgaugauggaccaggucagagaaucgcgcaacccaggaaacgcggaaauagaagaccucauauuucucgccaggagugcacucauacucagaggcucaguagcgcacaagagcugccuaccggcaugcguauauggcccagccaucgcaucgggauacaacuucgaaaaagaaggguacucacucgugggaauagacccauucaagcuacugcagaacagccagguauacagccuaaucaggccaaacgaaaacccagcgcacaagagccaacucguguggauggccugcaacucagcagcauucgaggaccuacgagugcuuagcuucauaagaggaaccaaggucagccccaggggcaaacucagcacaaggggaguacaaauagcgagcaacgagaacauggacacgauggagaguagcacccuggaacugagaagccgauacugggcaauaaggacaagaagcgggggcaacaccaaccaacaaagagccagcgcgggacaaauaucaguacagccggcguucagcguccagcgaaaccuaccguucgacaaaccgaccauaauggcggcauucaccggaaacacagaagggcggaccagcgacaugagggccgagauaauacgaaugauggaaggagcgaaaccggaagaaauguccuuccaaggaaggggagucuucgagcucucagacgaaaaagcaacaaaccccauagucccgagcuucgacaugagcaaugaagggaguuacuucuucggcgacaacgcagaagaauaugacaac

SEQ ID NO: 58842 - RNA, 1494 nt, Artificial Sequence
  derived and/or modified sequence opt11 from anti-influenza_Chain
auggcaagccaaggaaccaagaggagcuacgaacagauggagacgggcggcgagcgacaaaacgccaccgaaauaagggcaagcguaggacgcauggucggaggaauaggacgauucuacguacagaugugcacagaacucaaacucucagaccaagaaggaagacuaauccaaaacagcauaaccauagaacgcaugguacuaagcgcauucgacgaaaggcgcaaccgcuaccuugaagaacacccaagcgcaggaaaagacccaaagaaaaccggaggaccaauauaccggagacgagacggcaaauggguaagggaacuaauacuauacgacaaagaagaaauacgacgcauauggagacaggcaaacaacggagaagacgcaaccgcaggacugacacacaugaugaucuggcauagcaaccuaaacgacgcaacguaccaaagaacccgagcccuagucagaacagggauggaccccagaaugugcagccucaugcaaggaucaacccuaccaagacgaucaggcgcagcgggcgcagccaucaaagggguaggcaccaugguaauggaacuaaucaggaugaucaaaagaggaaucaacgacagaaacuucuggcgcggagacaacggacggcgaaccagaaucgccuacgaaagaaugugcaacauacugaaaggaaaauuccagaccgcagcgcaacgagcaaugauggaccaaguccgggaaaguagaaacccgggaaacgcggaaauagaagaccugaucuuucuagccaggagcgcacuaauacuacgcggcuccguggcacacaaaagcugccucccagccugcgucuacggacucgcaguagcaagcggcuacgacuucgaacgcgaaggcuacagccugguaggaauagacccauuccgacuacuccaaaacagccaaguauucucacucauacgcccaaacgaaaacccagcacacaaaagccaacuugucuggauggcaugccacagcgcagccuucgaagaccuaagaguaagcuccuucauaagaggaacacggguaaucccacgcggacaacuaagcacacgaggcguacaaauagcaucaaacgagaacgucgaagcaauggacagcagcacccucgaacucagaagccgauacugggccauaaggacaaggagcggagggaacacaaaccagcaacgcgcaagcgcaggacaaaucagcguccaaccaacauucagcguacaacgaaaccuacccuucgaacgaccaaccauaauggccgccuucaaaggaaacaccgaaggcagaaccagcgacaugcgaacagaaaucauaaggaugauggaaucagcaagaccagaagacgugagcuuccaaggccgcggaguauucgaacucagcgacgaaaaggcaaccaaccccauaguacccagcuucgacauguccaacgagggaagcuacuucuucggagacaacgcagaagaauacgacaac

SEQ ID NO: 58843 - RNA, 1494 nt, Artificial Sequence
  derived and/or modified sequence opt11 from anti-influenza_Chain
auggccucacagggaaccaagcgaucguacgaacaaauggaaacagacggggaaagacaaaacgccacggaaaucagagcaaguguaggaaaaaugauaggcggaaucgggagauuuuacauacaaauguguacggaacugaaacuaagcgauuaugagggcagacuuauacaaaacagccuaacgaucgaacgaauggugcuaucggcauucgacgaacgcagaaacaaguaccuggaagaacacccgagcgcgggcaaagacccgaagaaaacaggaggaccaauauaccgcagagucaacggaaaauggaugagagaacucauacucuacgacaaggaagagaucagacguauauggagacaagccaacaauggcgacgacgcgaccgccggacucacacacaugaugaucuggcacucaaaccuaaacgacgcaacauaccagcgaacgcgggcgcucguaagaacgggaauggacccacgaaugugcagccucaugcaagggagcacacucccacguaggagcggggccgcaggcgcggcugugaaaggggucgggaccauggucauggaacuggucaggaugauaaagagaggcauuaacgaccgaaacuucuggagaggagaaaacggcaggaaaacacgcauagccuacgaacggauguguaacauacucaagggcaaguuccagacagcagcccagaaagcgaugauggaccagguccgagaaucgcgugacccagggaacgcagaguucgaggaccucacauuucuggccagaagcgcguuaauacucaggggcucagucgcgcacaagagcugccuaccggccugcgucuacggcccggcaguggccucgggcuacgacuucgaaagggaaggguacucgcucguggggauagacccguucagacuacuacaaaacagccaaguauacagcuugauaaggccaaacgaaaaccccgcgcacaaaagucagcuaguauggauggccugccacucagccgcauucgaagaccuacgcgugcuaucguucauaaaaggaaccaaggucgugcccagaggaaagcuaucgacaagggguguacaaauagccucaaacgagaacauggaaacgauggagagcucaaccuuggaacuacgaucacgcuacugggccauaaggacaagaagugggggcaacaccaaccaacaacgcgcgagugcgggccaaauaucgauccaaccaacguucucgguccagcgcaaccuaccguucgaccgcacgaccguaauggcagcguucaccggaaacacagaagggcgcacaagcgacaugcgaaccgagaucauaagaaugauggagagugcgcgcccagaagacguauccuuccagggcagaggaguauucgagcuaucagacgagaaagcagccucgccaauaguaccgagcuucgacaugagcaacgaagggagcuacuucuucggcgacaacgcggaagaguacgacaac

SEQ ID NO: 58844 - RNA, 1494 nt, Artificial Sequence
  derived and/or modified sequence opt11 from anti-influenza_Chain
auggccucccaaggaaccaagcgaagcuacgaacagauggagacagacggagaaaggcaaaacgcgacggaaauaagagcgagcgugggaaagaugauagacgggaucgggcgauucuacauacaaaugugcacagaacuaaaacuaagcgauuacgagggccgacugauccaaaacagccugacaauagaacggauggugcuaucagcauucgacgaacgcagaaacaaguaccuagaagaacacccaagcgcuggaaaagauccgaagaagacaggcggcccaauauacaagcggguagacggcaaguggaugagagaauuagugcuauacgacaaagaagagauaaggaggaucuggcggcaagcgaacaacggagacgacgcaacagcaggccugacacacaugaugauauggcacagcaaccuaaacgacaccacguaccagagaacgcgggcucuaguacggacaggaauggacccacgaaugugcagccucaugcaaggcagcacguuaccgcgacggucaggagcagcgggcgccgcagucaaagggguaggaacgauggucauggagcugauaagaaugauaaaacgaggaauaaacgaccggaacuucuggcgaggcgaaaacggaaggaaaacacgaagcgcauacgaaagaaugugcaacauacuaaaaggaaaauuccaaacagcggcccagagagcgaugauggaccaagucagggaaucgaggaaccccggaaacgcggaaauagaagaccuaauauuccuggcaagaagcgcacugauacuaaggggaagcgucgcgcacaaaaguugccucccagcaugcgucuacggaccggcuaucgcaucaggauacaacuucgaaaaagaaggauacucacucgugggaaucgacccguucaagcuacugcagaacagccagguauacagccuaauaagaccgaacgaaaacccagcacacaaaagccaacugguauggauggccugcaacuccgcggcguucgaggacuuacgcguacucagcuucauaagagggacgaagguaagcccaagagggaaacucagcacaaggggaguacaaauagccagcaacgagaacauggacacgauggagagcucgacacuggaacugcgaucgagauacugggcgaucaggaccaggagcggaggaaacaccaaucaacaaagagcgagcgcaggccaaaucagcguccaaccagcauucagcguacagagaaaccucccguucgacaaaccaacaauaauggcggcauucacaggaaacacggaagggagaaccagcgacaugagggccgagaucauacgcaugauggagggcgcaaaaccggaagagaugaguuuccagggaaggggcguguucgagcugagcgacgagaaagcaacgaacccaaucgucccgagcuucgacaugagcaacgaaggaagcuacuucuucggcgacaacgcagaagaauacgacaac

SEQ ID NO: 58845 - RNA, 1494 nt, Artificial Sequence
  derived and/or modified sequence opt11 from anti-influenza_Chain
auggccucgcaaggaaccaagcgcucguacgagcaaauggaaaccggaggagaaagacaaaacgcaacggaaauaagagccagugugggaaggaugguaggcgggauaggccgcuuuuacguccaaaugugcacggaacuaaaacuaagugaccaagagggccgacucauacaaaacagcauaaccauagaaagaauggugcuaucggccuucgacgaacgaagaaaccgauaccuggaggaacacccaagcgccggaaaggacccaaagaaaacaggcggcccgaucuaccgcaggcgcgacggcaaauggguccgagagcucauccucuacgacaaggaagaaauccgccgaauauggaggcaagcaaacaacggcgaggacgcaaccgcgggauuaacccacaugaugaucuggcacuccaaucugaacgacgccacguaccagcgcacgcgcgcccucguaaggaccggcauggacccacgaaugugcagccuaaugcaaggaagcacgcucccgcgaaggagcggagcggcaggcgcggccaucaaaggagucggaaccauggugauggaacuaaucaggaugauaaaaagaggaaucaacgacagaaacuucuggagaggcgacaacggaaggcgcacacgcauagcauacgaaagaaugugcaacauccucaaaggcaaauuccaaacggcagcccaaagagcgaugauggaccaaguaagagagucgcgcaaccccggaaacgcagaaauagaagaccucaucuuccuggcaagaagugcgcucauacuaaggggcuccguagcccauaagagcugccuacccgccugcguauacggacuagcaguagccucaggcuacgacuucgaacgggaaggguacucacucguaggcauagacccguuccgacuccuccaaaacagccaggucuuuagucuaauccggcccaacgagaacccagcacacaagucccagcuaguauggauggcaugucacucagccgcguucgaagaccuaagagugagcagcuucauccgggggacaagggucauccccaggggccaacucucaacaagaggcguacaaauagcaucgaaugagaacguggaagccauggacagcucgacauuagagcugcgcagcagguacugggcaauaaggaccaggagcggaggcaacacaaaccaacaacgagcgagcgcaggccagaucucgguacagcccacauucucgguacagcgcaaucuaccauucgagcgcccaacaauaauggcagccuucaaagggaacacggaagggagaacaagcgacaugagaaccgagauaauccggaugauggaaagcgcacgacccgaagacguaucguuccaggggagaggcgucuucgaacuaagugacgagaaagcaacaaacccaauagucccgagcuucgacaugaguaacgaagggagcuacuucuucggcgacaacgcggaagaauacgacaac

SEQ ID NO: 58846 - RNA, 1530 nt, Artificial Sequence
  derived and/or modified sequence opt11 from anti-influenza_Chain
auguuccccgaaaaauuccucuggggagucgcacaauccggguuccaauucgaaaugggggacaaacuccgucgaaacaucgacacaaacacagacugguggcacuggguacgcgacaaaaccaacauagagaaaggacugguauccggcgaccucccagaagagggaauaaacaacuacgaacuguacgaaaaagaccacgaaaucgcccgcaaacuaggccuaaacgccuacagaaucggcauagaguggucacgaaucuuccccuggcccaccacauucauagacgucgacuacuccuacaacgaauccuacaaccuaaucgaagacgucaaaaucacuaaagacacccucgaagaacuagacgaaauagcaaacaaaagagaagucgcauacuaccgcagcguaauaaacagccucaggucaaaaggcuucaagguaaucgucaaccugaaucacuucacacuccccuacuggcuacacgacccaauagaagccagagaacgagcacucaccaacaagcgcaacggcuggguaaacccccgcacagucaucgaguucgccaaguacgcggccuacaucgccuacaaauucggcgacauagucgacauguggagcacauucaacgaaccgaugguagucgucgaacucggauaucucgccccauacuccgguuuuccacccggaguccucaaccccgaagcagccaaguuagccauacuccacaugaucaacgcccacgcuuuagccuaccgacaaaucaagaaauucgacaccgaaaaagccgacaaagauucaaaagaacccgccgaagucggcaucaucuacaacaacauaggagucgcauaccccaaagaccccaacgacagcaaagacgucaaagccgccgaaaacgacaacuucuuccacuccggccucuucuucgaagcuauccacaaggguaaacucaacaucgaguucgacggcgagacauucaucgacgccccauaccucaaaggaaacgacuggauaggcgucaacuacuacacaagagaagucgucaccuaccaagaacccauguuccccagcauaccacucaucaccuucaaaggcguccagggcuacggcuacgcuugucgcccuggaacccuguccaaagacgaucgaccaguauccgacaucggcugggagcucuaccccgaaggaauguacgacucaaucgucgaagcacacaaauacggaguccccguauacguaaccgaaaacggcaucgccgacuccaaagacauccuacgccccuacuacaucgccagccacaucaaaaugacagaaaaggccuucgaggacggcuacgaaguaaagggguacuuccacugggcacucaccgacaacuucgaaugggcccucggcuuccgcaugagauucggccucuacgaagucaaccucaucaccaaggaaagaauccccagagaaaaaucagucuccauauuccgagaaauuguagcaaacaacggcgucacaaagaaaauagaagaagaacuacuaagaggc

SEQ ID NO: 58847 - RNA, 1530 nt, Artificial Sequence
  derived and/or modified sequence opt11 from anti-influenza_Chain
auguucccagaaaaauuccuguggggcguggcccaauccgguuuucaauucgaaaugggagacaagcuacgcagaaacaucgacacgaacaccgacugguggcacuggguacgcgacaaaaccaacaucgaaaaagggcuagucuccggagaccuccccgaagagggaaucaacaacuacgaacucuacgagaaggaccacgaaauagcacggaaacuaggacucaacgccuacagaaucggcauagaauggucccgaauauuccccuggccaacuaccuucaucgacgucgacuacaguuacaacgaguccuacaaccuuaucgaagacguaaaaaucaccaaagacacccucgaagaacucgacgaaauagccaacaagagagaaguagccuacuaccgcucugucaucaacagccuccgaucuaaaggcuucaaaguaaucgucaaccucaaccacuucacgcuccccuacuggcuccacgaccccaucgaagcacgcgaacgcgcucucacgaacaaacgaaacggcugggucaacccccgcaccgucaucgaguucgcaaaauacgcggcauacauagcauacaaauucggcgacauaguagacaugugguccacauucaacgaacccauggucgucguagaacucggcuaccucgcccccuacuccggauucccgcccggaguacuaaaccccgaagccgcaaaacucgcgauacuacacaugauaaacgcccacgcacucgccuaccgacaaaucaagaaauucgacaccgaaaaagccgacaaagacagcaaagaacccgcggaaguagggauaaucuacaacaacaucggagucgcguaccccaaagacccgaacgacuccaaagacgucaaagccgccgaaaacgacaacuucuuccacucaggacucuucuucgaagccauccacaaagguaaacugaacaucgaguucgacggcgaaaccuucauagacgcccccuaccugaaaggaaacgacuggaucggaguuaacuacuauacccgcgaagucgucacauaccaagaacccauguuccccagcaucccccuaaucacguucaaaggcguccaaggguacggauacgccugccgcccaggcacacucuccaaagacgaccgccccgucagcgacaucggaugggaacuauaccccgaaggaauguacgacagcaucgucgaagcccacaaauacggcguccccguauacguaacggaaaacggcaucgcagacagcaaagacauccuaaggcccuacuacaucgccucccacauaaaaaugacggaaaaggccuucgaagacggcuacgagguaaaaggcuacuuccacugggcccuaacagacaacuucgaaugggcccuaggauuccgcaugcgcuucggacucuacgaagucaaccuaaucacaaaggaacgaauaccaagagagaaaagcgucagcaucuucagggaaauagucgcaaacaacggcgucaccaaaaagaucgaagaggagcuacuuagaggu

SEQ ID NO: 58848 - RNA, 1536 nt, Artificial Sequence
  derived and/or modified sequence opt11 from anti-influenza_Chain
augaaacgaaaagucaagaaaauggccgccauggcaaccuccaucaucauggccaucaugaucauccuacauagcaucccaguccucgcagggagaaucauauacgacaacgaaaccggaacccacggcggauacgauuacgaacucuggaaagacuacggcaacacaaucauggaacuaaacgacggaggcaccuucagcugccaaugguccaacaucggaaaugcacuguuccgaaaaggccgcaaauucaacuccgauaaaacauaccaagagcucggcgacauuguaguagaauacggcugcgacuacaacccaaacggcaacucguaccuaugcgucuacggcuggacacgcaaccccuugguagaauacuauaucguagagagcuggggcagcuggcgcccaccaggcgccacacccaaaggcacaaucacccaauggauggccggcacguaugaaauauacgaaacaacacgcgucaaccaaccauccaucgacggcaccgcaacauuucaacaauacuggagcguacgaacaagcaaaagaacgagcggcaccauaucaguaaccgaacacuuuaaacaaugggaacgcaugggcaugcgaaugggcaagauguacgaaguagcccucaccguagaaggauaucaaagcucaggcuacgcaaauguuuacaaaaacgaaauacgcauaggagcaaacccaaccccagcccccagccagagcccaauccggcgcgacgccuucagcaucauugaagccgaggaauacaacucgaccaacagcucgacccuccaagucauaggcaccccaaacaacggccgcggcaucggcuacaucgagaauggaaacacaguaacuuacuccaacauagauuucggauccggagccaccggcuucuccgccacaguagccacagaaguaaacaccucaauccaaauaagaucagacagccccaccggaacccuacucggcacacuauacgucagcucaaccgggagcuggaacacauaccaaacaguaagcacaaacaucagcaagaucacaggcguacacgacauaguccuaguauucucgggcccaguaaacgucgauaacuucaucuucagccgcuccucgcccguaccggcaccaggcgacaacacgcgugacgccuacuccauaauacaagccgaagacuacgacagcucguacggcccaaaccuccaaaucuucagccuacccggcggcggcuccgcgaucggauacauugaaaacggcuacagcacaacuuacaaaaacauagacuucggagacggcgccaccagcgucacagcacgcgucgccacacaaaacgcaacaacaauacaaguccgccugggcagcccaucaggcacacuccuaggcaccaucuacgucggaagcacgggcucguucgacaccuacagagacgucucggccaccaucuccaacaccgccggcgucaaagacaucguccucguauucagcggaccggucaacguggacugguucgucuucucaaagucaggcaca

SEQ ID NO: 58849 - RNA, 1536 nt, Artificial Sequence
  derived and/or modified sequence opt11 from anti-influenza_Chain
augaaacguaaggucaagaaaauggccgcgauggcaaccuccauaauaauggccaucaugaucauccuccacagcauccccguccucgcaggccgcauaauauacgacaacgagaccggcacccacggcggauacgacuacgaacuauggaaagacuacggcaacacaauaauggagcucaacgacggcggcaccuucagcugccaguggagcaacaucggaaacgcccucuuccgaaaaggcaggaaauucaacuccgacaaaaccuaccaagaacuaggagacauagucguggaauacggaugcgacuacaaccccaacggaaacuccuaccuaugcguauacggauggacacgcaacccccuggucgaauacuacaucgucgaaucauggggcagcuggcgcccacccggagcgacacccaaaggcaccaucacacaauggauggcgggcacguacgagaucuacgaaacgaccagagucaaccaacccucaaucgacggcaccgcuaccuuccaacaauacugguccgugcgcaccaguaaacggacaucaggaaccauaagcgucaccgagcacuucaaacaaugggaacgcaugggcaugcgcaugggcaagauguacgaaguagcccugaccgucgaaggauaccagucaucaggcuacgccaacgucuacaaaaacgaaauccgcaucggcgccaacccaaccccagcucccucccagagcccaauccgccgcgacgccuuuagcauaauagaagccgaagaauacaacucaaccaacuccucaacccuccaagucaucggaacacccaacaacggccguggcaucgguuacaucgaaaacggaaacacaguuacguacucuaacauagacuucggcucaggcgcaacgggauucucagccaccgucgccaccgaagucaacaccucgauacaaauaagaagcgacagcccaaccggaacucuacuaggcacccuauacgugagcucaacaggcagcuggaacaccuaccaaaccguaagcacaaacauaagcaagauaacaggcgugcacgacauaguccuuguguucucaggacccgucaacgucgacaacuuuaucuucagccggagcucacccguaccagcccccggagacaauacacgcgacgcauacucuaucauacaagccgaagacuacgacucaucauacggaccaaaccuccaaaucuucucccuaccuggaggcggcagcgcaaucggauacaucgaaaacggcuauagcacgaccuacaaaaauaucgacuucggggacggagcaaccuccgucaccgcccgcguagccacccaaaacgccacgaccauccaaguucgacuaggcucacccagcggcacccuacucggaaccaucuacgucggcagcacgggcucguucgacaccuaccgcgacgucucagccaccaucucgaacacggccggagucaaagacauuguucucguauucucaggacccguaaacguggacugguucguguucuccaaauccggaacc

SEQ ID NO: 58850 - RNA, 1539 nt, Artificial Sequence
  derived and/or modified sequence opt11 from anti-influenza_Chain
aucugcauaggcuaccacgccaacaacucaaccgaacaaguagacaccaucauggagaaaaacgucaccgugacucacgcucaagacauacuugagaagacccacaacggaaaacuaugcgaccuagacggagucaaaccacucauacugagagacugcuccguagccggcuggcugcugggcaaccccaugugcgacgaguucaucaacgucccagaauggagcuacaucgucgaaaaagccaaccccgccaacgaccugugcuaccccgggaacuucaacgacuaugaagaacucaaacaccuccucucccgaaucaaccacuucgagaaaauacagaucauccccaaaucauccuggucugaccacgaagcaagcuccggcguauccuccgcaugccccuaccaaggcaccccauccuucuucaggaacguagucuggcucaucaagaaaaacaacacauaccccacuaucaaaagauccuacaacaacacaaaccaagaagaccuacuaauccucuggggaauccaccacuccaacgacgcagccgaacaaaccaaacuauaccaaaaccccaccaccuacauaagcgucggaaccuccacccucaaccaacgccuagucccaaaaaucgccaccagaucaaaaguaaacggacaaaauggacgaauggacuucuucuggacaauccucaaaccuaacgacgccaucaacuucgaaagcaacggaaacuucauagccccagaauacgccuacaaaauagucaagaaaggauacaucccagaggcccccagagacggacaggccuacguccgaaaagauggagaauggguccuccucucaacauuccuaagauccgacaaaacccauaccugcccacccugcccggcccccgaacuccuaggaggacccuccgucuuccucuucccacccaaacccaaagacacccucaugaucagccgcacccccgaaguaaccugcguagucgucgacgugucccacgaagaccccgaagucaaauucaacugguacguagacggcgucgaaguccacaacgcaaaaacuaaaccccgcgaagaacaauacaacucuaccuaccgcgucgucuccguccucaccguccuccaccaagauuggcucaacggcaaagaauacaaaugcaaagucucuaacaaagcccugcccgcaccaaucgaaaagaccaucucgaaagccaaaggccaaccucgcgaaccacaagucuacacacucccacccucgcgagaagaaaugaccaaaaaucaagugucacuaaccugccucgucaaaggauucuacccaucagacaucgcagucgaaugggaauccaacggccaacccgaaaacaacuacaagaccacuccacccguccuagacucagacggauccuucuuccucuacuccaaacucaccguagacaaaucccgcuggcaacaaggcaacgucuucucaugcucaguuaugcacgaagcccuacacaaccacuacacccaaaaaucccuaagccucagccccggcaaa

SEQ ID NO: 58851 - RNA, 1539 nt, Artificial Sequence
  derived and/or modified sequence opt11 from anti-influenza_Chain
aucugcaucgguuaccacgccaacaacucaaccgaacaagucgacaccaucauggaaaagaacguaacaguaacccacgcacaagacauccucgaaaagacacacaacggcaaacuaugcgaccucgacggcgucaaaccccuaauccuccgcgacugcucagucgccggcuggcugcucggcaaccccaugugcgacgaguucaucaacguccccgaaugguccuacaucgucgagaaagcaaaccccgcgaacgaccuaugcuaccccggcaacuucaacgacuacgaagaacuaaaacaccuacugucacgcaucaaccacuucgagaaaauccaaaucaucccaaaaucguccuggagcgaccacgaagccuccucaggcguaagcuccgccugcccauaccaaggaacccccuccuucuuccggaacgucguauggcucaucaagaaaaacaacaccuaucccacuaucaaacgcagcuacaacaacaccaaccaagaagaucucuuaauucucuggggcauccaccacucaaacgacgcagcagaacaaacaaaacuguaccaaaaccccacgaccuacauaagcguuggcaccucuacccuuaaccagcgccuaguccccaaaaucgcaacacgcuccaaagucaacggccaaaacggacgcauggacuucuucuggaccauccucaaaccuaacgacgccauuaacuucgaauccaauggcaacuucaucgcccccgaauacgccuacaaaauaguaaagaaaggcuacauccccgaagcaccccgcgacggccaggcauacguccgcaaagacggcgaauggguccuccucuccacuuuccuccgaucagacaaaacccacacaugcccacccugccccgcccccgaacuacuaggcggccccagcguauuccucuucccacccaaacccaaagacacccuaaugaucagccgaacacccgaaguuaccugcgucguagucgacgucucacacgaagaccccgaaguaaaauucaauugguacgucgacggaguagaaguacacaacgccaaaaccaaaccccgagaagaacaauacaacucgaccuaccgagucgucuccguccuaaccguccuacaccaagacuggcuaaacggcaaagaauacaaaugcaaaguaagcaacaaagcccuacccgcacccauagagaaaaccaucagcaaagcuaaaggccaaccccgcgaaccucaagucuacacccuacccccaucccgcgaagaaaugaccaaaaaccaagugagccuaacaugccucguaaaaggauucuaccccuccgacaucgcagucgaaugggaguccaacggccaacccgaaaacaacuacaagaccaccccacccguucucgacucggacggcuccuucuuccucuacuccaaacucaccgucgacaagagccgguggcaacaaggaaacguauuuagcugcucaguaaugcacgaagcacugcacaaccacuacacccagaaaucccugucacuaagccccggcaaa

SEQ ID NO: 58852 - RNA, 1593 nt, Artificial Sequence
  derived and/or modified sequence opt11 from anti-influenza_Chain
acccuaugcaucggcuaccacgccaacaacagcaccgacaccguagacacaguacucgagaaaaacgucaccgugacacauuccgucaaccuccucgaagacaaacacaacggcaaacucugcaaacuccgcggcgucgccccacuucaccugggaaaauguaacaucgccggcuggauacuaggcaaccccgaaugcgaaucccucuccaccgccuccuccuggagcuauaucguagaaaccagcucaagcgacaacggaaccugcuaccccggggacuucaucgacuacgaagaacuacgggaacaacucuccagcguauccuccuucgagcgcuucgaaaucuucccaaaaaccuccuccuggcccaaccacgacucgaacaaaggcgucaccgcagccugcccacacgccggagcaaagagcuucuacaaaaaccuaaucuggcucguaaagaaaggcaacuccuaccccaaacucucaaaaucauacauaaacgacaaaggcaaagaaguacucguccucugggggauacaccaccccagcacaagcgccgaccaacagucccuuuaccagaacgccgacgccuacgucuucgucggaacaagccgauacaguaagaaauucaaacccgaaaucgccauccgccccaaaguccgcgaucaagagggucgaaugaacuacuacuggacccuaguagaacccggcgauaaaaucaccuucgaagcaaccggcaaccugguaguacccagguacgcguucgcaauggagcgcgacgccggcagcggcaucaucaucagcgacacucccguccacgacugcaacaccacaugccaaacaccaaaaggggccaucaacaccucccuacccuuccaaaacauccacccaaucaccaucggcaaaugccccaaauacgucaaauccacaaaacuucgccuggcaaccggccuccgcaacguccccagcauacaaucccgaggacucuucggcgcaaucgcaggcuucaucgagggcggcuggacuggcauggucgacggcugguacgguuaccaccaccaaaacgaacaaggcagcggcuaugcagccgaccuaaaauccacucaaaacgccaucgacgaaaucaccaacaaagucaacuccgucaucgaaaagaugaacacacaauucaccgccgucggaaaagaguucaaccaccuagaaaaacgcauagaaaaccuaaacaagaaaaucgaugacggguuccuugacauauggaccuauaacgccgaacucuugguccuacucgaaaacgaacgcacacuagauuaccacgacuccaacgugaaaaaccuauacgaaaaaguccgcucacaacucaaaaacaacgcuaaagaaaucggcaacggcugcuucgaguucuaccacaaaugcgacaauaccugcauggaaucggucaaaaacggcaccuacgacuaucccaaauacucagaggaggcuaaacuaaaccgcgaagaaauugacggcguaaaacuagagucaacgcgcaucuaccaaauccucgcaauuuacaguacaguagccucaucccuaguccugguagucucacugggcgca

SEQ ID NO: 58853 - RNA, 1593 nt, Artificial Sequence
  derived and/or modified sequence opt11 from anti-influenza_Chain
acccucugcaucggcuaccacgccaacaacucuaccgacaccguagacacagugcuagaaaagaacgucaccgucacccacagcguaaaccuccucgaagacaaacacaacggcaaacuaugcaagcuaagaggggucgcaccauuacaccugggcaaaugcaacauagcagguuggauccucggcaacccagaaugcgaaucccuaagcacagcaucguccuggagcugcauaguggaaacauccuccagcgacaacggaaccugcuacccuggcgacuuuaucgacuacgaagaacuacgcgaacaacucucaucagucagcagcuucgaacgcuucgaaaucuuccccaaaaccucaagcuggcccaaccacgacucaaacaaaggcgucacagcugcaugcccccacgccggcgccaaauccuucuacaaaaaccugaucuggcucgucaagaaaggcaacagcuaccccaaacucaguaaaagcuacauaaacgacaaaggcaaagaaguccuaguacuauggggcauacaccacccgagcaccucagccgaccaacagagccucuaccaaaacgcagacgcauacgucuucguaggcaccagccgauacucaaagaaauucaaacccgaaaucgcaauccgacccaaaguacgagaccaagaaggcagaaugaacuacuacuggacgcucguagaaccgggagacaaaaucaccuucgaagcaaccggaaaccuagucguaccccgguacgcauucgccauggaacgcgacgccggcuccggcaucaucaucagcgacacccccguccacgacugcaauacgacgugccaaacucccaaaggcgccauaaacaccagccuccccuuccaaaacauccacccaaucaccaucggcaagugccccaaauacguaaaaucaacaaaacuacgccucgccaccggccuccgcaauguaccgucgauacaaagccgcggccuauucggcgcaaucgcuggcuucaucgaaggcggcuggaccggaauggucgacggaugguacggcuaccaccaccaaaacgaacaaggguccggauacgcagccgaccucaagagcacccaaaacgccaucgacgaaaucacaaacaaagucaacagugucauagagaaaaugaacacccaauucaccgccgucggaaaagaguucaaccaccuggaaaaacguaucgaaaaccuaaacaagaaaauagacgacggcuuccucgacaucuggaccuacaaugccgaacuccuaguccuacucgaaaacgaaagaacacucgacuaccacgacuccaacguaaagaaccucuacgaaaaaguacgcucacaacucaaaaacaacgcaaaagaaaucggaaacggcugcuucgaguucuaccacaaaugcgacaauaccugcauggaauccguuaaaaacggcaccuacgacuaccccaaauacucggaagaagcaaaacucaaccgcgaagaaaucgacggcguaaaacuagaaucaacgcgaaucuaccaaauccuagccaucuacucuaccguagccuccagccucguccuaguagucucacuaggcgcc

SEQ ID NO: 58854 - RNA, 1593 nt, Artificial Sequence
  derived and/or modified sequence opt11 from anti-influenza_Chain
acacugugcauuggauaccacgccaacaacucaaccgauacagucgauacgguacucgagaaaaacgucaccgucacacacagcguaaaccuccuagaagacaaacacaacggaaaacuaugcaaacuccgaggcguagcaccccuucaccuaggcaaaugcaacaucgccggcuggauccucggcaaccccgaaugcgaaucccuauccacagccagcuccuggagcuacauaguggaaaccagcuccagcgacaacggaaccuguuaccccggagacuucauagacuaugaggaacuaagagaacaacuauccucagucuccucguucgaaagauucgaaaucuucccaaacacaagcuccuggcccaaccacgacuccaacaaaggcgucacagccgccugcccacacgcaggggccaagagcuucuacaaaaaccugaucuggcuagucaagaaaggcaacucauaccccaaacucuccaaaagcuacaucaacgacaaaggcaaagaaguucuuguccuauggggcauacaccaccccagcacaagcgccgaccaacaaagccucuaccaaaacgccgacgccuacgucuucgucggcaccucccgcuacagcaaaaaguuuaaaccagaaaucgcaauccgaccaaaaguccgagaccaagaaggccgaaugaacuacuacuggacgcucgucgaaccaggcgacaaaaucaccuucgaagccaccggcaaccuugucgugccccgcuacgcguucgcaauggaacgugacgcuggaagcggaauaaucaucuccgacaccccaguacacgacugcaacacaaccugccaaacccccaaaggcgcaaucaacaccucccucccauuccagaacauccaccccaucacaauaggcaaaugccccaaauacguaaaauccaccaaacuaagacucgccacaggccuacgcaacgucccuucuauccaaucccguggacucuucggcgcaaucgccggcuucaucgaaggaggcuggacaggcaugguagacggcugguacggauaccaccaccaaaacgaacaaggauccggcuacgccgcagaccucaaaaguacacagaacgccaucgacgaaauaaccaacaaaguaaacuccgugauagagaaaaugaacacacaauucaccgcagucggaaaagaguucaaccaccuugaaaaacgcaucgaaaaucucaacaagaaaaucgacgacggauuccucgacaucuggacguacaacgcagaacugcuaguccuacucgaaaacgaacgcacacucgacuaccacgacuccaacgucaaaaaccuauaugaaaaaguaagaagccaacucaaaaacaacgcgaaagaaaucggcaacggcugcuucgaguucuaccacaaaugugacaauaccugcauggaauccgucaaaaacggcaccuacgacuacccaaaauacucagaggaggcaaaacucaaccgcgaagaaauagacggcguaaagcuagaaagcacccgcaucuaccaaauccuagcaauauacucaaccgucgccuccagccucguccuagucguaucccuaggagcc

SEQ ID NO: 58855 - RNA, 1593 nt, Artificial Sequence
  derived and/or modified sequence opt11 from anti-influenza_Chain
acccucugcaucggcuaucacgcaaacaacuccaccgacaccgucgacacugucuuagagaaaaacguaacagucacccacuccguaaaccuccucgaagacaaacacaacggaaaacucugcaaacuacgcggagucgcaccccuacaccuaggcaaaugcaacaucgccggcuggauccuaggcaaccccgaaugcgaaagccucucgacagcuuccagcuggagcuacauuguagaaaccuccucaagcgacaacggaacaugcuaucccggcgacuuuauagacuaugaagaacuccgagaacagcucuccuccguaagcuccuucgaacgcuuugaaaucuucccaaaaaccagcagcuggccaaaccacgacucgaacaaaggagucaccgccgccugcccccacgccggcgccaagagcuucuacaaaaaucucauauggcucguaaagaaaggcaacuccuacccuaaacuaucaaaaucauacauaaacgacaaaggcaaagaaguccuuguccucuggggcauccaucacccgucaaccucagccgaccaacaaucacucuaucaaaacgccgacgccuacguauucguaggcaccucacgauacuccaagaaauucggccccgaaauagcaauccgcccaaaaguccgcgaccaggagggccgaaugaacuacuacuggacacucguugagcccggcgacaaaauaaccuucgaagcaacaggcaaccuagucgucccccgauacgcauucgcgauggagcgagacgccggaagcgggauaaucaucagcgacacaccaguacacgacugcaacacaaccugccagaccccaaaaggcgccaucaacacuucccuucccuuccaaaacauccaccccauaaccaucggcaaaugcccgaaauacgucaaauccacaaaacuccgucucgccaccggccuucgcaacgucccaagcauacaaucccgcgggcuauucggcgcuaucgccggauucaucgaaggcggcuggacgggcaugguagacggcugguacggauaucaccaccaaaacgagcaaggaaguggcuacgccgccgaccuaaaauccacccaaaacgccauagacgaaauaaccaacaaaguaaacuccgucaucgagaaaaugaacacccaauucaccgccgucggcaaagaauuuaaccaccucgaaaaacgaauugaaaaucucaacaaaaagaucgacgacggauuccucgacaucuggaccuacaacgccgaacuccuaguacuacucgaaaacgaacguacgcuagacuaccacgacuccaacguaaagaaccucuacgaaaaaguacgcucccagcugaaaaacaacgccaaagaaaucgguaacggaugcuucgaguucuaccacaagugcgacaacacaugcauggaaucagucaaaaacggcacuuacgacuaccccaaguacuccgaagaagccaaacuaaaccgcgaagaaauagacggcgucaaacuugaaagcacaagaauuuaccaaauacuagccaucuacucaaccgucgcaucaagccuaguccucgucgucagccuaggcgcc

SEQ ID NO: 58856 - RNA, 1593 nt, Artificial Sequence
  derived and/or modified sequence opt11 from anti-influenza_Chain
acccucugcaucggcuaccaugcaaacaacagcaccgacaccguagacacaguccuagaaaagaacguaaccgucacucacuccgucaaccuacuagaagacaaacacaacggcaaacucugcaaacuccgcggcgucgcaccccuccaucuagggaaaugcaacauagccggcuggauccuaggcaaccccgaaugcgaaucccucagcacagccucaagcugguccuacauaguagaaacaagcucauccgacaacggaaccugcuaccccggcgacuucauagacuacgaagaacucagagaacagcucucaagcgucuccuccuucgaacguuuugaaauauucccaaaaaccuccuccuggcccaaccacgacuccaacaaaggcgucaccgccgccugcccccacgccggcgccaaauccuucuauaaaaaccucaucuggcucguaaagaaaggcaacucguaccccaaacuaucgaaauccuacaucaaugacaaaggaaaagaaguucuaguacucugggguauccaccaccccagcaccagcgccgaccaacaaucgcuauaccaaaacgcagacgccuacgucuucgucgggacaucacgauacagcaagaaauucaaacccgaaaucgccauacgaccuaaaguccgcgaccaagaaggacgcaugaacuacuacuggacacucgucgaaccaggcgacaaaaucaccuucgaagccaccggaaaccucgucgucccacgauacgccuucgcaauggaacgcgacgccggauccggcauaaucaucucagauacccccguacacgauugcaacacaaccugccaaaccccgaaaggagcgaucaacacaucccuccccuuccaaaacauacaccccaucacgauaggcaagugcccaaaauacguaaaaagcacaaaacucagacuagccacaggacuccgaaacguuccguccauccaaucacgcggccucuucggcgcaaucgccggauucauagaaggaggcuggaccggcauggucgacggaugguacgguuaccaccaccaaaacgaacaaggaagcggauacgcagccgaccuaaaaucaacccaaaacgccauagacgaaauaacaaacaaagucaacagcgucaucgagaaaaugaacacccaauucaccgcggucggcaaagaguucaaccaccucgaaaaacgaaucgaaaaccucaacaagaaaaucgacgacggcuuccuagacaucuggaccuacaacgcagaacuccucguccuacucgaaaacgaacgcacccucgauuaccacgacagcaacgucaaaaaccucuacgaaaaaguucgcagccaacucaaaaacaaugccaaagaaaucggcaacgggugcuucgaguucuaccauaaaugcgacaacacaugcauggaaucaguuaaaaacggcaccuaugacuaccccaaguacuccgaagaagccaaacuaaaccgagaagaaaucgacggaguaaagcucgaauccacacguaucuaccagauccucgccaucuacuccacagucgccuccagccucguccucguagucagccuaggagcc

SEQ ID NO: 58857 - RNA, 1593 nt, Artificial Sequence
  derived and/or modified sequence opt11 from anti-influenza_Chain
acccugugcauaggcuaccacgccaacaacucaaccgacaccguagacaccguacucgaaaagaacguaacagucacccacuccguaaaccuccucgaagacaagcacaacggaaaacucugcaaacuacgaggggucgcaccccuacaccucggaaaaugcaacauugccggcuggauccuaggcaaccccgagugcgaaucccuauccaccgcaaguuccugguccugcaucguagaaaccagcuccuccgacaacggcacaugcuacccgggagacuucauagacuacgaagaacuacgcgaacaacuaagcuccguaagcucauucgaacgcuucgaaaucuucccgaaaaccagcuccuggccgaaccacgacagcaacaaagggguaacagccgcaugcccgcacgcgggcgccaaauccuucuacaaaaaccucaucuggcucgucaagaaaggaaacagcuacccaaaacuaagcaaaagcuacauaaacgacaaaggaaaagagguacucguccuauggggcauccaccaccccuccaccagcgcagaccaacaaucacuauaccaaaacgcagacgccuacguauucgucggaaccucacgauacagcaagaaauucaaaccagagaucgccauccgacccaaaguccgagaccaagaaggccgcaugaacuacuacuggacccucgucgaacccggggacaaaauaaccuucgaagccaccgguaaucucguagucccccguuacgccuucgccauggaacgcgacgccggcucaggcaucauaaucucggacaccccaguccacgacugcaacacaaccugccaaaccccgaaaggcgccaucaauacaucccuccccuuucaaaacauacacccaauaaccauaggcaaauguccaaaauacgucaaauccacaaaacuccgccucgccacaggccuccgcaacguccccuccauccaguccagaggucucuuuggagccauagccggcuucaucgaaggaggcuggacaggcauggucgacgguugguacggauaccaccaccaaaacgaacagggcucggguuacgcagccgaccuaaaauccacacaaaacgcaaucgacgaaaucacuaacaaagucaacuccgucaucgaaaagaugaacacacaauucaccgccgucggcaaagaguucaaucaccuagaaaagcgaauagaaaaccuaaacaagaaaauagacgacggauuccuagacaucuggacguacaacgcagaacuccucgugcuccucgaaaacgaacgaacccucgacuaccacgacucaaaugucaaaaaucucuacgaaaaaguacgaucacagcucaaaaacaaugccaaagaaauaggaaacggcugcuucgaguucuaccacaaaugcgacaauaccugcauggaaagcgucaaaaacggaaccuacgacuacccaaaguacuccgaagaagccaaacucaaccgagaagaaauagacggcguaaaacuugaaucaacccgcaucuaccaaauucuagccauauacagcaccguagccuccucccucgucuuagucgucagccucggcgcg

SEQ ID NO: 58858 - RNA, 1593 nt, Artificial Sequence
  derived and/or modified sequence opt11 from anti-influenza_Chain
acccucugcaucggcuaccacgcaaacaacuccaccgacaccgucgacaccguccucgaaaagaacguuaccguaacacacagcgucaaccugcucgaagacaaacacaauggcaaacuuugcaaacugcgcggagucgcaccccuacaccucggcaaaugcaacauagccggguggauacucggaaaccccgaaugcgaaucccucucaaccgccuccuccugguccuacaucguagaaaccuccagcagcgacaacggaaccugcuaccccggcgacuucaucgacuacgaagaacucagggaacaacuuucauccgucuccagcuucgaacgauucgaaaucuuccccaacacaagcagcuggcccaaccacgacagcaacaaaggagugacagccgccugcccccacgccggggcaaagagcuucuacaaaaaccugaucuggcucguaaagaaaggcaacuccuacccaaaacucuccaaaagcuacaucaacgacaaagguaaagaaguacucguacucuggggcauccaccaccccagcacguccgcggaccagcagucccuauaccaaaacgcagacgccuacgucuuugucggaaccucacgcuacuccaagaaauuuaaaccagaaaucgcaauccgcccgaaaguaagggaccaagagggacgaaugaacuacuacuggacccuagucgaaccgggcgacaaaaucacauucgaagccacaggaaaccugguagucccccgcuacgcguucgcaauggagcgggacgccggauccggcaucaucauaucagacacaccaguccacgacugcaacaccacgugccaaacaccaaagggcgcaauuaacacaucccuaccuuuccaaaauauccacccaaucaccaucggcaaaugcccaaaauacgucaaaagcacaaaacuccgacuagccacaggccugcgcaacguccccuccauccaaagccgcggccucuucggugccaucgccggauucauugaaggcggcuggacaggaaugguagacggcugguacggcuaccaccaccaaaacgagcaaggaucaggcuacgccgccgaccuaaaaagcacacaaaacgccaucgacgaaauaaccaacaaggucaacagcguuauagagaaaaugaacacacaauucaccgcagucggcaaagaguucaaccaccuagaaaaacgcaucgagaaccucaacaaaaagaucgacgacggcuuccucgacaucuggaccuacaacgccgaacuauuaguacuccucgaaaacgaacgcacacucgacuaucacgacucaaacgucaaaaaccucuacgaaaaaguuagaagccaacucaaaaacaacgccaaagaaaucggcaacggcugcuucgaguucuaccacaaaugcgacaacacuugcauggaaucagucaaaaacggcaccuaugacuacccaaaauacucagaagaagccaaacuaaaccgcgaagaaaucgacggagucaaacuagaaagcacccgcaucuaccagauccucgccauauacucaacaguggccagcagccuaguccuagucgucucccucggcgcg

SEQ ID NO: 58859 - RNA, 1593 nt, Artificial Sequence
  derived and/or modified sequence opt11 from anti-influenza_Chain
acgcucugcaucggauaccacgccaacaacucaacagacacuguagacaccguccuagagaaaaacguaaccgucacacacagcgucaaccugcucgaagacaagcacaacggcaaacuaugcaaacuccgagguguggcuccccugcaccucggcaaaugcaacaucgccggcuggauccugggcaaccccgaaugcgaaagccuauccacggccuccuccuggagcuacaucgucgaaaccucauccuccgacaauggaaccugcuacccaggcgacuucaucgacuacgaagaacucagagaacaacucuccagcguauccucauucgaacgauucgaaauauucccgaaaacauccucauggcccaaccacgacuccaacaaaggcguaacagcggccugcccccacgccggcgccaagagcuucuacaaaaaccuaaucuggcucgucaagaaaggcaacucauaccccaaacuaucaaaaucauacauaaacgacaaaggaaaagaaguccuaguccucuggggcauucaccacccauccacauccgccgaccaacaaucccucuaccaaaacgccgacgcauacgucuucgucggcaccucacgauauuccaagaaauucggccccgagauagccauacgacccaaaguccgcgaccaagaaggccgcaugaauuacuacuggacccucgucgagccaggagacaagauaacauucgaagcaaccggcaaccucguuguaccccgauacgccuucgccauggaacgagacgcaggcagcggcaucauaauaucggacacccccguacaugacugcaacacaaccugccaaacccccaaaggcgccaucaacaccagccuccccuuccaaaacauccaccccaucaccaucggcaaaugcccaaaauacgucaaaagcaccaaacuacgccucgcuaccggcuuacgaaacgucccaucaauacaaucaagaggccuauucggcgcaaucgcaggcuucaucgaaggaggauggacaggcaugguagacgguugguacggauaccaccaccaaaacgaacaaggcuccggcuacgcagccgaccucaaauccacccaaaacgccauagacgaaauaaccaacaaaguaaacagugucaucgagaaaaugaauacccaauucaccgccgucggcaaagaguucaaccaucuggaaaaacgaauagaaaaccuaaacaagaaaaucgacgacggcuuccucgacauauggaccuacaacgcagaacuccucguccuccucgaaaacgaacgcacccuagacuaccacgacuccaacgucaaaaaccucuacgaaaaaguccgaucacaacucaaaaacaacgccaaagaaauaggcaacggcugcuucgaguucuaccacaaaugcgacaauaccugcauggaaucagucaaaaacggcaccuacgauuaucccaaauacuccgaagaagccaaacuaaaccgcgaagaaaucgacggagucaaacuggaguccacccggaucuaccaaauccucgccauauacucaacugucgcauccucccucguucucguugucucccuaggcgcc

SEQ ID NO: 58860 - RNA, 1605 nt, Artificial Sequence
  derived and/or modified sequence opt11 from anti-influenza_Chain
gccaacgccgacacccuaugcaucggauaccacgccaacaacucaaccgacaccguagacaccguacucgagaaaaacguuaccgucacccacagcguaaaccuacuggaagacaaacacaacggcaaacucugcaaacuccgaggcgucgccccucuucaccucggaaaaugcaacauagccgguuggauccuaggcaaccccgaaugcgaaucacugagcacagccucaagcuggagcuacauaguagaaaccuccagcuccgacaacggaacaugcuacccaggcgacuucaucgacuacgaagaacuccgagaacaacucucaagugucagcucauucgaacgauuugaaauauucccaaaaaccuccuccuggcccgaccacgacagcaacaagggcgucacugcagccugcccccacgccggggccaaaaguuucuacaaaaaccucaucuggcucgucaaaaaggguaacagcuaccccaaacuaucaaaauccuacauaaacgacaaaggaaaagaaguccugguacuauggggaauccaccaccccuccacguccgccgaccaacagucacuauaccaaaacgccgacgccuacguauuugucggcaccucaagguacagcaagaaauucaaacccgaaaucgcaauccgcccaaaaguacgcgaccaagaaggaaggaugaacuacuacuggacccuugucgaacccggcgauaaaaucaccuucgaagccaccgggaaccucguagucccccgcuacgccuucgcgauggaacgcaacgcaggcagcgggaucauaauaagcgacacccccguccacgacugcaacacaaccugccaaaccccaaaaggagcaauaaacaccucccuacccuuccaaaacauccacccaauuacaauaggcaaaugcccaaaauacguuaaguccacaaaacuccgccuagccacaggccuucgcaacgucccguccauucaaucccgcggacucuucggcgccaucgccggcuucaucgaaggcggcuggaccggcauggucgauggcugguacggguaccaccaccaaaacgaacaaggcagcggcuacgccgccgaccugaaauccacccaaaacgcaaucgacaagaucacuaacaaagucaacuccguaauagagaaaaugaacacccaauuuacagccgucggcaaagaauuuaaccaccucgagaaaagaauagaaaaccuaaacaagaaagucgacgacggauuccuagacaucuggaccuacaacgccgaacuguuaguccuccucgaaaacgaacgcacccucgacuaccaugacuccaacguuaaaaaccucuacgaaaaaguacgaagccaacucaaaaacaacgccaaagaaaucggaaacggaugcuucgaguucuaccacaaaugcgacaauaccugcauggaguccgucaaaaacgggacguacgacuaccccaaauacuccgaagaagccaaacuaaaccgcgaagaaaucgacggggucaagcuagaauccacgcgcaucuaucagauccuggccauauacucaacagucgccuccagccuaguacugguaguaucacucggugca

SEQ ID NO: 58861 - RNA, 1605 nt, Artificial Sequence
  derived and/or modified sequence opt11 from anti-influenza_Chain
gcaaacgccgauacacucugcaucggauaucacgcaaacaacuccaccgacaccguggacaccguccuggaaaaaaacgugaccguaacacacuccguaaaccugcuugaagacaaacacaacggcaaacucugcaaacuacgcggcgucgcuccacuccaccucggcaaaugcaacauagcaggcuggauacucggcaacccagaaugcgaaagccuuagcaccgccuccucauggucauacaucguagaaacaagcuccagcgacaacgggaccugcuaccccggcgauuucaucgauuacgaagaacuacgcgagcaacucuccagcgucagcucauucgaacgcuucgaaauuuuccccaaaacaagcuccuggcccaaccaugacagcaacaagggcgucaccgccgcuugcccccgagccggcgccaagggcuucuacaaaaaccuaaucuggcucgucaaaaaaggcaacucauacccuaaacuuaacaaauccuacauaaacgacaaaggcaaagaaguccuaguacuauggggaauccaccaccccagcaccaccgcagaccagcagucacucuaccaaaacgccgacaccuaugucuucguaggcaccucccgcuacuccaagaaauucaaacccgaaauagaaauccgccccaaagucagagaucaagaaggccgaaugaacuacuacuggacccucguagaacccggugacaaaaucaccuucgaagccacuggcaaccuugucgucccacgguacgcauucgccauggaacgaaacgcagguagcggcaucaucauaucagacaccccagugcacgacugcaacacaaccugccaaacacccaaaggagcaaucaauaccagccucccuuuccaaaacauccaccccaucaccauuggcaaaugcccaaaauacgucaaaagcaccaaacuacgccuagccaccggccuccgcaacguacccuccauccaaucgcgcggccucuucggggccauagccggauucaucgaaggcggauggaccggcaugguagauggcugguacggcuaccaccaccaaaacgaacagggauccggauacgcagccgaccugaaaagcacacaaaacgccauagacaaaauaacaaacaaggucaacuccguaauagaaaagaugaacacccaauucaccgccguagacaaagaauucaaccaccucgaaaaacgcaucgaaaaccucaacaaaaaggucgaugacggcuuccucgacaucuggacauacaacgcagaacuccuuguacuacucgaaaacgaacgcacccucgacuaccacgacuccaacgucaaaaaucuguacgaaaaaguucgaaaccaacuaaaaaacaacgccaaagaaaucggcaacgggugcuucgaauucuaucacaaaugcgacaacaccugcauggaauccgucaagaacggaacguacgacuaccccaaguacagcgaagaagccaaacucaaucgcgaagaaaucgacggagucaaacucgaauccacccgcaucuaccaaauccucgccaucuacucaaccguggcaucgucacuaguccuaguagucucccucggcgcu

SEQ ID NO: 58862 - RNA, 1605 nt, Artificial Sequence
  derived and/or modified sequence opt11 from anti-influenza_Chain
gccaacgccgacacccucugcauaggauaccaugccaacaacucaaccgacaccguggacaccguacucgagaaaaacguuacaguaacacacaguguaaaccuacuggaagacaaacauaacggcaaacuuugcaaacuacgaggcguugccccacuacaccuaggcaagugcaacaucgccggauggauccucggaaacccggaaugcgaaucccuauccacggccuccucauggagcuacaucguugaaacauccagcuccgacaacggaaccugcuacccaggcgacuucaucgacuacgaagaacuccgcgaacaacucagcucagucuccagcuucgaacgauucgaaaucuucccgaagaccuccagcuggccagaccacgacagcaacaaaggcgucaccgccgcaugcccacacgccggcgcaaaaucuuucuauaagaaccuaaucuggcucgucaagaaagguaacagcuaccccaaacuaucaaaauccuacaucaacgacaaaggcaaagaagugcucguccucuggggcauacaccaccccuccacguccgcagaucaacaaucccuauaccaaaacgccgacgccuacguauucgucggcacaucccgcuacagcaagaaauucaaacccgaaaucgccauccgaccaaaaguccgagaccaagaaggccgaaugaacuacuacuggacccucguagaaccaggagacaaaaucaccuuugaagccaccggaaaccuagucguccccagguacgccuucgccauggaacgaaacgccggcuccggaaucauuauauccgacacccccguccacgacugcaacacaaccugccaaacccccaaaggcgcaaucaacacaucacuacccuuccaaaacauccaccccaucaccauuggaaaaugccccaaauacguaaaaucaaccaaacucagacucgccaccggccuacgaaacguuccauccauccaaucccguggacucuucggcgcgauagcaggauuuaucgaaggcggauggaccggcauggucgacggaugguacggauaccaccaccagaacgaacagggaucuggcuacgcagccgaccucaaauccacccaaaacgcuaucgacaaaauaaccaacaaaguaaacucggucauugaaaagaugaacacgcaauucaccgccgucggcaaagaguucaaccaccucgaaaaacgcaucgaaaaccucaacaagaaaguagaugacggcuuccuagacauauggacauacaacgcugaacuccucguacuucucgaaaacgaacgaacccucgacuaccacgacucgaacgucaaaaaccuauacgaaaaaguaagaucacaacucaaaaacaacgcaaaagaaaucggaaacggcugcuuugaguucuaccacaaaugcgacaauaccugcauggaaagcguaaagaacggcacuuacgacuacccgaaauacagcgaagaagcaaaacuaaaccgcgaagagauagacggcgugaagcucgaauccacacgcauauaucagauccucgcgaucuacucaacaguagccucaucccuaguccuagucguaucccucggcgcc

SEQ ID NO: 58863 - RNA, 1605 nt, Artificial Sequence
  derived and/or modified sequence opt11 from anti-influenza_Chain
gccaacgccgacacccuaugcauaggcuaccacgccaauaacucaaccgacacaguagacaccguacucgaaaagaacguaaccguaacccacagcgucaaccuccuagaagacaaacacaacggaaaacucugcaaacuccgcggaguagccccacuccaccucggcaaaugcaauaucgccggcuggauccucggaaacccagaaugcgaaucccucuccaccgccucaagcuggagcuauauagucgaaacauccagcagcgacaacggaaccugcuaccccggcgacuucaucgacuacgaagaacuccgcgaacaacucucaagcguauccuccuucgaacgcuucgaaauauuucccaaaacguccuccuggcccaaccacgacagcaacaaaggcgucacagcagcaugcccgcgagcaggggccaaaggcuucuacaaaaaucucaucuggcucguaaagaaaggcaacagcuacccaaaacuaaacaaauccuacaucaacgacaaaggcaaagaaguccucguucucuggggcauacaccaccccuccacaaccgccgaccaacaaagccucuaccaaaacgccgacacuuaugucuucgucggaaccuccagauacuccaagaaauucaaaccggaaaucgaaauacgcccaaaaguacgcgaccaagaaggaagaaugaacuacuacuggacccuaguggaaccgggcgacaaaauaacauucgaagccaccggcaaccucgucguaccccgguacgcguucgcaauggaacggaacgcaggcaguggaaucaucaucagcgacacccccgugcacgacugcaacacaaccugccaaacccccaaaggagccaucaacacuucacuccccuuccaaaacauccaccccauaaccaucggcaaaugcccuaaauacgucaaauccaccaaacucagacuagcuaccggccuacgcaacguccccuccauccagagccgcggccuauucggagcaaucgccggcuuuauagaaggaggauggacagguauggucgacggaugguacggauaccaccaccagaacgaacagggcuccggauacgccgccgaccugaaauccacacaaaacgcaauagacaaaauaacaaacaaaguaaacuccguaaucgagaaaaugaacacccaauucaccgcgguagacaaagaguucaaccaccuggaaaaacgaaucgaaaaccuaaacaagaaagucgacgacggguuccucgacauauggaccuacaacgccgaacuccuagucuuacuagaaaacgaacgcacccuagacuaccacgacuccaaugucaaaaaccucuacgaaaaagugcggaaccaacucaaaaacaacgccaaagaaaucggcaacggaugcuucgaguucuaccacaaaugcgacaacacauguauggaaagcgucaaaaacggaaccuacgacuaccccaaauacucagaagaagccaaacugaaucgagaagaaaucgacggcguaaaacucgaauccacccgcauauaccaaauacuagcgaucuacucaacagucgcuuccucacucguccuaguaguaucacuaggcgca

SEQ ID NO: 58864 - RNA, 1644 nt, Artificial Sequence
  derived and/or modified sequence opt11 from anti-influenza_Chain
caaaaacuccccggcaacgacaacagcacagccacccucugucucggccaccacgccguccccaacggaaccaucgucaaaaccaucaccaacgaccaaauagaagucaccaacgccacagaacucguacaaucgucauccaccggcgaaaucugcgacuccccacaccaaauacuagacggcgaaaacugcacccuaaucgacgcacuccuuggugacccgcaaugcgacggcuuccaaaacaagaaaugggaccucuucgucgaacgauccaaagccuacuccaacuguuaccccuacgacgucccagauuacgccucccuacgcagccucguagccuccagcggcacccucgaguucaacaacgaauccuuuaacuggaccggagucacccaaaacggaaccucaucagccugcauccgacgcuccaacaacucauucuuuagccgacucaacuggcuaacccaccucaaauucaaauaccccgcccucaacgucaccaugcccaacaacgaaaaauucgacaaacuguacaucuggggcguacaccaccccggcaccgacaacgaccaaauauuccccuacgcgcaagccuccggacgcauuaccguauccacaaaacgcucacaacaaacagucauccccaacaucgguucccgcccccggguaagaaacauccccagccguaucucaaucuacuggaccauaguaaaaccaggagacauucuacucaucaacuccaccggcaaccucaucgcgccccgcggcuacuucaaaauccgcuccggaaaauccagcaucaugcgauccgacgcccccauaggcaaaugcaacucagaaugcaucaccccuaauggaucgauccccaacgacaaacccuuccaaaacgucaaccgcaucaccuacggcgcaugcccacguuacguaaaacaaaauacccucaaacuagccaccggaaugcgcaacguacccgaaaaacaaacacguggcauauucggcgccaucgcuggcuucauugaaaacggcugggaaggcauggucgacggcugguacggcuuccgccaccagaacuccgaaggcaucggacaagccgcagacuuaaaaucgacucaagccgccauagaccaaaucaacggcaaacucaaccgacucauaggaaaaaccaacgaaaaauuucaccaaauagaaaaagaguucuccgaagucgaaggacgcauccaagaccucgaaaaauacgucgaagacaccaaaaucgaccucuggucuuacaacgcagaacuacucgucgcccucgaaaaccagcauaccauugaccucaccgacuccgaaaugaacaaacucuucgagaaaacaaagaaacaacuccgcgaaaacgcagaagacaugggcaacgguugcuucaaaaucuaccacaaaugcgacaacgcaugcaucggcuccauccgaaacggcacauacgaccacgacgucuaccgcgacgaagcacucaacaaccgcuuccaaauaaagggcguggaacucaaaucgggcuacaaagacuggauccucuggaucuccuucgccaucuccugcuuucuccucugcguugcccuacucggcuucaucaugugggccugccaaaaagggaacauccgcugcaacauc

SEQ ID NO: 58865 - RNA, 1644 nt, Artificial Sequence
  derived and/or modified sequence opt11 from anti-influenza_Chain
cagaaacuccccggcaacgacaacuccaccgccacccucugucucggacaccaugccguccccaacggcaccaucgucaaaaccaucacuaacgaccaaaucgaagucaccaacgccacagaacucguccagucuucauccaccggcgaaauaugcgacucgccacaccaaauacuagauggcgaaaacugcacccucaucgacgcacugcucggcgacccccaaugcgacggguuccaaaacaagaaaugggaccuauuuguggaacgauccaaagccuauucuaacugcuaccccuacgacguacccgacuacgcauccuuacgaucccucgucgccuccagcggcacacucgaauuuaacaacgagagcuucaacuggacgggaguaacacaaaacggaaccuccuccgccugcauccgccgguccaacaacucauucuucagccggcucaacuggcucacacaccucaaauucaaauaccccgcccuuaacgucaccaugccuaacaacgaaaaauucgacaaacucuacauuuggggcguccaccacccaggaaccgacaacgaccaaaucuucccauacgcccaagccagcggacgaaucaccguuuccacaaaacgaucacaacagacaguaauccccaacaucggaagccgcccccgaguacgcaacaucccuucccgaaucuccauauauuggaccaucgucaaacccggcgauauccuacucauaaacagcacaggaaaccuaaucgcaccgcgcggauacuucaaaauacgaucaggcaaaagcucaauaaugcgaagcgaugcccccaucggcaaaugcaacagcgaaugcaucacccccaacggcuccauccccaacgacaaacccuuccaaaacgucaaccggaucacauacggcgccugcccccgcuaugucaaacaaaacacccucaaacuagccaccggcaugcgcaacguccccgaaaaacagacacgcggcaucuucggagcaaucgccggauucaucgaaaacggaugggaaggaaugguagacggcugguacggauuccgacaccagaacucagaaggcaucggccaggccgccgaccucaaaagcacacaagcagccauagaccaaauaaacggcaagcucaaucgccuaauuggcaaaacaaacgaaaaauuccaucaaauagaaaaagaguucuccgaaguagaaggacgaauccaagaccuagaaaaauacgucgaagacacaaaaaucgaccucugguccuacaacgccgaacuccuagucgcccuagaaaaccaacacacaaucgaccuaaccgacucggaaaugaacaaacucuucgaaaagaccaagaaacaacuacgagaaaacgccgaagacaugggcaacggcugcuuuaaaaucuaccacaaaugcgacaacgcaugcaucggcuccauccgcaacggaaccuacgaccacgacgucuauagggacgaagcccucaacaaccgauuucaaaucaaaggcguagaacuaaaaagcggauacaaagacuggauccucuggaucucauucgcaaucucaugcuuccuacucugcgucgcacuccuaggauucauaaugugggcaugccaaaaaggaaacauccgcugcaacaua

SEQ ID NO: 58866 - RNA, 1647 nt, Artificial Sequence
  derived and/or modified sequence opt11 from anti-influenza_Chain
augcucaccuuccaccgcauaauucgcaaaggguggauguuccuccucgccuuccuccuuaccgcccuacuauucugccccacaggccaaccagccaaagccgccgcacccuucaacggcaccaugaugcaguacuucgaaugguaccuaccugacgacggaacccuauggaccaaagucgcaaacgaagcuaacaaucuuagcagcuuaggcaucaccgcgcucuggcucccuccagccuacaaggguaccucccgaagcgacgucggauacggaguuuaugaccucuacgaccuuggcgaauuuaaccaaaaaggcgcaguacgaaccaaauacggaaccaaagcccaauaccugcaggccauacaagccgcccacgcggccggcaugcaagucuacgcggacgucguauucgaccacaaaggcggcgcagacggaaccgaaugggucgacgcagucgaagucaaccccuccgaccgcaaccaagaaaucuccggcaccuaccaaauccaagccuggaccaaauucgacuuccccggccgcggaaacacauacucauccuucaaauggcgcugguaccacuucgauggcguagacugggacgaaaguagaaagcuaucccgcauauacaaauuccgaggaauagggaaagcaugggacugggaagucgacacagaaaacggcaacuacgacuaccuaauguacgcugaccucgacauggaccacccagaagucguaacagaauuaaaaagcuggggaaaaugguacgucaacaccacaaacaucgacggcuuccgccuagacgccguuaaacacaucaaauucucauucuuccccgacuggcuaagugacguccgcucacaaaccggcaaaccacucuucacaguaggagaauacuggagcuacgacauaaacaaacuccacaacuacaucaugaaaaccaacggcaccaugucccucuucgaugcaccacuccacaauaaauucuacaccgccuccaaaagcggcggcacuuucgacaugcgaacacucaugaccaacacacucaugaaagaccaacccacucuagcagucacuuucgucgacaaccacgacacagaacccggccaagcccugcaaucaugggucgaccccugguucaaaccccuugccuacgcauucauccuaacccgacaagaaggauacccaugcgucuucuacggcgacuacuacggaaucccccaauacaacauccccagccuaaaaucgaagaucgacccccuccuaauagcccgcagagacuacgccuaugguacccaacacgacuaccuagaccacuccgacaucaucggguggacccgcgaaggaguaacagaaaaacccggcuccggccucgccgcccucauaaccgacggaccuggcggaucaaaguggauguacgucggaaaacaacaugcaggaaaaguauucuaugaccucaccggcaaccgcagcgauacagucaccaucaacagcgacggcuggggcgaguucaaaguaaacggagggucagucucaguaugggucccacgcaaaacgaccgucucaaccaucgccuggucaaucacaaccagaccauggaccgacgaguucguccgcuggaccgaaccccgccuaguagccuggccc

SEQ ID NO: 58867 - RNA, 1647 nt, Artificial Sequence
  derived and/or modified sequence opt11 from anti-influenza_Chain
aucuguaucggcuaccacgcaaacaacuccaccgaacaagucgacaccauaauggagaaaaacgucaccgugacccacgcucaagacauccucgagaaaacccacaacggcaaacucugcgaccucgacggagucaaaccccuaauccuacgcgacuguucaguagcaggcuggcuccuaggaaaccccaugugcgacgaguucaucaacguuccagaauggucauacaucgucgaaaaagccaacccagccaacgaccucuguuaccccggcaacuuuaacgacuacgaagaacucaaacaccuccuaagccgcauaaaccacuucgagaaaauccaaaucauaccaaaauccucaugguccgaccacgaagccuccagcggugucucguccgcuugccccuaccaaggaaccccaucauucuuccgcaacgucguuuggcuaaucaagaaaaacaauacauacccaaccaucaaaagaucauacaacaacaccaaccaagaagaccuccucauccuuuggggcauccaccacuccaacgacgccgcagaacaaaccaaacucuaccaaaaccccaccacguacaucucugucggaaccucaacacuaaaccaaagacucgucccaaaaaucgccacccgaucaaaagucaacggccaaaacgggcgaauggacuucuucuggaccauucucaaacccaacgacgccauaaacuucgaauccaacggcaacuucaucgcaccagaauacgccuacaaaauugucaagaaaggagacagcgccauagucaaauccgaagucgaguacggcaacugcaacacaaaaugccaaacaccaaucggcgcaauaaacucauccaugcccuuucacaacauucacccccuaacgaucggcgaaugccccaaauacgucaaauccaacaaacugguccuugccaccggccuccgcaacuccccacuacgcagcgacaaaacccacacaugcccucccugccccgcccccgaacuccucggaggccccucaguauuucucuucccacccaaacccaaagacacacucaugaucucccguacccccgaaguaaccugcgucguugucgacgucucccacgaagacccugaagucaaauuuaacugguacgucgacggcgucgaaguacacaacgccaaaacaaaaccccgcgaagaacaguacaacucaacauaccgcgucgucagcguccuaaccguacugcaccaagacuggcucaacggcaaagaauacaaaugcaaagucuccaacaaagcccuaccagcacccaucgaaaagaccaucucaaaagccaaaggccaaccccgagaaccccaaguuuacacccuaccacccucccgcgaagaaaugaccaaaaaccaagucucccucacgugccucgucaaaggcuucuaccccagcgacauagccgucgaaugggaauccaacggccaacccgaaaacaacuauaaaacaacgccacccgugcucgacucagacggcucauucuuccuauacuccaaacuuaccguagacaaaucccgcuggcaacaagguaacguauucucaugcuccgucaugcacgaagcccuccacaaccauuacacacagaaaucacucucacucucacccggcaaa

SEQ ID NO: 58868 - RNA, 1647 nt, Artificial Sequence
  derived and/or modified sequence opt11 from anti-influenza_Chain
aucugcaucggauaccacgccaacaacuccaccgaacaagucgacaccaucauggaaaagaacgucaccguaacccacgcacaagacauccuagagaaaacccacaacggcaaacuaugcgaccuagacggcgucaaaccccuaauacuccgcgacugcagcguagccggauggcuccucggaaaccccaugugcgacgaguucaucaacguccccgaauggucauacauagucgaaaaagcaaaccccgccaacgaccuauguuacccaggcaacuucaacgacuacgaagaacucaaacaccuucucucccgcaucaaccacuucgagaaaauccaaauaauacccaaaucuagcugguccgaccacgaagcaagcuccggagucucauccgcaugccccuaccagggaacccccucauucuuccgaaacgucguauggcucaucaagaaaaacaacaccuacccaacuaucaaacgcucauacaacaacacaaaccaagaagaccuccucauccuauggggaauacaccacucaaacgacgccgccgaacaaacaaaacucuaccaaaaccccacgaccuacaucuccguaggcacuucaacacucaaccaaagacucguacccaaaaucgccacccgauccaaggucaacggacaaaacggccgcauggacuucuucuggacaauccuaaaaccgaacgacgcaaucaacuucgaaucaaacggcaacuucaucgccccggaauacgcuuacaaaaucgucaagaaaggcgacuccgcaaucgucaaaagcgaaguagaauacggcaacugcaacaccaaaugccaaacccccaucggcgcuaucaacuccuccaugccuuuucacaacauccacccccucacaaucggcgaaugcccgaaauacguaaaaucaaacaaacucguacucgccacaggccuacgaaacucgccccuacgcucagacaagacgcacaccuguccgcccugccccgcccccgaauuacuaggcggacccuccguauuccucuucccgccaaaacccaaagacacccucaugauaucccgcacacccgaaguaaccugcgucgucgucgacgucucacacgaagacccagaaguaaaauucaacugguacgucgacggagucgaaguccacaacgcaaagaccaaaccccgcgaagaacaauacaauucaaccuaccgcguggucuccguccuaaccguucugcaccaagacuggcucaacgguaaagaauacaaaugcaaagucucuaacaaagcccuaccugccccaauagaaaagaccauauccaaagcaaaaggacaacccagagaaccccaaguauacacccuaccucccucccgcgaagaaaugaccaaaaaccaagucucccuuacaugccucguuaaaggauucuaccccuccgacaucgccgucgaaugggaauccaacggucaacccgaaaacaauuacaaaaccaccccucccgucuuagacagugacggcucuuucuuccuuuacagcaaacucacugucgacaaaucccguuggcagcaaggcaacguauucuccugcucagucaugcaugaagcacuacauaaccacuacacccaaaaaucccucucacuaucccccggcaaa

SEQ ID NO: 58869 - RNA, 1647 nt, Artificial Sequence
  derived and/or modified sequence opt11 from anti-influenza_Chain
augcucacauuccaccgaaucauccgcaaaggcuggauguuccuccuagccuucuugcucacagcccuacuauucugcccaacaggucagccagcaaaagccgcagcacccuucaacgguacgaugaugcaauacuucgaaugguaccucccggacgacggaacacuauggaccaaaguagccaacgaagccaacaaccuaucaucccuagguauuaccgcccucugguuaccacccgcauacaaagggacgucccgauccgacgucggauacggcgucuacgaccuguacgaccucggcgaguucaaccaaaaaggcgccguccgaaccaaguacggcaccaaggcccaauaucuacaggccauccaagcggcccacgcagccggcaugcaaguguacgcagacgucguauucgaccacaaaggaggggccgacggcacagaauggguagacgccguagaagucaaccccuccgaccgaaaccaagaaauaucaggcacauaccaaauacaagcauggaccaaauucgauuuccccggacguggcaacacauacucguccuucaaauggagaugguaccacuucgacggcguagacugggacgaaucacgcaaacucagccggaucuacaaauucagaggcaucggaaaagcgugggacugggaagucgacaccgaaaauggcaacuacgauuaccuaauguacgccgaccuagacauggaccacccagaagucgucaccgaacucaaaagcuggggaaaaugguacguaaacaccaccaacaucgacggcuuccgacucgacgcaguaaaacacaucaaauucucauucuuccccgacuggcucuccgacgucagaucccaaacuggaaaaccacuauuuaccgucggggaauacuggagcuacgacaucaacaaacuccacaacuauaucaugaaaacgaacgggaccaugucccuauucgacgcaccccuacacaacaaauucuacacugccucaaaauccggcgguaccuucgacaugagaacacuaaugacaaacacacuaaugaaagaccaacccacacucgccgucaccuucgucgacaaccaugacaccgaacccggccaagcccuacaauccugggucgacccaugguucaaaccacucgccuacgcuuucauccucacgcgccaagaaggcuaccccugcguguucuacggcgacuacuacggaaucccccaauacaacaucccaagccuaaaaucaaaaaucgacccccuccucaucgcaagaagagacuacgccuacggcacccaacacgacuaucucgaccacagcgacaucaucggauggacacgcgaaggcgucacggaaaaaccaggcuccggccuggccgcucuaaucacagacggccccggcggcagcaaauggauguacguaggcaaacaacacgcaggcaaagucuucuacgaccuaaccggcaaccgcuccgacaccguaaccauaaacucggacggcuggggagaauuuaaagugaacggcggauccguauccgucugggucccacgaaaaaccaccgucuccacaaucgccuggucaauuaccacccgcccauggacagacgaguucguccgauggaccgaaccccgccucguagccuggccc

SEQ ID NO: 58870 - RNA, 1650 nt, Artificial Sequence
  derived and/or modified sequence opt11 from anti-influenza_Chain
gaccagaucugcauaggcuaccacgcaaacaacucaacggaacaagucgacacaauaauggagaaaaacgugaccgucacccaugcccaagacauacucgagaaaacacacaacggcaaacuaugcgaccuggacggcguaaaaccacucauccuaagggacugcucugucgccggcuggcuccugggcaacccgaugugcgacgaauuuaucaacguccccgaaugguccuacauagucgaaaaagccaacccaaccaaugaccuaugcuaccccggcuccuucaacgacuacgaagaacucaaacaccuccugucacgcaucaaccacuucgagaaaauacaaaucauccccaaaucgagcuggagcgaccacgaagccuccucagggguaagcagugccugccccuaccucggcucccccuccuucuuccgaaacgucgucugguuaaucaagaaaaacuccacguaccccacaaucaagaaauccuacaacaacaccaaccaagaagaccuccucguccuauggggcauccaccacccaaacgacgccgccgaacaaacacgccuuuaccagaaccccacaaccuacaucuccaucggaaccagcacacucaaccaacgccucgucccuaaaaucgccaccagaucaaaagucaacggucaguccggccgcauggaguucuucugggccauacucaaacccaacgacgccaucaacuucgaaucgaacggaaacuucaucgccccggaauacgccuacaaaaucguaaagaaaggcgacagcgcgaucaugaaaagcgaacucgaauacggaaacugcaacaccaaaugccagaccccgaugggagccauaaauuccucgaugccauuccacaacauccacccacuaacaauaggcgaaugccccaaauacgucaaaucaaaccgccucguacucgccaccggccucagaaacucaccccaaagagaaucccgaagaaagaaacgaggccuguucggcgccaucgcaggauucauugaaggaggguggcaaggcauggucgacggaugguacggcuaccaucacagcaacgaacaaggaucuggcuacgccgcagacaaagaauccacccagaaagccaucggcgucaccaacaaagucaacagcauaauugacaaaaugaacacccaauuugaagcugucggccgagaguucaacaaccucgaacgccgcaucgaaaaccucaacaagaaaauggaagacggauuccuagacgucuggaccuacaaugccgaacuccucguacucauggaaaacgaacgcacccucgacuuccacgacucaaacgugaaaaaucuauacgacaaagucagacuacagcuacgagacaacgccaaagaacuaggaaacggcuguuucgaguucuaccacaaaugcgacaacgaaugcauggaaucuauccggaacggaaccuacaacccucaauacucagaagaagcgcgcuuaaaacgcgaagagaucagcggcgucaaacuagaauccauaggcaccuaccaaauccuaagcauuuacagcaccgucgcuagcucgcuagcacuagccauaaugauagcuggccuaucccucuggaugugcuccaacggaucacuacagugcagaauaugcaua

SEQ ID NO: 58871 - RNA, 1650 nt, Artificial Sequence
  derived and/or modified sequence opt11 from anti-influenza_Chain
gaccaaaucugcauaggcuaccacgccaacaauagcaccgaacaagucgacaccauaauggaaaagaacgucacggucacacacgcacaagacauccucgaaaaaacccacaacggaaagcuaugcgaccucgacggcgucaaaccccucauacuacgcgacugcuccgucgcuggauggcuacuaggaaacccuaugugcgacgaauucaucaacgugcccgaaugguccuacaucgucgaaaaggccaaccccaccaacgaccucuguuauccaggaucauucaacgacuacgaagaacuuaaacacuuacucagccggaucaaccacuucgaaaaaauccaaaucauccccaaaucaucgugguccgaccacgaagccuccagcggcguauccucagcaugcccauaccuaggcagcccaucauucuuccgcaacgucgucuggcucaucaaaaaaaacuccaccuaccccacaaucaaaaaauccuacaauaacaccaaccaagaagaccuacucguccucuggggcauacaccacccaaacgacgcagccgaacaaacccgccucuaucaaaaccccacuaccuacauaagcaucggaaccuccacccugaaccaacgacucguccccaaaaucgcaacccgcagcaaagucaacggccaaucaggcagaauggaauucuucugggcaauacugaaaccaaaugaugccaucaacuucgaaucaaacgguaauuucaucgcacccgaauaugccuacaaaauagugaagaaaggcgacagcgcgaucaugaaaagcgaacucgaguacggcaacugcaacacgaaaugccaaaccccuaugggcgcaaucaacagcagcaugcccuuccacaauauccacccacucacaaucggggaaugccccaaauaugucaaaucaaaccgccucguacuagccaccggccuacgcaacuccccgcaacgagaaucccgcagaaaaaagagaggacucuucggcgcaaucgcaggcuucaucgaaggcggcuggcaaggcauggucgacggcugguacggcuaccaccacagcaacgaacaaggcuccggcuacgccgcagacaaggagagcacccaaaaagcaauaggcgucaccaacaaaguaaacucgaucaucgacaaaaugaauacacaauuugaagccgucggcagagaauucaacaaccucgaacgcagaauagaaaaccucaacaaaaaaauggaagacggguuccucgacgucuggaccuacaacgccgaacuccucguacucauggaaaacgaacgcacccuagacuuccacgacuccaacgucaaaaaccuguacgacaaaguccgucuacaacuccgagacaacgccaaagaacuuggcaacggcugcuucgaauucuaccacaaaugugacaacgaaugcauggaaagcauccgcaauggaaccuacaacccucaguacuccgaagaagcccgccuuaaacgagaagaaauaagcggagucaaacucgaauccauaggcaccuaccaaauccucuccaucuacuccaccgucgcaucuucccuggcacucgcaauaaugauagccggccuaucucuauggaugugcuccaacggcucccuccaaugccgcaucugcauc

SEQ ID NO: 58872 - RNA, 1656 nt, Artificial Sequence
  derived and/or modified sequence opt11 from anti-influenza_Chain
augaacauccaaauccucgcuuucaucgccugcguacucaccggcgccaagggagacaaaauaugccucggccaccacgccguagccaacggaaccaaggucaacacccuaacagaaaaaggaaucgaagucguaaacgcuacagaaacagucgaaaccgcagacgucaagaaaauaugcacgcaaggcaaaagagccaccgaccucggccgcuguggacuacucggaacccucauaggacccccucaaugcgaccaauuccuggaguucagcucagaccucaucaucgaacgccgcgaaggcaccgacguuugcuacccaggccgcuuuacaaacgaagaaucgcuccgccaaauacuccgccgcucagguggaaucggcaaagaauccauggguuucacauacucaggcauccgcaccaacggcgccgcaagcgccugcacccgaagcggauccuccuucuacgccgaaaugaaauggcuacuaucaaacuccgacaacuccgcauucccacaaaugacuaaggccuacagaaacccacgcaauaaacccgcccuaaucaucuggggcguccaccacucggaauccgccagcgaacaaaccaagcucuacggcucaggcaacaaacucaucaccguucgcuccuccaaauaccaacaaucauucacccccucacccggcacccgacgcaucgacuuccacuggcuccuccucgaccccaacgacacaguaacuuucacuuucaacggcgccuuuaucgcacccgaucgggcaucauucuuccgcggcgaaucacuuggaguccaaagcgacgcaccccucgauuccucgugccggggcgacugcuuccacaguggcggaaccauagucagcucccucccauuccaaaacauaaacucccgaaccgucggacgaugcccacgcuacgucaaacaaaaaucccuccuccucgcaaccggcaugcgcaacgucccagaaaaaccaaaaccccgaggccuauucggagccaucgccggauucaucgaaaacggcugggaaggacucaucaacggaugguacggcuuccgacaccagaacgcccaaggagaaggcacagcagccgacuacaaauccacucaauccgccauagaccaaaucacaggaaaacuaaaucgccuaauaggaaaaaccaaucagcaauucgaacucaucgacaacgaguucaacgaaauagaacagcaaaucggcaacguaauuaacuggacgcgcgacgcaaugaccgaaaucugguccuauaacgcugaacuccuaguagcaauggaaaaccaacacaccaucgaccucgcagacuccgaaaugucaaaacucuaugaaagagucaagaaacagcuccgugaaaacgccgaggaagacggcaccggcugcuucgagauauuccacaaaugcgacgaccaaugcauggaauccauacgaaacaacaccuacgaccacacacaguaccgcacagagucccuacaaaaccgcauccaaaucgaccccgucaaacuuagcagcggauacaaagacaucauccuaugguucagcuucggcgccagcugcuucauccuucuugccauagccaugggccuagucuucaucugcaucaaaaacggcaacaugcaauguaccauaugcauc

SEQ ID NO: 58873 - RNA, 1656 nt, Artificial Sequence
  derived and/or modified sequence opt11 from anti-influenza_Chain
augaacacccagauccucgccuucauagccugcguacuaaccggagucaaaggcgacaagauaugccuaggccaccacgccguagcuaacggcaccaaggugaacacccucaccgaaaaaggcaucgagguagucaacgcaacugaaaccgucgaaaccgcugacguaaagaaaaucugcacccaaggcaaacgcgcaaccgacuuagguagauguggccuccuaggaacccucauaggaccaccccaaugcgaccaauuccuagaguucuccucagaccucaucaucgaacgcagagaagguacagacguaugcuaccccggucgcuucacaaacgaggaaagccuccgccaaauacuccgccgauccggaggcaucgguaaagaauccaugggcuucacauacuccggcauccgcaccaacggagccacauccgcaugcaccagauccggcucgucauucuaugccgagaugaaauggcuccucagcaacucagauaacagcgccuucccccaaaugaccaaagcauaccgaaacccccguaacaaacccgcccucaucaucuggggcguacaccacuccgaguccgucuccgagcaaacuaaacucuacggaucaggaaacaaacucauuaccguccgaucaagcaaauaccaacagucauucacccccagcccaggcgcccgccgaauagacuuccacuggcuccuccucgauccgaacgacaccgugaccuucacauucaacggagcauucaucgcgcccgaucgagccagcuucuucaggggcgaaucccuaggcguccaaagcgacgucccgcucgacuccagcugccgaggugauugcuuccacucaggcggaacaauagucucaagccuccccuuccaaaacauuaacucucgcaccgucggaaaaugcccccgcuacgucaagcaaaaaucccuccuccuggccacuggcaugcgcaacguacccgaaaaacccaaaccccgcggacuauucggcgcaaucgcaggcuucaucgaaaacggcugggaaggccuaauaaacggaugguacggcuuccgccaccaaaacgcccaaggagaaggaaccgccgccgacuacaaaucaacccaaagcgccaucgaccagauaaccggcaaacucaaccgccucauaggcaaaaccaaccaacaauucgaacucaucgacaacgaguucaacgaaaucgaacaacagaucgguaacguaaucaacuggacccgcgacgccaugaccgaaauuugguccuacaacgcagaacuccucgucgccauggaaaaccaacacacaaucgaccuagcagacucugaaauguccaaacucuacgaacgcgucaagaaacaacuacgagaaaaugccgaagaagauggcaccggcugcuucgaaauauuccacaaaugcgacgaccaaugcauggaauccauccguaacaacacauacgaccacacacaauaucgcaccgagucacuccaaaaucgcauccaaaucgaucccgucaaacucagcuccggcuauaaagacaucauccucugguucaguuucggcgccagcugcuuccuccuacuugccaucgccaugggccucgucuuuaucugcaucaaaaacggcaacaugcaaugcacaaucugcauc

SEQ ID NO: 58874 - RNA, 1656 nt, Artificial Sequence
  derived and/or modified sequence opt11 from anti-influenza_Chain
augaacauacaaauacucgcauucauagccugcguccuuaccggggccaaaggcgacaaaauaugucucggacaccacgcugucgcaaauggcacaaaagucaacacccugacugaaaagggaaucgaagucgucaacgcaacggaaaccgucgaaaccgccaacaucaagaaaaucugcacccaaggcaaaagaccaaccgaccugggccaaugcggccuccuaggcacccuaauaggaccaccacaaugcgaccaauuccucgaguuuuccagcgaucucauaaucgagagacgagaaggcacagacgucugcuacccaggcaaauucaccaacgaagagucacuacgccagaucuuacgccgcucaggaggaaucgguaaagagagcaugggcuucacuuacagcggaaucagaaccaacggcgccacaagcgccugcacacgcagcggcagcagcuucuacgccgaaaugaaguggcuccucucaaacucggacaacgccgcauucccacagaugaccaaaagcuaccgaaacccccggaacaaacccgcacucauaauauggggcguccaccacagcgaaucaguaagcgaacaaaccaaacuauacggcagcggcaacaaacucauaaaaguccgcuccagcaaauaccaacaauccuucacaccaaacccuggagccaggcgaauagacuuccacugguuacuacucgacccaaacgacaccgucaccuucaccuucaacggcgccuucaucgcaccggacagagccagcuucuuccgcggagaauccaucggaguacaaagcgacgcaccacucgacagcucgugcggaggcaacugcuuccacaacggagguaccauugucucaagccugcccuuccaaaacauaaacccacgcaccgucggcaaaugcccccgauacgucaaacagaaaagccuccuccucgccacagguaugcgaaacgucccagaaaaaccaaagaaaagaggccuuuuuggcgcaaucgccggguuuauagaaaacggcugggagggccucaucaacggaugguacggcuucaggcaccaaaacgcacaaggcgagggcaccgccgcagacuacaagucuacacaaucagcuaucgaccaaaucaccgggaagcucaaccggcucaucggaaaaaccaaccaacaguucgaacuaaucaacaacgaguucaacgaagucgaacaacagaucggcaacgucaucaacuggacccaagacgccaugaccgaaguauggucguacaacgcagaacuacucguagccauggaaaaccaacacaccaucgaccucaccgacagcgaaauguccaaacucuacgagcgcguccggaaacaacuacgagaaaacgcagaagaagacggcaccggaugcuucgaaauauuccacaaaugcgacgaccacugcauggagagcauccgaaacaacaccuacgaccacacacaauaccgcacagagucacuacagaaccggauucagauagaccccgucaagcugagcggcggauauaaagacaucauccucugguucucguucggcgccucaugcuuucuccuacucgcaauagcgaugggccuaguguucauaugcaucaaaaacggaaacaugcagugcaccauaugcauc

SEQ ID NO: 58875 - RNA, 1656 nt, Artificial Sequence
  derived and/or modified sequence opt11 from anti-influenza_Chain
gaccagauaugcaucggauaccacgccaacaacuccaccgaacagguagacacaauaauggagaaaaacgucaccgucacucacgcccaaaacauccucgagaaaacacacaacggcaaacucugcgaccuagacggcgucaaaccccucauccucagagacugcagcgucgcaggcuggcuccucgguaacccaaugugcgacgaguuccuaaaugugcccgaaugguccuacauaguggagaaaaucaaccccgccaacgaccuuugcuacccaggcaacuuuaacgacuacgaagaacucaaacaccuccuaucacgaaucaaccacuucgaaaagauacaaauaaucccaaaaucauccugguccgaccacgaagcuagcuccggcgucuccuccgccugcccauaccaaggccgcagcucauucuuccgcaacgucgucuggcuaauuaagaaagacaacgccuaccccaccauaaaacgcagcuacaacaauacaaaccaagaagaccuacucgugcuaugggggauacaccacccaaacgacgccgccgaacaaacccgacuauaccaaaacccaacaacauacaucucugucggcacuucaaccuuaaaccaacgacucguccccaaaaucgccacccguuccaaagucaacggccaguccggaagaauggaguucuucuggaccauccucaagcccaacgacgccaucaacuucgaaucaaacggcaacuucaucgcacccgaaaacgccuacaaaaucgucaagaaaggagacucaacaaucaugaaaagcgaacucgaauacggcaacugcaacaccaaaugccagacacccaucggcgcaaucaacagcaguaugccauuccauaacauccacccccuuacgaucggagaaugcccaaaauacgucaaauccaacaaacucguccucgcaaccggccuccgcaacucgccccaaggcgaacgccgccgcaagaaacgcggccucuucggagcaauagccggcuucaucgaaggcggcuggcaaggcaugguagacggaugguacggguaccaccacuccaacgaacaaggauccgguuacgccgccgacaaagaaagcacccaaaaagcaaucgacggcguaacaaauaaaguaaauucaaucauagacaaaaugaacacacaguucgaagcggugggacgcgaguucaacaaccuagaacgccggaucgaaaaccugaacaagaaaauggaagacggcuuccucgacguguggacauacaacgccgaacuccucguccucauggaaaacgaacgaacccuagacuuccacgacuccaacgucaaaaaccucuacgacaaaauccgucuccaacugcgagacaacgccaaagaacucggcaacggcugcuucgaguucuaccaccguugugacaacgaaugcauggaaucaguacgaaacggaacauacgacuacccccaauacuccgaagaagcccgccuuaaacgagaagaaauauccggaguaaaacuagaaagcaucggaacauaucaaauacuaucaaucuacuccacagucgccuccucccucacacucgccaucaugguagccggacucucccuauggaugugcucaaacggcucccuccaaugccgaauaugcauc

SEQ ID NO: 58876 - RNA, 1656 nt, Artificial Sequence
  derived and/or modified sequence opt11 from anti-influenza_Chain
gaccaaauaugcaucggauaccacgcaaauaacagcacagaacaagucgacacgauaauggagaaaaacgucaccguaacacacgcccaagacauccuagaaaagacccacaauggaaaacuaugcgaccucgacggcgucaaaccucuaauccuccgcgacugcuccguggcaggcuggcuccugggaaaccccaugugcgacgaauucauaaauguaccagaaugguccuacaucguggaaaaggccaaccccacaaacgaccugugcuacccagggucauucaaugauuacgaagagcucaaacaccuacucucucgcaucaaccacuucgaaaagauccaaaucaucccaaaauccuccuggucugaccacgaagcgagcuccggcguuuccucagccugccccuaccucggcucccccuccuuuuuccgcaacgucgucuggcuaauaaaaaaaaauuccaccuacccaaccaucaaaaaauccuacaacaacacuaaccaagaagaccuccucguacucuggggcauacaccacccuaacgacgccgccgaacaaacucgccucuaccaaaaccccaccacuuacaucuccauaggcacuucuacccucaaucaaagacuugugccuaaaaucgccacgcgaucaaaagucaacggccaaucaggccgcauggaauucuucuggaccauacuuaaccccaacgacgccauaaacuucgaaagcaacggcaauuuuaucgcccccgaauacgccuacaaaauaguaaaaaaaggcgacucagccaucaugaaaagcgaacuagaauacggcaacugcaacacaaaaugccaaacacccaugggcgcgaucaacuccucaaugccauuccacaacauccacccccucacaaucggcgaaugccccaaauacgucaaauccaaccgccuaguccucgccacgggccugcgcaacagcccccaacgcgaauccagacggaaaaaacgcggccucuucggugccauagccggcuucauagaaggaggcuggcaagggauggucgacggcugguacggcuaucaccacucaaacgaacaagguagcggguacgcggccgacaaagaaagcacacaaaaggccauagacgguguaaccaacaaagucaacucgaucaucgacaaaaugaacacacaauucgaagcagugggacgagaauucaacaaccucgaaagacgaauagaaaaccucaacaaaaaaauggaagacggcuuccucgacgucuggaccuacaaugcagagcuccugguacuaauggaaaacgagcgaacccucgacuuccacgacagcaacguaaaaaaccuauacgacaaaguccgccuccaacuccgcgacaaugccaaagaacuugguaacggcugcuucgaauucuaucacaaaugcgacaacgaaugcauggaauccauucgcaacgggaccuauaacuacccccaauacuccgaagaagcccggcucaaacgagaagaaauaagcggcgucaaacucgagagcauaggcaccuaccaaauccucucaaucuacagcaccgucgccuccagccucgcacuagccauaaugauggcaggccucagccuguggaugugcuccaacggcagucuccaaugccgcauaugcauc

SEQ ID NO: 58877 - RNA, 1656 nt, Artificial Sequence
  derived and/or modified sequence opt11 from anti-influenza_Chain
augaacauccaaauacuugccuucaucgccugcguauuaaccggagccaagggcgacaaaaucugccucggacaccacgccguagccaacggcacaaaagucaacacccuaacagagaaagggaucgaagucguaaacgccacagagaccgucgagaccgcagacgucaagaaaauaugcacucaaggcaaacgcgccaccgaccucgggcgaugcggacuccuaggcacccuaaucggaccaccccagugcgaccaauucuuagaguucuccucagaccuaauaauagaacgccgagaaggcaccgacguuugcuaccccggacgcuucaccaacgaagaaucccuacgccaaauccuccgccgcuccggaggaaucggcaaagaaagcaugggcuucaccuacuccggcauccgcaccaacggagcagccagcgcaugcacccgauccggcuccuccuucuacgcagaaaugaaauggcuacucuccaacucagauaacuccgcauucccccagaugacaaaagccuaccgcaacccccgcaacaaacccgcccucaucauaugggguguacaccacuccgaaucagccuccgaacaaaccaagcucuacggguccgguaacaaacuaauaacuguccgcagcuccaaguaccaacaauccuucacccccuccccaggcacccgccgaaucgacuuccacuggcuauuacucgaccccaacgacaccguaacauucaccuucaacggcgccuucauugccccagaccgagcaucuuucuuccgaggcgaaucauuaggaguccagucugacgccccacucgacucaagcugccgcggcgacugcuuccacagcggcggcaccaucgucuccucgcuaccguuccaaaacaucaacucccgcaccguaggacgcugcccacgcuacgucaaacaaaaaucacuccuacucgccacuggaaugcgaaacguacccgaaaaaccaaaaccacgaggacuguucggcgccaucgcaggcuucaucgaaaacggaugggaaggccuaaucaacggaugguacgguuuccgccaccaaaacgcucaaggggaaggcaccgcagcagacuauaaauccacccaauccgccaucgaccaaaucaccgggaaacuuaaccgacucaucggcaaaaccaaccaacaauucgaacuaauagacaacgaauuuaaugagaucgaacaacaaaucgggaacgucauaaacuggacucgcgacgccaugacagaaaucugguccuacaacgcagaacuucucgucgccauggagaaccaacacaccaucgaccucgccgacuccgaaauguccaaacuauacgaacgagucaaaaagcaacuacgcgaaaacgcagaggaagacggcacuggcugcuucgaaaucuuccacaaaugcgaugaccaaugcauggaaucaauccggaacaacaccuacgaccacacccaauaccgaacugagucccuccaaaaccggauccaaaucgauccaguuaaacucuccuccggauacaaggacauuauacuaugguucuccuucggcgccucaugcuuuauccuacucgcaaucgcaaugggccuaguguucauaugcaucaaaaacggaaacaugcaaugcaccaucugcauc

SEQ ID NO: 58878 - RNA, 1656 nt, Artificial Sequence
  derived and/or modified sequence opt11 from anti-influenza_Chain
augaacacccagauccuagccuucaucgccugcguccucaccggcguaaaaggcgacaaaaucugccucggccaccacgcagucgcgaacggaacgaaagucaacacacuaaccgaaaaaggaaucgaagucgucaacgcuaccgaaacagucgaaaccgccgacguuaagaaaaucugcacucaaggcaaacgagcaaccgaccugggcagaugcggccuccuaggcacacucaucggccccccccaaugcgaccaauuccucgaguucucuagcgaccuuaucaucgaacgcagagaaggcacagacgucugcuaccccggccgcuucacaaacgaggaaucacuccgccaaauacuccgccgcucgggcggcauuggaaaagaaucuaugggauuuaccuauuccggaauccgcacaaacggcgcaacauccgcaugcacacgcuccggauccucauucuacgccgaaaugaaauggcuacuaucaaacucugacaacagcgccuucccccaaaugacuaaagccuaccgcaacccccgaaacaaaccagcacucaucaucuggggaguccaccacuccgaaucggucuccgaacaaaccaaacucuacggcuccggcaacaaacuaaucaccguccgaucauccaaauaucaacaaucauucacccccagcccaggcgcaagacgaauagacuuccacuggcuacuucuagaccccaaugacaccgugaccuucacuuucaacggcgccuucaucgcccccgaccgcgcaucauucuuccgcggcgagucacuaggaguacaauccgacgucccacucgacaguuccugccgcggagauugcuuccacuccgggggcaccaucguaucaucccuccccuuccagaauauaaacucucgcaccgucggcaaaugccccagauaugucaaacaaaaaucccuccuccuggcaaccggcaugaggaacgucccagaaaaacccaaaccccgcggccuauucggagccaucgcugguuuuauugaaaacggcugggaaggacucauaaacggcugguacgguuuccgacaccaaaacgcucaaggagagggaacagcagcggacuacaaaucuacccaaucggcgaucgaccaaaucaccggcaaacucaaccgacucaucggcaaaaccaaccaacaauucgaacucaucgacaacgaauucaacgagauagaacaacaaaucggcaacgucaucaacuggacacgcgacgccaugaccgaaaucuggucauacaacgccgaacuccuaguagccauggaaaaccagcacaccauagaccucgccgacucagaaauguccaaacucuacgaacgagucaaaaaacagcuacgcgaaaacgccgaagaagacggcacugguugcuucgaaaucuuucacaaaugcgacgaccaauguauggaauccauacgcaacaacaccuacgaccacacccaauaccgcaccgaaucccuccagaaccgcauucaaaucgaccccguaaaacuauccuccggauacaaagacaucauccuaugguucuccuuuggcgccuccugcuuccuuuuauuagccauagccaugggccucguauucauaugcaucaaaaacggaaacaugcaaugcacgaucugcauc

SEQ ID NO: 58879 - RNA, 1656 nt, Artificial Sequence
  derived and/or modified sequence opt11 from anti-influenza_Chain
augaacauccaaauccucgccuucauagccugcguccucacuggcgccaagggcgacaaaaucugccucggccaccacgccgucgccaacggaacuaaagucaacacccucaccgaaaaaggcaucgaggucguaaacgcaaccgaaacagucgaaacagccaacaucaagaaaaucugcacccaaggcaaacgcccgacagaccuaggccaaugcggacuccuaggaacucuuaucggacccccacaaugcgaccaauuccuugaguucuccuccgaccuaauuaucgaacgcagggaaggcaccgacguuugcuacccaggcaaauucaccaacgaagaaucccuccgccaaauacuacgccgcuccggcggcaucggcaaagaaucaaugggauucaccuacuccggcauucgaaccaacggcgccaccucggcaugcacacgcagcggaagcucauucuacgccgaaaugaaauggcuccuaucaaacucggacaacgcugccuucccacaaaugaccaaaagcuaccgcaacccccgcaacaaacccgcgcucauaaucuggggcguacaccacucagagagcguaucagaacaaaccaaacucuacgguagcggaaacaaacuaauaaaaguacgcuccuccaaauaccaacaauccuuuacccccaacccaggcgcccgccgcauagacuuccacuggcuccuccucgaucccaacgacacagucacauucacauucaacggcgccuucaucgcaccagaccgcgccagcuucuuccgaggcgagagcauaggcguccaaagcgacgcuccccuagacagcuccugcgggggaaacugcuuccacaauggcgggacaauagucuccucacucccguuccaaaacaucaauccccgcaccgucggcaaaugcccccgcuacguuaaacagaaaagccuccuacucgccacaggcaugcgcaauguacccgaaaaacccaagaaacgcggccuauucggcgccauagcaggcuucaucgaaaacggaugggaaggccucaucaacgggugguacggauucagacaccaaaacgcacaaggcgaaggaaccgccgccgacuacaaauccacccaaucagcaauagaccaaaucacugggaaacucaacagacucauaggcaaaaccaaccaacaauucgagcuaaucaacaacgaguucaacgaagucgaacaacaaauaggaaacgucauaaacuggacccaagacgccaugaccgaagucugguccuacaacgcagaacuccucgucgcaauggaaaaccaacacaccaucgaccucaccgacuccgaaaugucaaaacucuaugaacgcguccgaaaacaacuccgagaaaacgcagaagaagacggcaccggcugcuucgagaucuuccacaaaugcgacgaucacugcauggaaucaauccgcaacaacacauacgaccacacgcaauauagaacagaaucccuccaaaaccgcauccaaauagacccagucaagcucagcggcggcuacaaagacaucauucucugguucucguucggagccuccugcuuccuccuucuagccauagccauggggcuaguguucaucugcaucaaaaacggaaacaugcaaugcaccauaugcauc

SEQ ID NO: 58880 - RNA, 1656 nt, Artificial Sequence
  derived and/or modified sequence opt11 from anti-influenza_Chain
gaccaaaucuguaucggcuaccacgccaacaacaguacugaacaagucgacaccaucauggagaaaaacguaaccgucacgcacgcccaaaauauacucgaaaagacccacaacggcaaacugugcgaccucgacggaguaaaaccccucauccuccgcgacugcuccgucgccgguuggcuacucggcaaccccaugugcgacgaguuccucaacgucccagaaugguccuacaucgucgaaaagaucaacccugcaaacgaccucugcuacccaggcaacuucaacgacuaugaagaacucaaacaccuacucuccagaauuaaccacuucgagaaaauacaaauaauaccaaagucaucuugguccgaccacgaagccucgucgggcguauccagcgcaugccccuaccaaggacgcucaucauucuuccgaaacgucgucuggcuaauaaagaaagacaacgcauaccccaccauaaaacgauccuacaacaacaccaaccaagaagaccuccuaguccucuggggcauacaccaccccaacgacgccgccgaacaaacacgacuguaccaaaauccaaccacauacauauccgucggcacguccacacucaaccaaagacucgucccaaaaauagccacccgaagcaaagucaacggacagagcggacgcauggaauuuuucuggacaauacucaaaccgaacgacgcuaucaacuucgaaucaaacggcaacuucauagcccccgaaaaugcauacaaaaucgucaaaaagggcgacuccacaauaaugaaaucagaacuagaauacggcaacugcaacaccaaaugccaaacccccaucggcgcaaucaacucauccaugccauuccacaacauacacccccucaccaucggcgagugccccaaauacguaaaguccaacaaacucguacuagccaccggacuccgcaacuccccacaaggagaacgacgccgcaagaaacgaggccucuucggcgccauugccggcuucauagaaggcggcuggcagggaaugguggacggaugguaugguuaccaccacagcaacgaacagggcuccggcuacgccgccgacaaagaaaguacccaaaaagccaucgacggcgucaccaauaaagucaacuccaucaucgacaagaugaacacacaauucgaagccguaggucgggaguucaacaaccucgaacgucgaaucgaaaaccucaacaagaaaauggaagacggauuccuagacguguggacauacaacgccgaacuccucguacugauggaaaacgagcgcacacuagacuuccacgacucaaacgucaaaaaccuguacgacaaaaucagacugcaacuccgagacaaugcuaaagaacuaggcaacggaugcuucgaguucuaccaccgcugcgacaacgaaugcauggaauccguccgaaacggaaccuaugacuacccacaauacagcgaagaagcccggcuaaaacgcgaagaaaucuccggcgucaaacucgaaagcauaggcaccuaccaaauccuauccaucuacuccacagucgccuccagccuaacacuagccauaauggucgcuggacuaucccuauggaugugcagcaacggcucccuccaaugccgcaucugcauc

SEQ ID NO: 58881 - RNA, 1656 nt, Artificial Sequence
  derived and/or modified sequence opt11 from anti-influenza_Chain
gaccaaaucugcaucggauaccacgccaacaacuccaccgaacaaguagacaccauaauggagaagaacguaaccgugacgcaugcacaagacauacuggaaaaaacccacaacggcaaacuaugcgaccuagacggcguaaaaccccucauccucagagacugcuccguagccggauggcuccucgguaaccccaugugcgacgaauucaucaacgucccagaaugguccuacauagucgaaaaagccaacccaaccaacgaccucugcuacccuggcuccuucaacgacuacgaagaacucaaacaccuccucucccgcaucaaccacuucgaaaaaauccagaucauacccaaaucauccuggucagaccacgaggcgucauccggcguaucauccgcaugcccauaccucggaucacccucauucuuccggaacgucguguggcuaauaaaaaaaaacuccaccuacccaaccauuaagaagagcuacaacaacacgaaccaggaagaccuccucguacuauggggcauacaucaccccaacgacgcagcagaacaaacccgucuauaccaaaacccaaccacauacaucuccaucgguacaagcacgcuaaaccagcgccucguacccaagauagccacccgguccaaagucaacggacaauccggccgcauggaauucuucuggaccauccucaaccccaacgacgccauaaacuucgaaucaaacggcaacuucaucgccccugaauacgccuacaaaauagucaagaaaggcgacuccgccaucaugaaaagcgaacucgaauacggcaacugcaacaccaaaugccaaacacccaugggcgcaaucaacuccuccaugccguuccacaacauacacccacuaaccaucggagaaugcccaaaauacguaaaaucgaaccgucucguccucgcaaccgggcuacgaaacuccccccaaagagaauccagacgaaaaaaacgcggccucuucggcgcaaucgccgguuucauagaaggaggcuggcaaggcauggucgacggcugguacggcuaccaccacucaaacgagcaaggcuccggauacgcagccgacaaagaauccacccagaaagcaaucgacggcgucaccaacaaagucaacagcauaaucgacaaaaugaacacacaauucgaggcuguaggccgcgaauucaacaaccucgaacgccgcauagaaaaucucaacaaaaaaauggaagacggcuuccuagacguauggacuuacaacgcagaacuacuaguccucauggaaaacgaacgcacccuggacuuccacgacagcaacgugaaaaaccucuacgacaaaguccgacuacaacuccgagacaacgccaaagaacucggcaacggcugcuucgaauucuaccacaaaugcgacaacgaaugcauggaaucgaucagaaacggcacauacaacuacccccaauacuccgaggaagcccgccuaaaacgcgaagaaaucuccggugucaaacucgaaucaaucggcacauaccaaauccuaagcaucuacuccacugucgccagcucacuagcgcuggcaaucaugauggcaggccuaucccuauggaugugcucgaacggaagccuccaaugccgaauaugcauc

SEQ ID NO: 58882 - RNA, 1680 nt, Artificial Sequence
  derived and/or modified sequence opt11 from anti-influenza_Chain
augagcaacauggacauagacucaaucaacaccggaacaaucgacaaaaccccggaagaacucacgccaggcacgagcggcgcaacccgcccgauaaucaaaccagcaacccuagccccacccuccaacaaacggacgagaaaccccucccccgaacgcacaacaaccuccuccgaaaccgacauaggccgcaaaauccagaagaaacaaacaccaaccgaaauaaagaaauccgucuacaaaauggucguaaaacugggcgaguucuacaaccaaaugauggucaaagcaggccuuaacgacgacauggaacgcaaccuaauacaaaacgcgcaagcaguagaacgaauccuacucgccgcaaccgacgacaagaaaaccgaauaccaaaagaaacgcaacgcccgagaugucaaagagggcaaagaagagauagaccacaacaaaaccgguggcaccuucuacaaaaugguacgagacgacaaaaccaucuacuuuagcccaauaaaaauaaccuuccuaaaagaagaaguaaaaacaauguacaaaacaacgaugggcagcgacggcuucuccggacucaaccacaucaugaucggacacucccaaaugaacgacguaugcuuccaacgcagcaaaggacuaaaacgcguuggccucgacccaucccucauuucaaccuucgccggcuccacccucccccgacgaagcggcaccacaggcguagcaauaaaaggaggcggcacgcuggucgacgaagccauccgcuucaucgggcgcgccauggccgaccgcggacuccuccgcgacaucaaagcaaaaacagccuacgagaaaauacuccuaaaccugaaaaacaaaugcuccgcaccccaacaaaaagcccuagucgaccaagucaucggcagccgaaaccccggcauagcagacaucgaagaccucacccuccucgcccgcuccaugguaguaguccgcccaucagucgcaagcaaaguaguccuaccaauaagcauauacgccaaaaucccccaacugggguucaacaccgaagaauacuccauggucggcuacgaagccauggcacucuauaacauggcgacacccgucuccauccugcgaaugggagacgacgcgaaagacaaaucucaacucuucuucaugucaugcuucggcgcagcauacgaagaccugagaguccugagcgcccucaccggaacugaguucaaacccagaucagcacucaaaugcaaaggcuuccacgugccagccaaagaacaggucgaaggcaugggggccgcccucaugagcauuaaacuccaauucugggcccccaugaccagaagcggaggcaacgaaguauccggcgagggcggcuccggacaaauauccugcagccccgucuucgcaguagaacgccccaucgcccucuccaagcaagcagucaggcgcaugcuuagcaugaacguagaaggccgggacgccgacgucaaaggcaaccuacuaaaaaugaugaacgacuccauggccaagaaaacauccggcaacgcauucauaggcaagaaaauguuccaaaucucagacaaaaauaaaguaaacccaauagaaauaccaaucaaacaaacaauccccaacuuuuucuucggccgggacaccgccgaggacuacgacgaccuagauuac

SEQ ID NO: 58883 - RNA, 1680 nt, Artificial Sequence
  derived and/or modified sequence opt11 from anti-influenza_Chain
augaacacgcaaauccuggcacugaucgcauauauguuaaucggcgccaaaggcgacaaaauaugccuuggacaccacgccgucgccaacggcacaaaagucaacacacuaacagagcgcggaaucgaaguagucaacgccaccgaaacagucgaaacagucaacaucaagaaaauaugcacccaaggaaaaagacccaccgaucucggccaaugcggacuacuaggaacacucaucggcccgccccaaugcgaccaguuccucgaguucgacgccgaccucauaaucgaacgcagggaagggacagacgucugcuaccccggaaaauucacuaacgaagaaucacuacgacaaauacuccgcggcucagggggaauagacaaagaauccaugggauucaccuacagcggcauccgcaccaacggcgucaccagcgccugccgacggagcggcuccucuuucuacgccgaaaugaaauggcuccucuccaacuccgacaacgccgccuucccccaaaugacaaaaagcuaccguaaccccaggaacaaaccggcacucauaaucuggggcguccaccauuccggcucugccacagagcaaaccaaacucuacggaagcggcaacaaacucaucaccguaggauccagcaaauaccaacaguccuucacaccaucccccggugcacgaccccaaguaaauggccagagcggacgcaucgacuuccacuggcuccuccuagaccccaacgacaccgucacauucacauucaacggugccuucaucgcccccgaccgcgccucauucuuccgaggagaaucacucgggguccaauccgacgucccgcucgacagcggcugcgaaggcgacugcuuccacucccgaggcacaauagucagcagccucccauuccaaaacaucaacccacgcaccgugggcaaaugcccacgcuacguaaaacaaacaagccugcuacuagccaccggcaugcgcaacguacccgaaaaucccaaaaccagaggccucuucggggccauagccggcuucauagaaaacggcugggagggucucauugacggcugguacggcuuccgccaccaaaacgcccaaggagaaggcacggcagcagacuacaaguccacacaaagcgcaaucgaucaaauaacaggaaaacugaaccggcucauagacaaaacaaaccaacaauucgaacuuauugacaacgaguucuccgaaaucgaacagcaaauaggcaacgucaucaacuggacacgugacagcaugaccgaagucuggucauacaacgccgaacuccucgucgccauggaaaaccagcacaccaucgaccuagccgacuccgaaaugaacaaacuauacgaacgcguccgcaaacaacugcgcgaaaacgccgaagaagacggcaccggaugcuucgaaauauuucacaaaugugacgaccaaugcauggaauccauccgcaacaacaccuacgaccacacacaauacagaacagagucccuucaaaaccgaauccaaaucgaccccgugaaacucagcuccggguacaaagacauaauccuaugguucuccuucggcgcaucaugcuuccuccuacuagccauagccaugggccuagucuucaucugcaucaaaaacggaaacaugcggugcacaaucugcauc

SEQ ID NO: 58884 - RNA, 1680 nt, Artificial Sequence
  derived and/or modified sequence opt11 from anti-influenza_Chain
augaacacacaaauacuagcccuaaucgcaugcaugcucaucggcgccaagggagacaaaaucugccuaggccaccacgcagucgccaacggcacgaaaguaaacacacugaccgaacgaggaaucgaagucgucaaugcuaccgaaacagucgaaacagccaacaucaagaagauuugcacacagggcaaacgacccacggaccugggccaaugcgggcuccucggcacccucaucggcccaccgcagugcgaccaauuccuagaguucgacgcagaccuaaucauagaacgccgcgaaggcaccgacgucugcuacccuggaaaguucaccaacgaagaaucgcuacgccaaauacuucgcggaucaggcgggauagacaaagaauccaugggauucacauacagcggcauacgcaccaacggcgccaccuccgccugccgacgcagcggaagcucauucuacgccgaaaugaaauggcuucucagcaacagcgacaacgccgcauucccacaaaugaccaagagcuaccggaacccccgcaacaagcccgcacuaaucauauggggcguccaccacagcggaagcgcgacagagcaaaccaaacuauacggcucgggcaacaaacucaucaccgugggcuccucgaaauaccaacaaucauucacacccucccccggcgcacgcccacaaguaaacggccaaagcggccgcaucgauuuccacuggcuacugcuagacccgaacgacacggucacauucacauucaacggcgcauucaucgcaccggaccgcgccucauucuuucgaggaggaucccuaggaguccaaagcgacgugccgcucgacuccggcugcgaaggagacugcuuccacagcggcgggaccaucguaagcagccucccauuccaaaacaucaacccacgcaccgugggcaagugcccccgauacgucaaacaaaccagccuccuccucgccacaggcaugcgcaacgucccagaaaacccgaagacccgaggccuauucggcgccauagcgggguucaucgaaaacggcugggaaggccuaaucgacggcugguacggauucagacaucaaaacgcacagggcgaagggacagcugcagacuacaaauccacccaaagcgccaucgaccagauaaccggaaaacuuaacaggcuaauagacaaaaccaaccaacaguucgagcucauagacaacgaguucaacgaaauagaacaacaaauaggcaacgucaucaacuggacccgagacuccaugaccgaagucuggucauacaacgccgaacuccuagucgccauggaaaaccaacacaccaucgaccuugcagauuccgaaaugaacaaacucuacgagcgaguacgcaaacaacuaagagaaaacgccgaagaagacgggaccggaugcuucgaaaucuuccacaagugcgacgaucaguguauggaaucaauccgaaacaacaccuacgaucacacacaauaccgcacagaaucccuccagaaccgaauccagaucaacccggucaaacuauccucgggauacaaagacaucauccucugguucucguucggagccucaugcuuccuccuccuagcaaucgccaugggccuugucuucauaugcauaaagaacggaaacaugaggugcaccaucugcauc

SEQ ID NO: 58885 - RNA, 1680 nt, Artificial Sequence
  derived and/or modified sequence opt11 from anti-influenza_Chain
auggaacgcaucguacuccuccucgcaauaguaucccuugucaaauccgaccagaucugcaucggcuaccacgccaacaacagcacagagcaagucgauacaaucauggagaaaaacgucaccgucacccacgcacaagacauacuagagaaaacccacaacggaaaacucugcgaccuagacgggguaaaaccacuaauccuacgcgacugcucaguagccggcuggcuccucggaaacccaaugugcgacgaauuucucaacguccccgaaugguccuacaucgucgagaaaaucaacccggcgaacgaccuaugcuacccaggcaacuucaacgacuacgaagaacuaaaacaccuccuaucacggauaaaccacuucgaacguauccaaauaauccccaaaucaucguggucagaccacgaagccuccuccggcguaagcuccgccugcccauaccagggccgaucauccuucuuccgcaacguuguauggcucaucaagaaaaacaacgcauacccaaccaucaaacgaucuuacaacaacaccaaccaggaagaccuccuaguacucuggggcauccaccaucccaacgacgcagcagaacaaacccgccuuuaccaaaacccaaccacauacauaucagugggaaccagcacccucaaccaacgccucguccccaaaauagcaacccguagcaaagucaacggccaaagcgggcgcauggaguucuucuggaccauacuaaaacccaacgacgccaucaacuucgagagcaacggcaacuucaucgccccagaaaacgccuacaaaaacugccaaaaaggcgacagcaccauaaugaaaagcgaacucgaauauggcaacugcaacacaaaaugccaaacccccaucggcgcaaucaauucauccaugcccuuccacaacauacacccacucacaauaggcgaaugcccaaaauacguaaaauccaaccggcucguacuggcaacaggacuacgaaacucaccccaaggcgaacgccgaagaaagaaacgcggacuauucggcgcaaucgccgguuucaucgagggcggcuggcaaggaauggucgacggcugguacggcuaccaccacucaaacgaacaaggauccgguuacgccgccgauaaagaguccacccaaaaagcaauagacggcguaacaaacaaagucaacucaaucaucgacaaaaugaacacccaauucgaggccgucggacgcgaguucaacaaccuagaacgacgaaucgaaaaccuaaacaagaaaauggaagacggcuuccucgauguguggacauauaacgcagaacuccuaguacucauggaaaacgaacgcacccuagacuuucacgacagcaacgucaaaaaccuauacgauaaaguacgccuccaacuacgagacaacgcaaaagaacuaggaaacggaugcuucgaauuuuaccaccgaugcgacaacgaauguauggaauccguacgcaauggcaccuacgacuacccacaauacucggaagaagcccgacugaaacgcgaagaaauauccgggguaaaauuagaaucuauaggcaccuaccaaauacuauccaucuacucuacuguagcaucaucccucgcccuagcgaucauggucgccggccugucacucuggaugugcucaaacgga

SEQ ID NO: 58886 - RNA, 1680 nt, Artificial Sequence
  derived and/or modified sequence opt11 from anti-influenza_Chain
augagcaacauggacaucgacagcauaaacacaggcaccaucgacaaaacacccgaagaacuaaccccaggaacaagcggcgcaaccagaccaauaauaaaacccgccacacucgcaccgcccagcaacaaacgcaccagaaacccgagcccagaaagaaccacaaccuccagcgaaacagacauagggcgaaaaauacagaagaaacaaaccccaaccgagauaaagaaaagugucuacaaaaugguagucaaacucggcgaguucuauaaccaaaugaugguaaaagcuggccuaaacgacgacauggaacgaaaccucauccaaaaugcacaagcagucgaacgcauacuacucgccgccaccgacgacaagaaaaccgaauaucaaaagaaaagaaacgcccgcgauguaaaagaagguaaagaagaaauugaccacaacaaaaccgggggcacauucuacaaaaugguccgagacgauaaaacgaucuauuucucgcccaucaaaaucacauuccucaaagaagaggucaaaacaauguacaaaaccacaaugggcuccgacggcuucuccggacuaaaucacauaaugauaggccacucccaaaugaacgacguauguuuccagcgaagcaaaggccuaaaaagaguagggcuagaccccagccuaauaagcaccuucgccggaagcacccugccccgacgcuccggaacaaccggggucgccaucaaaggcggaggaacccucgucgacgaagcaauccgcuucaucggaagggcaauggcagaccgcggacuccucagggacaucaaagcgaaaacagccuacgagaaaauacuacugaaccucaaaaacaaaugcagcgccccgcaacagaaagcccucgucgaccaagucauuggcucgagaaacccaggaaucgccgacaucgaagaucucacacuccuggccagaagcaugguagucgucagacccucagucgcgagcaaagucguacuccccaucagcaucuacgcaaagauaccacagcugggauucaacacagaagaauacucaaugguaggcuacgaggcgauggcccucuacaacauggccacuccgguaagcauccuacgaaugggcgacgacgccaaagacaaaucccaacuuuucuucaugaguugcuucggcgcagcauacgaggaccugcgaguacuauccgcccuuaccggcaccgaguucaagccgaggagcgcacucaaaugcaaaggauuccacguaccagcaaaagaacaagucgaaggaaugggugccgcauuaauguccauaaaacuacaauucugggcaccaaugacccgaagcggcggaaacgaaguauccggagaagggggauccggacaaauauccugcagccccgucuucgccgucgagaggcccaucgcacucagcaaacaagccguccgccgcaugcuuagcaugaacgucgaaggacgcgacgccgacguaaagggaaaccuccucaaaaugaugaacgacucuauggccaagaaaacuagcggcaacgccuucaucggaaagaaaauguuccaaaucagcgacaaaaacaaagugaaccccauagaaauucccaucaaacaaacgaucccaaacuucuucuucggacgagacacagcagaagacuacgacgaccucgacuac

SEQ ID NO: 58887 - RNA, 1680 nt, Artificial Sequence
  derived and/or modified sequence opt11 from anti-influenza_Chain
augaauacacaaauucucgcccuaaucgccuacaugcucaucggagcuaaaggcgacaaaauaugccucggccaccaugccguagccaacgggaccaagguaaacacccucaccgaacgagggaucgaagugguaaacgcaaccgaaaccguagagacagucaacauaaagaaaaucugcacccaaggcaaacgccccacagaccuaggccaaugcggccuccucggcacccuaauaggcccaccacaaugcgaccaauuccuagaguucgacgccgaccuaaucauagaacgacgagaaggaaccgacgucugcuaccccggcaaauucaccaacgaagaaagccuacgacaaauacuccgaggaucaggcggcaucgacaaagaauccaugggauucacauacucaggaauccgcacaaacggcgugaccucagcgugucgcagauccgggagcucauucuacgccgaaaugaaauggcuacuaagcaacagcgacaacgcagccuucccacaaaugaccaaaagcuaccgcaacccacgaaacaagcccgcccuaaucauauggggcguacaccacuccggcagcgccacagaacaaaccaaacucuacggcagcggaaacaagcuaaucaccgucggaucaucaaaauaccaacaaucauucaccccaucuccaggcgcccgcccccaagucaacggacaauccggccgaaucgacuuucacuggcuccuacucgaccccaacgacaccguaaccuucaccuucaacggcgccuucauagcaccagaccgcgcaucauucuuccgcggcgagucacucggcguacaauccgacgucccccuagacuccggaugcgaaggagacugcuuccacucaagagggacaauaguaagcagccuccccuuccaaaacaucaacccccgaaccgucggcaaaugcccaagauacguaaaacaaaccucccugcuccucgccaccggaaugcgcaacguaccagaaaacccaaaaacaagaggccuauucggcgccauagcagguuucauagagaacggcugggaaggccuaaucgacggaugguacggcuuccgccaccagaacgcacaaggagaaggcaccgccgccgacuauaaaucgacucaguccgccauagaccaaaucaccggaaaacuaaaccgacuaaucgacaaaaccaaccaacaguucgagcucauagacaacgaguucagcgaaaucgaacagcagaucgggaacgucaucaacuggacccgugacagcaugaccgaagucuggucauacaacgccgaacuccuaguagcaauggagaaucaacacaccaucgaccucgcagacuccgagaugaacaaacuuuacgaacguguccgcaaacaacucagagaaaacgccgaagaagacggcacaggaugcuucgaaaucuuccacaaaugcgacgaccaaugcauggaaucuauacgcaacaauacauacgaccacacccaauaccgcacggaaucccuccaaaauagaauacaaaucgaccccgucaaacuaagcuccggcuacaaggacaucauccucugguucuccuucggagccagcugcuucuuacuucucgccaucgccaugggacucgucuucaucugcaucaaaaacggcaauaugagaugcacgaucugcaua

SEQ ID NO: 58888 - RNA, 1680 nt, Artificial Sequence
  derived and/or modified sequence opt11 from anti-influenza_Chain
augaacacgcaaauacuagcccucaucgcgugcaugcuaauaggugcgaaaggcgacaaaauaugccucggacaccacgcagucgccaacggaaccaaagucaacacccucaccgaacgaggcaucgaagucgucaacgccacugaaacagucgaaaccgcaaacauuaagaaaauaugcacacagggaaaacgcccuacagaccucggacaauguggccuccuagguacccucaucggcccaccccaaugcgaccaguuccucgaguucgacgcagaccucaucauagaacgcagagaaggcaccgacguuugcuaccccggaaaauucacaaacgaggaaucccucagacaaauacuacgaggauccggaggcaucgacaaagaaagcaugggauucaccuacuccggaauccgcaccaacggagccaccucagccugcagacgguccggcucguccuucuacgccgaaaugaaauggcuccucucuaacuccgacaacgcugcauucccacaaaugaccaagagcuaccgaaacccaagaaacaaacccgcccuaaucauauggggcguccaccacuccggcagcgccaccgaacaaaccaaacucuacggcagcggcaacaaacucaucacagucggcagcagcaaguaccaacaaucauucaccccauccccuggcgcacggccgcaagucaauggacaaucgggccgaaucgacuuccacuggcuccuccucgaccccaacgacacagucaccuucacauucaacggcgccuucaucgccccagaccgggccucauucuucagaggagggucccuaggcguucaaagcgacgucccccucgacagcggaugcgaaggcgacugcuuccacucaggagggacaaucguaucaucccuacccuuccaaaauauaaacccccgcacugucggaaaaugcccccgcuauguaaaacaaacaagucuccuccucgccacugguaugagaaacgucccagaaaaccccaaaacgagaggucucuucggcgcuaucgccggauucauagaaaacggcugggaaggacucaucgacggcugguacggcuuccgccaccaaaaugcccaaggcgaagguacagccgcugacuacaaauccacacagagcgcaaucgaucaaauaacaggcaaacucaaccgccucauagacaagaccaaucaacaauucgaacucaucgacaacgaguucaacgaaauagaacaacaaaucggaaacgucauuaacuggacccgcgacuccaugacggaagucugguccuacaacgccgaacuacucgucgccauggaaaaccaacacaccauagaccucgccgacuccgaaaugaacaaacuauacgaacgcguacgcaaacaacuacgagaaaaugcggaagaagacgggaccggcugcuucgaaaucuuccacaaaugcgacgaccaaugcauggaauccauacgcaacaacaccuacgaucauacacaauacaggaccgaaucgcuucaaaaccgaauccaaaucaaccccguaaagcuauccagcggcuacaaagacauaauacuaugguucagcuucggcgccuccugcuuccuacuccucgccaucgcaaugggacucgucuucaucugcaucaaaaacggcaacaugcgaugcaccauaugcauc

SEQ ID NO: 58889 - RNA, 1680 nt, Artificial Sequence
  derived and/or modified sequence opt11 from anti-influenza_Chain
auggaacgaaucguccuacuccucgcaaucgucucccuugucaaaagcgaccaaaucugcauaggcuaccacgccaacaauagcacagaacaaguagacacuaucauggagaaaaaugucacagugacccaugcccaagacauccuagagaaaacgcacaacggaaaacuaugcgaccuggacggagucaaaccccucauccuccgagacugcucugucgccggcuggcuccuaggcaaccccaugugcgacgaguuccucaacguacccgaauggucuuacaucgucgagaaaaucaaccccgccaacgaccuaugcuaccccgguaacuucaacgacuacgaagaacuaaaacaccuacucucucgcaucaaccauuucgaaagaauccagaucaucccaaaauccuccuggagcgaccacgaagccuccagcggagucagcuccgccugcccauaccaaggccgaucuucauucuuccgcaacgucgucuggcugaucaagaaaaacaacgcauaccccacaauaaaacgcuccuacaacaacacaaaccaagaagaccuucucguccucuggggcauccaccacccuaacgacgccgccgaacaaacccgccuauaccaaaacccaacaacauacauaucagucggcaccagcaccuuaaaccaacgccucgucccaaaaauagcaacucgaagcaaaguuaacggccaaucaggucgcauggaguucuucuggacaauccucaaacccaacgacgcaaucaacuucgaauccaacggaaauuucaucgcacccgaaaacgcauacaaaaauugccaaaagggagacucaaccauaaugaaaucagaacucgaauacggcaacugcaacacuaaaugucaaacacccaucggcgcaaucaacuccuccaugccauuccacaacauccacccgcucaccauaggagaaugccccaaauacgucaaaucaaaccgacucguccuagcaaccggacuccgaaacuccccacagggagaacgccgacgcaagaaacgaggucuuuucggagcaauagccggauucaucgaaggcggcuggcaaggcaugguagacggcugguacggcuaccaucacucaaacgaacaaggcuccggcuaugccgccgacaaagaaucaacccaaaaagccauagacggcgucaccaacaaagucaacuccaucauagacaaaaugaacacacaauucgaagccgucggcagagaauuuaacaaccucgaacgacgcaucgaaaaccucaacaagaaaauggaagacggcuuccucgacgucuggacauauaacgccgaacuacucguccucauggaaaacgaacgcacccucgacuuccacgauucaaacgucaaaaaccuauacgacaaaguacgacuccaacuccgcgacaacgccaaagagcucggcaacgggugcuucgaguucuaccaccgaugcgacaacgaaugcauggaauccgugcgcaacggcaccuacgacuacccccaauacagcgaagaagcacgccucaaacgcgaagaaauauccggcguaaaacuagaauccauaggaacauaccaaauacuaucaaucuauuccacaguugccuccucccuagcacucgccauuauggucgccgggcugagccucuggaugugcucuaacgga

SEQ ID NO: 58890 - RNA, 1686 nt, Artificial Sequence
  derived and/or modified sequence opt11 from anti-influenza_Chain
augccccgagcccuccgucgcgucccagguuccagagucaugcuccgcguaggcgucgucgucgcaguacucgcccuaguagcagcccucgcgaauuuagccguaccccgccccgcacgagccgcuggaggcggcuacuggcacaccagcggcagagaaauacuugacgccaacaacgugccaguacgcaucgccggaaucaacugguucggcuucgaaaccugcaacuacguuguucacggacucuggucacgcgacuaccgauccaugcuagaccaaaucaaaucccuaggauacaacaccauccggcucccauacuccgacgacauacuuaaaccgggcaccaugcccaacuccauuaacuucuaccaaaugaaccaagaccuccaaggccucaccucacuacagguaauggacaaaauaguugcauacgcaggccaaauaggacuccgcauaauacuagaccgccaccgccccgacugcuccgggcaguccgcccucugguacacauccucuguaucagaagccacauggaucuccgaccuccaagcccuugcccaacgcuauaaaggaaaccccacagucguaggcuucgaccuccacaacgaaccccacgacccagcaugcuggggaugcggagacccuuccaucgauuggcgccucgcagcagaaagagccggaaacgccguucucucagucaacccaaaccuacucauauucgucgaaggugugcaauccuacaacggagacuccuacugguggggcggcaacuuacaaggcgccggccaauaccccguaguccucaacguacccaaccgccucguauacuccgcccacgacuacgcuaccuccgucuauccacaaaccugguucagcgacccaacauuccccaacaacaugcccggcaucuggaacaaaaacuggggauaccucuucaaccaaaacaucgcaccuguauggcucggagaguucggcacaacccuacaauccaccacagaccaaaccuggcucaaaacacucguccaauaucuccgaccuaccgcccaauacggcgcagacagcuuccaauggacauucuggucauggaacccagacuccggagacaccggcggaaucuuaaaagacgacuggcaaacagucgacaccguuaaagacggcuaucucgcaccgaucaaaucauccauauucgaccccguuggcgcauccgccagccccuccagccaacccucaccauccguaucaccaucucccucuccauccccauccgccucccgcaccccgacccccacacccacaccaacagccagcccaacacccacccucacacccaccgccacccccacaccaaccgccucccccaccccauccccaaccgccgccucaggagcacgcuguaccgccagcuaccaggucaacuccgacuggggcaacggcuucaccguaacaguagccguaaccaacaguggaucugucgccaccaaaacuuggaccgucuccuggacauucggaggcaaccaaacaauaaccaacuccuggaaugccgccgucacccaaaacggccaaucagucacagcucgcaacaugucuuacaacaacgucauccaacccgggcaaaacacgacauucggcuuucaagccuccuacaccggcuccaacgccgccccaacagucgccugcgcagcauca

SEQ ID NO: 58891 - RNA, 1686 nt, Artificial Sequence
  derived and/or modified sequence opt11 from anti-influenza_Chain
auggaacgcgucugguggaaagaagcaguaguguaccaaaucuacccaagguccuucuacgacagcaacggcgacggcauaggcgacaucagaggcauaauagcaaaacucgacuaccuaaaagaacuuggcgucgacgucgucuggcuaagcccagucuacaagagccccaacgacgacaacggguacgacaucuccgauuaccgagacaucauggacgaguucggcaccauggccgauuggaaaacaaugcuugaagaaaugcacaaacgcggaaucaaacucgucauggaccuaguaguaaaccacacaagcgacgagcacccaugguucaucgaaagccgcaaaagcaaggacaacccguacagagacuacuacauauggcgccccggcaaaaacgggaaagaaccaaacaacugggaaaguguauucuccggaagcgcaugggaauacgacgaaaugacaggcgaguacuaccuacaccuguucagcaagaaacaaccagaccucaacugggaaaaccccaaaguccgccgcgaagucuaugaaaugaugaaauucuggcuagacaaaggcgucgacggauuccggauggaugugaucaacaugaucagcaaggugccugaacucccagacggcgaaccccaaagcgggaaaaaguaugccagcggaagccgcuacuacaugaacggcccaagaguccacgaguuccuccaagaaaugaaccgagaaguccucagcaaauacgacaucaugaccguuggcgaaacccccggcgucacgcccaaagaaggcauccuauacaccgaccccagccgccgugaacucaacauggucuuccaauucgaacauauggaccucgacuccggccccggcggcaaaugggacauaagaccauggagccuggcagaccucaagaaaaccaugaccaaauggcaaaaagaacucgaagggaaaggcuggaacucccuauaccuaaacaaccacgaccaaccaagagcagucucccgguucggcgaugacggcaaauaccgcgucgaaagcgcgaaaaugcucgccaccuuccuacacaugaugcaaggcaccccauacaucuaccaaggggaagagaucggcaugaccaacgugcgcuucccaagcaucgaagacuaccgggacauagaaacacuaaacauguacaaagaaagagucgaagaauacggcgaagacccacaagagguaauggagaaaauauacuacaaaggacgcgacaacgcaagaaccccaaugcaaugggacgacagcgaaaacgccggauucacagccggaacccccuggauccccgucaaccccaacuacaaagaaauaaacguaaaagccgcacucgaagaccccaacagcgucuuccacuacuacaagaaacugauccaacuccgaaaacaacacgacauuauaguauacggcaccuacgaccucauccuagaggacgaccccuauaucuaccgcuacacacgaacacuaggcaacgaacaacuaaucguaaucaccaacuucuccgagaaaacaccggucuuccgccuccccgaccacauaaucuacaaaaccaaagaacuccuaaucuccaacuacgacgucgacgaggccgaagaacugaaagaaauccgccuaagacccugggaagcccgcguauacaaaauacgacuaccc

SEQ ID NO: 58892 - RNA, 1686 nt, Artificial Sequence
  derived and/or modified sequence opt11 from anti-influenza_Chain
augccccgugcccuccgacgaguccccggcucacgaguaaugcuccgcgucggagucgucgucgcuguccuugcccucgucgccgcacuagccaaccuagcagucccgcgaccagcccgcgcagccggcggaggauacuggcacacaagcggacgagaaauucuagacgcaaacaacguacccgucagaaucgcuggcauaaacugguucggcuucgaaacauguaacuacgucguacacggccuauggucaagagacuaccgcagcaugcuagaccaaaucaaaagccucggcuacaacacaauccgucuccccuacucugaugacauucuaaaacccgggacaaugcccaacuccauaaacuucuaccaaaugaaccaagacuuacaaggacucacaucccuccaagucauggacaaaaucguagcauacgccggacaaaucggccuccgaaucauacucgaccggcaucgacccgacugcucaggccaaucagcuuuaugguacaccucgucagucucagaagccaccuggaucuccgaccuccaagcccucgcacaacgcuacaaaggaaaucccacagucgucggcuucgaccuucacaacgaaccacaugacccugccugcuggggcugcggcgacccauccauagacuggcgacuugccgccgaacgagcaggcaacgccguccuauccgucaaccccaaccuccucauauucguagaaggaguacaauccuacaacggcgacuccuacugguggggcggcaaccuccaaggagcaggccaauaccccgucguccucaacguccccaaccgacuugucuacucagcccacgacuacgcaaccucaguauacccccagacaugguucuccgauccaaccuuccccaacaacaugccaggcauauggaacaaaaacugggguuaccucuucaaccaaaacaucgcuccuguauggcucggagaauuuggcacaacacuacaaucaacaaccgaccaaacauggcuaaaaacccuaguccaauacuuacgucccacagcccaauacggagccgacuccuuccaauggaccuucuggagcuggaaccccgacuccggagauacaggcggcauccucaaagacgacuggcaaacaguugacaccgugaaagacggcuaccucgccccuaucaaguccucaauauucgaccccgucggcgcaagcgccucacccuccucccaaccaucacccuccgucucaccauccccuucacccucaccaagcgccucacgaacccccaccccuacccccaccccuacagccucaccgacccccacccuaacucccaccgcaacccccaccccaacggccucaccaaccccaagcccuaccgccgccuccggcgcacgcugcaccgcuuccuaccaaguaaacucagacuggggaaacggauuuaccguaaccgucgccgucacaaacucaggcuccgucgcaacaaaaacauggaccguaucuuggacauucggcgguaaucaaaccaucaccaacagcuggaaugccgcagucacccagaacggccagagcgucacugcccgaaacauguccuacaacaacgucauacaacccggccagaacaccaccuucggauuccaagcauccuacacgggcagcaacgccgccccuaccguagccugcgcagcaagc

SEQ ID NO: 58893 - RNA, 1686 nt, Artificial Sequence
  derived and/or modified sequence opt11 from anti-influenza_Chain
auggaacgcgucugguggaaggaggccgucguauaccaaaucuacccacgaucauucuacgacagcaacggcgacggaaucggcgacauccgaggcaucauagccaaacucgacuaccucaaggagcucggcguagacguaguuuggcucagccccgucuauaaaagccccaacgacgacaacggcuacgacauauccgacuaccgagacaucauggacgaguucggcacaauggccgacuggaaaacgaugcucgaagaaaugcacaaaagaggcaucaaacucgucauggaccuagucgucaaccacaccagugacgaacaccccugguucauagaaucccgaaaaucaaaggacaaccccuaccgagacuacuacaucuggcggccaggcaaaaacggcaaagaacccaacaacugggaaucagucuucuccggcucagccugggaguacgacgaaaugaccggcgaauacuaccuacaccucuucagcaagaaacagccagaccucaacugggaaaacccgaaaguccgccgagaaguauacgaaaugaugaaauucuggcuagacaagggcguagacggcuuccgcauggacgucauaaacaugaucagcaaagucccugaacuccccgacggagaaccccaguccggcaagaaauacgccuccgggucgcguuacuauaugaacggaccccgcguccacgaguuccuucaagaaaugaaccgagaaguccuaucaaaauacgacaucaugaccgucggggaaaccccgggaguaacccccaaagaaggcauacuauacaccgacccaagccgccgcgaacucaacaugguauuccaauucgaacacauggaccuggacuccggaccaggcggaaaaugggacauccgccccuggucacuggccgaccucaagaaaacaaugaccaaauggcagaaagaacuagaaggcaagggcuggaacucccucuaucucaacaaccaugaccaacccagggccgucuccagauucggagacgacggcaaguaccgcgucgaauccgccaaaaugcucgccacauuccuacacaugaugcaagggacaccauacauauaccaaggcgaagaaauaggcaugaccaacguccgauucccguccaucgaagacuaccgagacaucgaaacacucaacauguacaaagaacgcguagaagaauacggcgaagacccacaggaagucauggaaaagauauacuacaaaggcagagacaacgcacgcacccccaugcaaugggacgacuccgagaacgcgggcuucacagccggaaccccuuggauccccgucaaccccaacuacaaagaaaucaacguaaaagcagcccucgaggacccaaacagcguauuccacuacuacaagaaacucauacaacuccgcaaacaacacgacaucauagucuacggaacauacgaccucauccuagaagacgaccccuacaucuauagauacacaagaacccuaggcaacgaacaacuaauagucauaaccaacuucuccgagaaaacgcccguguuccgacuaccagaccacaucauauacaaaacaaaagaacuccucauaagcaacuacgacgucgacgaagccgaagaacucaaggagauacgacuacgaccaugggaagcacgcguauacaaaauccgccucccc

SEQ ID NO: 58894 - RNA, 1689 nt, Artificial Sequence
  derived and/or modified sequence opt11 from anti-influenza_Chain
auggagaaaauaguccuacuuuucgcgauugucucccuagucaaauccgaccaaauaugcaucggcuaccacgcgaacaacucgacagaacaagucgacacaauaauggaaaagaacguaaccguaacccacgcucaagacauacucgagaaaaagcacaacggaaaacuaugcgaccuagauggcgucaaaccccuaauccuccgcgacugcucagucgcaggcuggcuucucggcaaccccaugugcgacgaguucaucaacguccccgaauggucguacaucgucgaaaaagccaaccccgucaacgaccugugcuacccaggagacuucaacgauuacgaagaacucaagcaccuacuaucacggaucaaccacuucgagaaaauccaaaucauacccaaaagcuccuggagcagccacgaagcgucacucggcgucucaucggccugcccguaccaaggcaaaaccucauucuuccgcaacgucgucuggcuaaucaagaaaaacucuaccuaccccacaaucaaacgguccuacaacaacaccaaccaagaagaccugcuaguacucuggggcauccaccacccaaacgacgccgccgaacaaacgaaacuguaccaaaacccaaccacuuacauuagcgucggcacauccacccucaaccaacgacucgugccccguaucgccacccgauccaaagucaauggacaauccggccgcauggaguucuucuggaccauccuaaaaccaaacgacgccauaaacuucgaauccaacggaaacuucaucgcaccagaauacgccuacaaaauagucaagaaaggcgacuccacaauaaugaaaucggaacucgaauacggcaacugcaacacaaaaugccaaacccccaugggagcaaucaacucauccaugccauuccacaacauccacccccuaaccaucggagaaugccccaaauacgucaaauccaaccgccucguccucgccaccgggcuccgcaacagcccccaacgcgaaacucgcggacucuucggcgccauagcgggcuuuaucgaaggaggcuggcagggcaugguagacgguugguacggcuaccaccacuccaacgaacagggcucaggcuacgccgcggacaaagaauccacacaaaaagccaucgauggcgugaccaacaaagugaacuccaucaucgacaaaaugaacacacaauucgaagccguaggcagagaguucaacaaccucgaaagacgaaucgaaaaccuaaacaagaaaauggaagacggcuuccuggacgucuggacauacaacgccgaacuccucguacucauggaaaacgaaagaacccuagacuuccacgacagcaacgucaaaaaccuauacgacaaaguacgccuacaacuccgagacaacgccaaagaacuggggaacggcugcuucgaauuuuaccacaaaugcgacaaugaaugcauggaaagcgucagaaacgguacauacgacuacccacaauacagcgaagaagcacgccucaaaagggaagaaaucuccggcgugaaacucgaauccaucggaauauaccagauacucuccaucuacucgaccgucgcauccagucuagcacuagccauaauggucgccggccuaagccucuggaugugcuccaacggaagccuccaaugccgcaucugc

SEQ ID NO: 58895 - RNA, 1689 nt, Artificial Sequence
  derived and/or modified sequence opt11 from anti-influenza_Chain
auggaaaaaaucguccuacuauucgcgaucguaagccucgucaaauccgaccaaauaugcaucggcuaccacgcaaacaacagcaccgaacaaguagacaccauaauggaaaagaacgucaccguaacccacgcccaggacauacucgagaagaaacacaacggcaaacucugcgaccuagacggagucaagccccucauccuacgggacugcuccgucgcaggcuggcuacucggaaacccaaugugcgacgaauucaucaacgugccggagugguccuacauaguagaaaaggccaaccccgucaacgaccucugcuacccaggcgacuucaaugacuacgaagaacucaaacaccuacuaaguagaaucaaucauuucgaaaaaauacaaaucauccccaaauccagcuggucaagccaugaagcaucccuaggcgugagcucagcaugccccuaucaagggaaaacgagcuucuucagaaacgugguauggcucauaaaaaaaaacagcaccuacccgacaaucaaacgcagcuacaacaacaccaaccaagaagaccuccucguccuauggggaauccaccacccgaacgacgccgcagaacaaaccaagcucuaccaaaaccccacaaccuacaucagcguaggaaccagcacacucaaccaacgucuagucccccgaauagcuacgcgcagcaaagugaacggccaguccggcaggauggaauucuucuggaccauacuaaaacccaacgacgccauaaacuucgaauccaacggcaacuucauagccccugaguacgccuacaaaaucgucaaaaaaggagacagcacaauaaugaaauccgaacucgaauacggcaacugcaacacaaaaugccaaacccccaugggagccauaaacagcuccaugccauuccacaacauccacccccucaccaucggcgaaugccccaaauacguuaaaagcaaccgacugguccucgccacaggccuccgcaauagcccccaacgcgaaacacgcggacuauucggagccaucgcuggcuucaucgaaggcggauggcaaggcauggucgacggcugguacggguaccaccacagcaacgaacaaggcagcggcuacgcggccgacaaagaaagcacccaaaaagcgaucgacggaguaaccaacaaagucaacagcauaauagacaaaaugaacacccaauucgaagcuguagggagagaguucaacaaccuggaaagacgcauagaaaaccuaaacaaaaaaauggaagacggcuuccucgacgucuggacauacaacgccgaacugcucguacuaauggaaaacgaacgcacacuagacuuccacgacagcaacgucaagaaccucuacgacaaaguacgacugcagcuccgcgacaacgccaaagagcucggcaacggaugcuucgaguucuaccacaaaugcgacaacgaaugcauggaaucaguacggaacggcaccuacgacuacccccaauacuccgaagaagcccgccugaaacgagaagaaaucagcggagucaaacuagaauccaucggcaucuaccagauacuaagcauauacagcaccgucgccuccagccuggcacuggcaauaaugguagccgggcucagccuauggaugugcuccaauggcagucuacagugcagaaucugc

SEQ ID NO: 58896 - RNA, 1692 nt, Artificial Sequence
  derived and/or modified sequence opt11 from anti-influenza_Chain
auggaaaagauaguccuacucuucgcaaucgucucacucgucaaauccgaccaaaucugcauagguuaccacgcaaacaacuccacagaacagguagacaccauaauggagaaaaacgucaccgucacccacgcacaagacauccuagagaaaacacauaauggaaaacucugcucccucaacggcguaaaaccccucauccuccgcgacugcagcguagcuggauggcuacucggaaaccccaugugcgacgaauuucucaacgucccagaaugguccuacauagucgaaaaagacucccccaucaacgggcucugcuaccccggagacuucaacgacuacgaagaacuaaaacauuuacuguccuccaccaaccacuucgaaaagauacagaucauaccacgcagcagcugguccgaccacgacgccuccucaggcguguccuccgcaugccccuacaacggccgcucauccuucuuccgaaacgucgucuggcucauaaagaaaaacaacgccuaucccacaaucaaaaggaacuacaacaacacaaaccaagaagaccuacucguacucuggggcauccaccacccgaacgacgccaccgaacaaaccaaacuauaccaaaaccccacaacauacgucuccguagguaccuccacccuaaaccaaagauccgucccagaaaucgccacccgacccaaaguaaacggccaaucgggccgcaucgaguucuucuggaccauacucaaaccaaacgacgccaucaacuucgaauccaacggcaacuucauugcccccgaauacgccuacaaaaucgcuaagaaaggagacucagccaucaugaaauccggccuagaauacggcaacugcaacacaaaaugccaaacaccaaugggagccaucaacucaagcaugccauuccacaacauccacccccuaaccauaggcgaaugcccgcgguacgucaaaagcgaccgacucguccuagcaacaggccuacgcaacgucccccaacgagaaacacgcggauuauucggcgccaucgccggcuucaucgaaggcggcuggcaaggcaugguagacggaugguacggauaccaccacucaaacgaacagggaagcggauacgcugccgacaaagaaagcacgcaaaaagccaucgauggaauaaccaacaaagucaacuccauaauagacaaaaugaacacccaguucgaagcagucggcaaagaguucaacaaccucgaacgacgcaucgaaaaccucaacaagaaaauggaagacggguuccuagaugucuggacauacaacgccgaacuccugguacucauggaaaaugaacgcacacucgacuuccacgacagcaacgucaaaaauuuauacgacaaaguccgccuacaacuacgagacaacgccaaagaacuaggcaacggcugcuucgaguucuaccacaaaugcgaugacgaaugcauggaaucaguacgaaacgggaccuacgacuacccccaauacuccgaagaagcccgacuaaacagagaagaaauaagcggcgucaaacucgaaagcaucggcacauaccaaauccucucuauauacuccaccguagccucgucucucgcgcucgcgaucaugguggcaggccucucauucuggaugugcagcaacgguucccuccagugcagaauaugcauc

SEQ ID NO: 58897 - RNA, 1692 nt, Artificial Sequence
  derived and/or modified sequence opt11 from anti-influenza_Chain
auggagaaaauaguacuccucuucgcaauugucagccucguaaaauccgaccaaaucuguaucggauaccacgccaauaacagcaccgaacaagucgacaccaucauggaaaagaaugugaccgucacccacgcacaagauauccuagagaaaacacauaacggaaaacucugcagccuaaacggaguaaaaccccucauccuccgagacugcucaguagcuggcuggcuacucggaaaccccaugugcgacgaauuucuaaacguccccgaaugguccuacaucguggaaaaagacagccccaucaacggccuuugcuaccccggcgacuucaacgacuacgaagaacucaaacaccuacucucauccacuaaccacuucgagaaaauacagaucaucccccguucauccuggucagaccacgacgccuccucaggcgugagcagcgccugcccuuacaacggacgcuccucauucuuccgcaacgucgucuggcuaaucaagaaaaacaacgccuacccgaccauaaaacgcaacuacaacaacaccaaccaggaagaucuacucguucuauggggcauacaccaccccaacgacgcgaccgaacaaaccaaacucuaucaaaaccccacuaccuacgucagcgucggcacaagcacacuaaaccagcgaagcguccccgaaaucgcaacacgcccaaaagucaacggccaaucugggcgcaucgaauuuuucuggaccauccuuaaacccaacgacgccaucaacuucgaaucaaacggcaacuucauagcacccgaauacgccuacaaaauagccaagaaaggcgacucagcaaucaugaaauccggccucgaauacggaaacugcaacaccaaaugccaaaccccaaugggugccauaaacagcuccaugcccuuccacaacauccauccacucaccaucggcgaaugcccaagauacguaaaauccgacagacucguccucgccaccggccucagaaacguuccacaacgcgaaacccgaggccuauucggagccaucgccggguucaucgaaggcggcuggcaaggaaugguagacggcugguacggauaccaccacuccaacgaacaaggaucaggauacgcugcggacaaagaauccacccaaaaagccaucgacggcauaacaaacaaaguaaacagcaucauugacaaaaugaacacucaguucgaagcagucggcaaagaguucaacaaccucgaacgaagaauagaaaaucucaacaagaaaauggaagacggcuuccucgacgucuggaccuacaacgcagaacuccucguacucauggaaaacgaacgcacccucgacuuccacgauucaaacgucaaaaaccucuacgacaaaguccgccuccagcuccgagacaacgccaaagaacucggaaacggcugcuucgaguucuaccacaaaugcgacgacgaaugcauggaaucaguccguaacggcaccuacgauuacccucaauacagcgaagaagcccgccucaaccgugaagaaaucuccggcgucaaacuagaaagcauuggcacuuaccaaauccucucgauauacuccacaguagcaagcucccuagcccuagccauaauggucgccggacucucuuucuggaugugcagcaacggaucacuacaaugccgcaucuguauc

SEQ ID NO: 58898 - RNA, 1695 nt, Artificial Sequence
  derived and/or modified sequence opt11 from anti-influenza_Chain
auggaaaaaaucguccuccucuucgccaucgucucccuugucaaauccgaccaaauaugcaucggguaccacgcaaacaacuccaccgaacaagucgacacaaucauggagaaaaacguaaccguaacucacgcccaagacauccucgaaaaaaaacacaacggcaaacuaugcgaccucgacggagucaaaccucugauccuccgcgacugcuccgucgcaggguggcuacuaggcaacccaaugugcgacgaauucauuaauguccccgaauggucauacaucguagagaaagcgaaccccgucaacgaccuauguuaccccggggacuucaaugacuaugaagagcucaaacaccuacuaucccgcauaaaccacuucgaaaaaauccaaaucaucccuaaaucauccuggucaucucacgaggccuccuuaggcguguccagcgccugcccguaccaaggcaaguccucauucuuccggaacgucgucuggcucaucaaaaaaaacucuacauaccccaccauaaaacgaagcuacaacaacaccaaccaagaagaccuacucguccucuggggaauacaccaccccaacgacgcagccgaacaaacaaaacucuaccaaaaccccacgaccuacaucucaguuggcacauccacccucaaccaacgucucgucccacguauagcaacacgaagcaaagucaacggacagaguggacguauggaauucuucuggaccauccuaaaacccaacgacgcgaucaacuucgaaagcaacggaaacuucauagcccccgaauacgcauacaagaucguaaaaaaaggcgauucuaccaucaugaaauccgaacuagaguacggcaauugcaacaccaaaugccaaacucccaugggcgcgaucaacuccuccaugccauuccacaacauacaccccuugaccauaggcgaaugccccaaauacgucaaaagcaaccgacucguccucgccaccggucuacgcaacuccccacaacgagagcgccgccgaaaaaaacgcggccucuucggagccauagccggauuuaucgagggcggcuggcaaggcauggucgacggcugguacggcuaccaccauaguaacgaacaaggcuccggcuacgccgccgacaaagaauccacgcagaaagcuaucgacggagucaccaacaaaguaaacucaaucaucgacaagaugaacacccaauuugaagcagucggccgagaauucaacaaccucgaacgacggaucgaaaaccucaacaaaaaaauggaagacggauuccucgacgucuggacauacaacgccgaacuccuugugcuaauggagaacgaacgcacccuagacuuccacgacagcaacguaaagaaccucuacgacaaaguccggcuccaacuccgcgacaaugccaaagagcucggcaacgggugcuucgaauucuaccacaaaugugacaacgaaugcauggaguccguacgcaacggcacguacgacuacccccaauacuccgaggaagcccgacucaaacgcgaagaaaucagcggcgucaaacucgaauccauaggaauauaccaaauacucuccaucuacagcacgguagcauccucccuagcacuagcaauaaugguagcaggccucucccucuggaugugcuccaacggcucccuccaaugccgc

SEQ ID NO: 58899 - RNA, 1695 nt, Artificial Sequence
  derived and/or modified sequence opt11 from anti-influenza_Chain
auggagaaaaucguacuccucuucgccaucguaagcuugguaaagucagaccaaaucugcaucggcuaccacgcaaacaacucaaccgaacaagucgacaccaucauggaaaaaaacgucaccguaacccacgcccaagacauccuggaaaagacacacaacggaaaacucugcgaccucgacggagucaagccccucauccuccgagacuguuccgucgccggcuggcuucucggcaaccccaugugcgacgaauucaucaacguacccgaauggucguacaucguagaaaaagcuaacccagugaacgaccugugcuacccuggcgacuucaacgacuacgaagaacucaaacaccuccucucacgcauaaaccacuucgaaaaaauccaaaucauccccaaauccucauggucaucccacgaagcuagccucggagucuccuccgcuugcccauaccaaggcaaguccuccuucuuccgcaacgucgucuggcucauuaagaaaaacuccaccuaccccacaaucaaaagauccuacaacaacacaaaccaagaagaccuccucguccuauggggaauccaccaccccaaugacgccgccgaacaaacaaaacucuaucaaaaccccacaaccuacaucagcgugggcacauccacacucaaccaacgacucguaccacgcaucgccacccgcuccaaggucaauggucaaucaggccgaauggaauucuucuggaccauccucaaacccaacgacgccauaaacuucgaaagcaacggcaacuucaucgcccccgaauacgcauacaaaauuguaaaaaaaggcgacagcacuauaaugaaaucugaacucgaauacggcaacugcaacaccaaaugccaaacaccaaugggcgcaaucaacucauccaugccuuuccacaacauccauccacuaaccaucggggaaugccccaaauacguaaaauccaacagacucguccucgccaccggccuccguaacucaccccaacgcgaaagacgccgaaaaaaaagagggcucuucggagccaucgccggcuucaucgaaggaggcuggcaaggaauggucgacggaugguacggcuaccaucacucaaacgaacagggcagcggcuacgccgcagacaaagaauccacccaaaaagccaucgacggcguaaccaacaaagugaacuccaucauagacaaaaugaacacacaauucgaagcugucggccgagaauucaacaaucuggagcgacgaaucgaaaaccuaaacaaaaaaauggaagacggcuuccucgacgucuggaccuacaacgccgaacuccugguccuaauggaaaacgaaagaacacucgacuuccacgacucaaacgucaaaaaccucuaugacaaagucagacuccaacuccgagacaacgcaaaagaacucggcaacggaugcuucgaauucuaucacaaaugcgacaacgagugcauggaaagcguccgcaacggcaccuacgacuacccccaauacuccgaagaagcccgccugaaacgagaagaaauaagcggcguuaagcuagaaagcaucggcaucuaccaaauacucuccaucuacuccaccgucgcgagcucccucgcccucgcaauaauggucgcaggacucucccucuggaugugcucgaacggaucccuacaaugccga

SEQ ID NO: 58900 - RNA, 1695 nt, Artificial Sequence
  derived and/or modified sequence opt11 from anti-influenza_Chain
auggaaaagauaguccuacuccucgccaucguaucccuagucaaaagcgaccaaaucugcaucggcuaccacgcuaacaacuccaccgaacaagucgacacaaucauggagaaaaacgucaccgugacacacgcccaagacauacuagagaaaacccacaacggcaaacuaugcgaccucgacggaguaaaaccccugauccuacgagacugcagcgucgccggcuggcuccucggcaacccaaugugcgacgaguucaucaacgucccggaaugguccuacauaguagaaaaagcaaacccagccaacgaccucugcuaccccggcaacuucaacgacuacgaagaacucaaacaccuccucucccgaaucaaccacuucgagaaaauucaaaucauaccaaaaucgagcuggagugaucacgaagccuccagcggagucuccucagcaugccccuaccaaggcaaaagcuccuucuuccgaaacguggucuggcuaauaaagaaaaacagcagcuacccgaccaucaaacgauccuacaacaacacgaaccaagaagaccuccucguccucuggggcauccaccaccccaacgacgcagcggaacagacgagacuguaccagaaccccacaacauacaucuccgucggcacauccacccuaaaccaacgacucguacccaaaaucgcgacccgcuccaaagugaacgggcaaagcggcaggauggaauuuuucuggacaauacucaaaccuaacgacgccaucaacuucgaaucaaacggaaacuucauagcacccgaauaugcauacaaaaucgucaagaaaggcgacuccgccaucaugaaauccgaacuagaauacgggaauugcaacacaaaaugccaaacccccaugggagcaaucaacuccuccaugccguuccacaauauccacccacuaaccaucggcgaaugcccaaaauacgucaaaagcaacagacucguacuagccacaggccuccgaaacucaccccagcgagaacgccgccgcaagaaacgcggacuauucggagccaucgcaggcuucaucgaaggaggcuggcagggcauggucgacggcugguacggcuaccaccacuccaacgaacaaggcuccggcuacgccgccgacaaagaaucaacccaaaaagccaucgacggcgucaccaacaaagucaacuccaucaucgacaaaaugaacacccaauucgaagccgucggacgggaguucaacaaucucgaacgacgcauagaaaaccucaacaagaaaauggaagacggauuccucgacguauggaccuacaacgccgaacuacucguacucauggaaaacgagcgaaccuuagacuuccacgacucaaacgucaaaaaccuauacgacaaaguccgccuccagcuccgcgacaacgccaaagaacucggcaacggcugcuuugaauuuuaccacaaaugcgacaacgaaugcauggaaagcguccgcaacgguacguacgacuacccccaauauuccgaagaagcccgccuaaaacgcgaagaaaucucgggcguuaaacuagaaucaaucggaauauaccaaauacucucaaucuacuccacugucgcaucuagucuggcccuagccauaaugguagccggacucucccuauggaugugcucuaacggcucucugcaaugccga

SEQ ID NO: 58901 - RNA, 1695 nt, Artificial Sequence
  derived and/or modified sequence opt11 from anti-influenza_Chain
auguccgaccgcagacaaaaccgcaagacccccgacgaacaacgaaaagcaaacgcacucaucaucaacgaaaacaucgaagcguacaucgcaaucugcaaagaagucggccucaacggcgacgaaaugcuaauacuagagaacggaaucgcaaucgagaaagcgaucaggaucugcugcgacggcaaguaccaagagaaaagagaaaagaaagccagggaagcccaacgggccgacagcaacuucaacgccgauagcauaggcauacgacugguaaaacgagcgggcucaggcacgaacauaaccuaccacgccgucguagaacucaccucaagaagccguauaguacagauacucaaaucacacuggggcaacgaauuaaaccgagcaaagaucgcaggaaaacgccuaggcuuuagcgcccuauucgcuagcaaccucgaagcaaucauauaccaacgcggacgcaacgcagcacgaaggaacgggagcgcagaacuguucacauuaacacaaggagcagggaucgaaacccgauacaaauggauaauggaaaaacacauaggcaucggaguccuaauagccgacgcuaaaggacucaucaacggcaaaagagagggaaaaaggggcgucgacgcgaacgugaaacuacgcgccggcacaaccggaagcccauuagaacgcgccaugcagggcaucgaaaagaaagcauucccaggaccacuccgagcccuugcccggagaguggucaaagccaacuacaacgacgcacgcgaagcccuaaacguaaucgcagaagcaagccuacuccugaaaccacaaaucacuaacaaaaugaccaugcccuggugcauguggcuagcagcccgccucacccuaaaagacgaguucgccaauuucugcgccuacgcaggucgacgagcguucgaaguguucaacaucgcaauggagaaaaucggcauaugcucauuccagggaaccaucaugaacgacgacgaaaucgaaagcauagaagauaaagcgcaaguacuuaugauggcgugcuucggccucgccuacgaagacuucagccuaguaucagcaaugguaucacacccccucaaacuacgaaaccgaaugaaaauaggcaacuucagggucggcgagaaagucuccaccguccuaucuccacuacucagguucacacgcugggcagaguucgcgcaacgauucgcacuccaagcaaacaccucacgagaaggugcacaaaucuccaacagcgccguauucgccgucgaacgcaaaauaaccaccgacgugcaaagagucgaagaacuccucaauaaaguccaagcacacgaagacgaaccacuucaaacccucuacaagaaaguacgcgaacaaauaucaauaauaggccgaaacaaaagcgaaaucaaagaguuccucggcagcucaauguacgaccuaaacgaccaagagaaacaaaacccaaucaauuucagguccggagcccacccguuuuucuuugaguucgacccagacuacaaccccaucagaguaaaaagaccuaaaaagccaauagccaagcgcaacagcaauaucucaagacuagaagaagaaggaauggacgaaaacagcgaaaucggccaagccaaaaagaugaaaccacucgaccagcucacauccacaagcuccaacaucccagggaaaaac

SEQ ID NO: 58902 - RNA, 1695 nt, Artificial Sequence
  derived and/or modified sequence opt11 from anti-influenza_Chain
augaaagucaaacuccucguccuacucugcacauucaccgccaccuaugccgacacaaucugcaucggcuaccacgccaacaacuccaccgacacagucgacaccguacucgagaaaaacguaaccgucacccacuccguaaaccuccucgaaaacagccacaacggaaaacugugccuacuaaaaggcaucgcaccccuucagcucggcaacugcucagucgccggcuggauacucggaaacccagagugcgaacuacucauaagcaaggaaucauggucauacaucgucgaaaaaccgaacccagaaaacggcacaugcuaccccggccacuucgccgacuacgaagaacuccgcgaacaacuaucaagcgucagcuccuuugaacgauucgaaaucuucccuaaagaaucauccuggcccaaccacaccguaacaggcgucuccgccuccugcagccacaacggagaguccuccuucuaccgcaaccuccuauggcucaccggcaaaaacggacuuuacccuaaccuaucaaaauccuacgcaaacaacaaagaaaaagaaguccucguccuauggggcguacaccacccgcccaauaucggagaccaaaaagcacucuaccacaccgaaaacgcauacguauccgucguaucaucccacuacagcagaaaauuuacacccgaaaucgcaaaacgcccaaaagugagagaccaagaaggccgcaucaacuaccacuggacacuacucgaaccuggcgacaccauaauuuucgaagccaacggaaaccugauagcgccccgauacgcauucacacugagccgcggcuucggcagcggcauaaucaacucgaacgcgcccauggacaaaugcgaugcuaaaugccagaccccgcaaggcgccaucaacucgucccugccuuuucagaacgugcaccccgugaccauaggagagugccccaaauacguccgcucagccaaacuccgaauggucacaggccuacguaacauacccagcauccaaucacgcggccucuucggcgccaucgccggcuucaucgaaggcggcuggaccggcauggucgacggcugguacggcuaccaccaccaaaacgagcaaggauccggauacgccgcugaccaaaaaucgacacaaaaugccauuaacggaaucaccaacaaaguaaacuccguaaucgagaaaaugaacacccaauucaccgcggugggaaaagaguucaacaaacucgaacgacgcauggaaaaccucaacaaaaaggucgacgacggguucaucgacauauggacguauaacgccgaacuccuaguccuucuagaaaacgaacgaacgcuagacuuccacgacucaaacgucaaaaaccuauacgaaaaaguaaaaagccagcucaaaaacaacgccaaggaaaucggcaacggaugcuucgaguucuaccacaaaugcaacgacgaaugcauggaaucggucaaaaacggcaccuacgacuaccccaaauacuccgaagaaagcaaacuuaaccgagagaagaucgacggcguaaaacucgaauccaugggugucuaccaaauccuagccaucuacucaacagucgccagcucccucguccuccucguaucgcugggagccaucagcuucuggaugugcucaaacggcucgcuucaaugccggaucuguauc

SEQ ID NO: 58903 - RNA, 1695 nt, Artificial Sequence
  derived and/or modified sequence opt11 from anti-influenza_Chain
augaaagucaagcuccucguccuccuaugcaccuucacagccacauacgccgacaccaucugcaucggcuaccacgccaacaacagcaccgacacgguagacacuguccuagagaaaaacgucacagucacucacagcgucaaccuccucgaaaacucccacaacgguaaacucugccuacucaaaggcauagcaccccuacaacuagguaacugcuccguagccggcuggauccucggcaacccagaaugcgaacuccugaucucaaaagaauccugguccuacauuguugaaaaacccaauccggaaaaugguacaugcuauccaggucacuuugcagacuaugaagaacuccgagaacaacuaucuagcgucuccucauucgaacgcuucgaaaucuucccuaaagaaucgucauggcccaaccacacaguaaccggcgucagcgccuccugcucccacaacggagaaucguccuucuaccgaaaucuccuauggcuaaccggcaagaacgggcucuacccuaaccuaagcaaaaguuacgccaacaacaaagaaaaagaaguucucguacuauggggaguucaccacccacccaauauuggagaccagaaaacacucuaccacacugaaaacgccuacgucuccguaguaucgucccacuacagucgaaaauucacacccgaaaucgcaaaacgacccaaagugcgugaccaagaaggacgcaucaacuauuacuggacccuccucgaaccaggcgacaccauaaucuucgaagccaacggaaaccucauagcgccccgcuacgcguucgcccuaucucgaggcuucggcuccgggaucaucaacuccaacgcacccauggacaaaugcgacgcaaaaugccaaacaccacaaggcgcaaucaauuccucucuccccuuccaaaacgugcaccccgucaccaucggagaaugccccaaauacguccgcagcgcaaaacuccgaauggucaccggccuaagaaacauccccagcauucaaucacgaggccuauucggcgcuaucgccggauucaucgaaggcggauggaccggcauggucgacggcugguacggcuaccaccaccaaaaugaacaaggaagcgguuacgccgcagaccaaaaauccacacaaaacgccaucaacggcaucaccaacaaagucaacagugucauagagaaaaugaacacccaauucacagccgucggcaaagaguucaacaaacucgaacgccgaauggaaaaccucaacaaaaaggucgaugacggcuucauagacaucuggaccuacaacgccgaacuccucgucuuacucgaaaacgaacgcacccucgacuuccacgacuccaacgucaagaaccucuacgaaaaagucaaaagccaacucaaaaacaacgccaaggaaaucggcaacggaugcuucgaguucuaccacaaaugcaacgacgaaugcauggaaucugucaaaaacggcacguacgacuacccaaaguacucggaagaaagcaaacucaaccgagagaaaaucgacggugucaaacucgaauccauggggguauaccaaauccucgccaucuacucaacagucgccuccagccucguccuacucgucagccugggagccaucagcuucuggaugugcagcaacggcucccuccaaugccgaaucugcaua

SEQ ID NO: 58904 - RNA, 1695 nt, Artificial Sequence
  derived and/or modified sequence opt11 from anti-influenza_Chain
augaaagucaaacuucucguccuacucugcaccuucaccgccaccuacgccgacaccaucugcaucggcuaccacgccaauaacuccacagacacagucgacacaguccuagaaaagaacgugaccgucacacacuccgucaaccugcucgaaaacagucacaauggcaagcuaugccugcuuaagggcauagcaccccuccaacucggaaacugcucggucgccgguuggauccucgggaacccagaaugcgaacuccucaucucaaaagaauccuggucuuacauagucgaaaaacccaacccagaaaacggcacauguuaccccggacacuuugccgacuacgaagaacugcgagaacaacucuccagcgucagcucauucgaacgcuucgaaaucuuccccaaagaauccucauggcccaaccauaccguuacaggcgucagcgcauccugcagccacaacggcgaaucuucuuucuaucggaaccuacuauggcucacgggcaagaacggccucuacccaaaccuuuccaaaucguacgccaacaacaaagaaaaagaaguacucguacuauggggaguccaccacccacccgacaucggagaccagaagacccuauaccacaccgaaaacgccuacgucuccguuguaucaucccacuacucccgaaaauucacccccgaaaucgccaaacgccccaaaguccgggaccaagaaggccgcaucaacuacuacuggacgcugcucgaacccggcgacaccaucaucuucgaagccaacggaaaccucauagcaccccgcuacgccuucgcccucucccgaggcuucggauccgguaucaucaacucaaacgcacccauggacaaaugcgacgcuaaaugccaaacaccccaaggcgcaaucaacuccucacuacccuuccaaaacguccaccccgucaccauaggcgaaugcccaaaauacguccgcuccgcaaaacuucgcauggucacuggacuccgcaacauccccuccauccaaucccgcggacuauucggcgccauagcaggcuucaucgaaggcggcuggaccggcauggucgacggaugguacgguuaccaccaccagaacgagcaaggcuccggauacgcggcagaccaaaaauccacacaaaacgccaucaauggcaucacaaacaaaguaaacuccgucaucgagaaaaugaacacccaauucaccgcagucggcaaagaguucaacaaacuugaacgccgcauggaaaaccucaacaagaaaguagacgacggcuucaucgacauauggacauacaacgccgaacuccuaguccuccuagaaaacgaacgaacccucgacuuccacgacuccaacgugaaaaaccucuacgaaaaaguaaaaucccaacucaagaacaacgccaaagaaaucggcaacggaugcuucgaguucuaccacaaaugcaacgacgaaugcauggaauccgucaaaaacggaaccuacgacuacccaaaauacuccgaagaaucaaaacuaaacagagagaaaauagacggcguaaaacucgaauccaugggcgucuaccaaauccucgcuaucuacuccaccgucgccuccuccuuaguucuccucgucucccuaggcgccaucucguucuggaugugcuccaacggcucccuccaaugcagaauaugcauc

SEQ ID NO: 58905 - RNA, 1695 nt, Artificial Sequence
  derived and/or modified sequence opt11 from anti-influenza_Chain
augaagguaaaacugcucguccuccuaugcaccuucacagcaaccuacgccgacaccauaugcaucggcuaccacgcaaacaacucaacagacacaguagacaccguacucgagaaaaacgucaccgucacccacuccgucaaccuccucgaaaacucccacaacggaaaacuaugccugcucaaaggcauagcuccccuucaacucggcaacugcuccguagccggcuggauccucggcaacccagaaugcgaacuacucaucuccaaggaaagcuggagcuacaucgucgaaaaaccaaacccagagaacggaaccugcuaccccggacacuucgccgacuacgaagaacuacgagaacagcucucaagcgucagcucauucgagcgcuucgagauuuucccaaaagaaagcucuuggccaaaucacaccguuaccggcgucuccgcaagcugcucccacaacggagaauccucauucuacaggaaccuacuauggcucaccggcaaaaacggacucuaccccaaccucagcaaauccuacgccaauaacaaagaaaaagaaguccugguacucuggggaguccaucacccacccaacaucggagaucaaaaagcccuauaccacaccgagaacgccuacguuuccgucgucagcagccacuacagccgcaaauucaccccagaaaucgcaaaacgucccaaaguacgagaccaggaaggucgcaucaacuauuacuggacccuccucgaaccaggcgacaccaucauauucgaagccaauggcaaccuaaucgcuccccgcuacgccuucgcccucuccagaggcuucggguccggaaucaucaacagcaacgcccccauggauaaaugcgacgccaagugccaaaccccgcaaggagccaucaacagcucccuacccuuccaaaacguacacccagucaccauaggcgaaugcccaaaauacguccgauccgccaaacuacgaauggucacagggcuccgcaacauaccaucaauccaaucacgcggacuauucggcgcaauagccggguucauagagggcggcuggaccggcauggucgacgguugguacggcuaccaccaccaaaacgaacaaggcuccggauacgcagcagaccaaaaaucgacacaaaacgcgaucaacggaaucaccaacaaagucaacucaguuaucgagaaaaugaacacacaauucacagccgucggcaaagaguucaacaaacucgaacgccgaauggaaaaccucaacaagaaagucgacgauggauucaucgacaucuggacauacaacgccgaacuacucguacuccucgaaaacgaacgcacacuagacuuccacgacuccaacgucaaaaaccucuacgaaaaaguaaaaagccaacucaaaaacaacgccaaagaaaucggaaacggauguuucgaguucuaccacaaaugcaacgaugaaugcauggagucagucaaaaacggcaccuacgacuaccccaaauacucagaggaguccaaacuaaaucgcgagaaaaucgacggaguaaagcucgaauccaugggcguauaccaaauucuagccauauacagcacagucgcaagcagccuaguacugcuaguaucgcucggcgccaucagcuucuggaugugcagcaacggcucccuacaaugccgaaucugcaua

SEQ ID NO: 58906 - RNA, 1695 nt, Artificial Sequence
  derived and/or modified sequence opt11 from anti-influenza_Chain
augaaagcaaaacuccuaguacuacucugcaccuucacagccaccuacgccgacaccaucugcaucggcuaccacgccaacaacuccaccgacaccguagacaccguccuagaaaagaacgugaccguaacccacagcguuaaccuccucgaagacucacacaacggaaaacucugccuccucaaaggcaucgcaccccuccaacucggaaacugcuccgucgccggcuggauacuaggcaaccccgaaugcgaacuccuaaucagcaaagaauccuggucauacaucgucgaaacccccaacccagaaaacggcacuugcuaccccggcuacuucgccgauuacgaagaacuccgcgaacaacuauccucuguauccucuuucgaacgcuucgaaauauuccccaaagaauccuccuggcccaaccacacagucaccggcguaucagccagcuguucccacaacggaaaauccucguuuuaccgcaaccuccuuugguuaaccggcaaaaacggccucuacccaaaccucuccaaauccuacguaaacaauaaagaaaaggagguacucguacuauggggaguacaccauccacccaacaucggcaaccaaagagcccuauaccacaccgagaacgccuacgucuccguagucaguucacacuacucccgccgcuucaccccagaaaucgccaaacgccccaaaguccgcgaccaagagggacgcaucaacuacuacuggacccuccucgaaccgggagacacaaucaucuucgaagccaacggcaaccucauagcacccugguacgccuucgcccucucacgcggcuucggcucaggcauuauuacauccaacgccccgauggaugaaugcgacgccaaaugccaaacaccacagggcgccaucaacucaucgcuccccuuccaaaacguccaccccgucaccauaggcgaaugccccaaguacguccgcucagccaaacuacguauggucaccggccuccgaaacauacccuccauccaaagccgaggacuauucggcgcgauagccggauucauagaaggaggauggacaggcauggucgacggcugguacggcuaccaccaccaaaacgaacagggcuccggguacgccgcagaccaaaaaucaacccagaacgccauaaacggcauaaccaacaaagucaacuccguaaucgagaaaaugaacacacaauucaccgcaguaggcaaagaauuuaacaaacucgaacgacgaauggaaaaccucaacaaaaaggucgacgacggguuccucgacauauggacuuacaacgccgaacuccucguccuccuagaaaacgaacgcacccucgacuuccaugacucaaaugucaaaaaccucuacgaaaaagucaaaucccaacucaaaaacaacgccaaagaaaucggcaacggcugcuucgaguucuaccacaaaugcaacaacgaaugcauggaaagcgucaaaaacggaacauacgacuacccaaaauacagcgaagaaucaaaacuaaaccgagagaaaaucgacggcgucaaacuugaaucaaugggcguauaccaaauacucgcaaucuacucaacagucgccuccucccucgugcuccucgugucccucggcgccaucucauucuggaugugcuccaacggcucacuacagugccgcaucuguauu

SEQ ID NO: 58907 - RNA, 1695 nt, Artificial Sequence
  derived and/or modified sequence opt11 from anti-influenza_Chain
augaaggucaaacuccugguccugcuaugcaccuucaccgccaccuacgcagacaccauuugcaucggauaccacgcuaacaacagcaccgacacagucgacaccguccuagagaaaaacgucacaguaacccacucagucaaccugcuagaagacagccacaacggaaaacuaugccuccuaaaaggcaucgccccacuccagcuaggcaacuguagcgucgccggcuggauacucggcaaccccgaaugcgaacucuuaaucagcagagaauccuggucauacaucguagaaaaaccuaacccagaaaauggaacgugcuaccccggacacuuugccgacuacgaagaacucagagaacaacucucuucaguuuccagcuucgaacgcuucgagaucuuccccaaagaaagcagcuggcccaaccacacgaccacaggaguuuccgccagcugcagccacaacggagaaucgucauucuacaaaaaccuccucuggcucacaggaaagaacgggcucuaccccaaccucuccaaauccuacgccaacaacaaagaaaaagagguacucguacucuggggcguacaccacccgccaaacaucggcgaccaaagagcccuauaccauaaagaaaacgcauacgucucagucguaagcucccacuauagccgcaaauucacccccgaaauugccaagcgcccaaaaguacgcgaccaggagggacgaaucaacuacuacuggacacuacuagaaccgggcgacaccauaaucuuugaagcaaacggcaaccugaucgcuccacgauacgccuucgcacucucacgcggcuucggcagcggcaucaucaacagcaacgccccaauggacgaaugcgacgccaaaugccaaacaccccaaggcgcuaucaacucgucucuccccuuccaaaacguccacccagucacgaucggcgaaugccccaaauacguccggagcgccaaacuucgcauggucaccgggcuacgcaacauccccagcauacaaucccgagggcuauucggcgcgauugccggauucaucgaaggcggguggaccgguauggucgacggaugguacggcuaccaccaccaaaacgaacaagguuccggcuacgcagccgaccaaaaguccacccaaaacgcaauaaacggaauuacgaacaaagucaacagcguaaucgaaaagaugaacacccaauucacagccgucggaaaagaguucaauaaacuggaaaggcgcauggaaaaccucaacaagaaagucgacgacggauucauagauauauggaccuacaacgccgaacuccuaguccuacuagaaaacgaacgaacccucgacuuccacgacagcaacguuaaaaaccucuacgaaaaagucaaaucccaacucaaaaacaacgcuaaagaaauaggcaacggcugcuucgaguucuaucacaaaugcaacgacgaaugcauggaaucagucaaaaacggaaccuacgacuaccccaaguauucggaagaaagcaaacucaacagagagaaaauagacggcguaaaacuagaaagcaugggcguauaccaaauccuagccaucuacucgaccguagcauccucccucguacuucuagucucccuaggagccaucucguucuggaugugcagcaacggaucccuacaaugccggaucugcauc

SEQ ID NO: 58908 - RNA, 1677 nt, Artificial Sequence
  derived and/or modified sequence opt11 from anti-influenza_Chain
gacaaaauaugcaucggauaccaaagcaccaacuccaccgaaacagucgacacacugacaaaaacaaacguccccguaacccaagcaaaagaacuacuccacaccgaacacaacggcauguuaugcgcaaccaaccuaggccacccccuaauccucgauaccugcaccauagaaggacucauauacggcaacccaucgugugaccuacuccucggcggccgagaauggagcuacaucguagaacgaccgagcgccguuaacgggaugugcuaccccggaaacgucgaaaaccucgaagaacuccgacuacuauucagcuccgccuccuccuaccaaagaguccaaaucuucccagacacaauauggaacguaacauacagcggcacaucaucagcaugcucaaacuccuucuaccggagcaugcgcuggcucacccagaaagacaauaccuacccaguccaagacgcacaauacaccaacaaccgaggcaaaucaauccucuucaugugggggaucaaucacccgccaaccgacaccguacaaaccaacuuauacacacgcaccgacaccacaaccuccgucacaacagaggacauaaaccgagcauucaaaccgguaaucggcccacgaccccucgucaacggacuacaaggacgaaucgacuacuacugguccguccuaaaaccaggacaaaccuuaagaguccgguccaacggcaaccuaaucgccccaugguacggccacauccuaucaggcgaaucucacggacgaauccucaaaagcgaccucaacagcgguaacugcgucguacagugccaaaccgaaaggggcggacuaaacaccacacuaccauuccacaacgucucaaaauacgccuuuggcaacugccccaaauacguaggagucaaaucccucaaacuagcaguagguaugcgcaauguaccggccagaucaucacgcggacucuucggcgcaaucgccggauucauagaaggaggcuggccaggccucguugcaggcugguacggauuccaacacuccaacgaccaaggaguaggcauggccgccgaucgagacuccacccaaaaagcaaucgacaaaaucacaaguaaagucaacaacaucguagacaaaaugaacaagcaguacgaaauaaucgaccacgaguucagcgaaauagaaacccgucuaaacaugaucaacaacaaaaucgacgaccaaauacaggacaucugggccuacaacgcagaacuauuaguccuacucgaaaaucaaaagacacuagaugaacacgacgcaaaugucaacaaccucuacaacaaaguaaaacgagcacuagguuccaacgccauggaagacggaaaaggaugcuucgaacucuaccacaaaugcgacgaccgaugcauggaaacaaucagaaacgggaccuacaaccgaggcaaguacaaagaagaaagcagguuagaacgacagaaaauagaaggaguaaaacucgaauccgaaggaaccuacaaaaguggacgacucgucccacgcggaucccccggcuccggcuacauacccgaagcgcccagagacggccaagcauacguacgcaaagacggcgaauggguccuccuaucgaccuuccucggaaaacccaucccgaacccccuacuuggacuagacagcaccggc

SEQ ID NO: 58909 - RNA, 1677 nt, Artificial Sequence
  derived and/or modified sequence opt11 from anti-influenza_Chain
gacaagaucugcauaggauaccaaucuaccaacucaaccgaaaccgucgacacccucaccaagaccaacguccccguaacccaggccaaagaacuucugcacacagaacacaacgggaugcuaugcgccaccaaccuuggccauccacuaauacuagacacaugcaccaucgaagggcucaucuacgggaaccccagcugcgaccuccuacugggcggccgcgaauggagcuacaucgucgaaagaccauccgccgucaacggcaugugcuaccccggaaacguagaaaaccuggaagaacuccgacuacuauucuccuccgccucguccuaccaacgaguccagauauucccugacaccaucuggaacguaaccuacuccggcaccucaucagccugcagcaacagcuucuaccgauccaugcgguggcucacccaaaaagacaauacauacccaguacaagacgcccaauacaccaacaacagaggcaaauccauccuuuucauguggggcaucaaccaucccccuaccgacaccguacaaaccaaccuauacacaagaacagacaccaccaccuccgucaccacagaagacauuaaccgcgcauucaaaccaguaauaggaccccgaccccucgucaacgggcuccaaggccggaucgacuacuacuggucaguucuaaaacccggccaaacccuccgcguccggagcaacggcaaccuaaucgcccccugguauggccacauccucuccggcgaaucccacggacgaauacuaaaauccgaccuuaacuccggcaacugcguuguccagugccaaacagaacgaggcggccucaauaccacccucccauuccacaacguauccaaauacgcauucggaaacugccccaaguacgucggcgucaaaucacuaaaacucgccgucggcaugcgcaacguaccggcaagaagcagccgaggccuauucggcgccaucgcaggauucauugaaggcgguuggccaggccuagucgcaggcugguacggauuccaacacucaaacgaccaaggcgucggcauggcagccgacagagacucaacacaaaaggccauugacaaaaucaccagcaaggucaacaacaucgucgacaaaaugaacaaacaauacgaaauaaucgaccacgaguucuccgaaaucgaaacucgacucaacaugaucaacaacaaaauagacgaccaaauacaggacaucugggcauacaacgccgagcuucucguccuacucgaaaaccaaaagacccucgacgaacacgacgccaacgucaacaaccucuacaacaaaguaaaaagagcccucggaagcaacgccauggaagacggcaaaggcugcuucgagcuguaucauaaaugcgacgaccgcuguauggaaaccauccggaacggaaccuacaaccgcggcaaauacaaagaagaaucccgccucgaaagacaaaagaucgaaggaguuaaacucgaauccgagggcaccuacaaaucaggccgccuagucccucgaggguccccgggcucaggcuacauucccgaagcgccccgagacggccaagccuacguacgcaaagacggcgaauggguccuccucuccaccuuccucggaaaaccgaucccaaacccccuccuaggccuagacucaaccggg

SEQ ID NO: 58910 - RNA, 1695 nt, Artificial Sequence
  derived and/or modified sequence opt11 from anti-influenza_Chain
auguccgacagacgccaaaaccgaaagaccccggacgaacaacgaaaagcgaacgcccucauaaucaaugaaaacaucgaagccuacauagcaauaugcaaagaagucggacuaaacggagaugaaaugcugauccucgaaaacgggaucgcaauagagaaagccauacgcaucugcugcgacggaaaauaccaagaaaaacgcgaaaagaaagcaagagaggcgcagagagcagauagcaacuucaacgccgacagcauaggcauacgacuggucaaacgagcaggaagcggaaccaacauaacauaccacgccgucguagaguuaacaucacgcucccgcaucguacaaauccuaaaaagucacuggggcaacgaacuaaacagagcaaaaaucgcgggcaaacgacugggcuucuccgcacuauucgccagcaaccucgaagccaucaucuaccaaagaggccgcaacgccgcccgcagaaacggauccgcagaacuauucacgcucacgcaaggcgccggaaucgagacgcgauacaaauggaucauggaaaaacacauaggcaucggaguacugauagcagacgcgaaaggacuaaucaaugggaaaagggaaggaaaacgcggcgucgacgcgaacguaaaacuccgcgcaggcacgacagggagcccacuagaacgcgcgaugcaagguaucgaaaagaaagccuucccaggaccgcucagagcccuagcccgccgcgucgucaaagccaacuacaacgacgcccgggaggcacugaaugucaucgccgaggccagccugcuacuaaaaccccaaauaaccaacaaaaugaccaugccauggugcauguggcuagcggcacgccuaacccucaaagacgaguucgcaaacuucugcgcauaugcaggacgccgcgcguucgaagucuucaacaucgcgauggagaaaaucggcauaugcuccuuccaaggcaccaucaugaacgacgacgaaauagaaagcauagaagacaaagcccaaguacuaaugauggcaugcuucggccuagccuaugaagacuucagccuaguaucagcaaugguaagccacccccucaaacuacgcaaccggaugaaaauaggaaacuuccgagucggugaaaagguauccaccguccuaagcccguuacuacgauucacacgcugggccgaguucgcccaaagguucgcccuccaagccaacacauccagagaaggcgcccaaaucagcaacagcgcagucuucgccguagaaaggaaaauaaccaccgacguacaacgcgucgaagaacuucucaacaaaguccaagcgcacgaggacgaaccacuacaaacacucuacaagaaaguccgagagcaaaucucuauaauaggccgcaacaaaagcgagaucaaagaguuccucggauccucaauguacgaccuaaacgaccaggaaaaacaaaaccccaucaacuuccgaagcggagcccaccccuucuucuucgaguucgacccagacuacaacccaauacgagucaaacgacccaaaaagccaauagcuaaacgcaacagcaacauaucacggcuugaagaagaaggaauggacgaaaauagcgaaauaggacaagcaaagaaaaugaaaccacuagaccaacuaaccagcaccuccagcaacauaccagggaaaaac

SEQ ID NO: 58911 - RNA, 1695 nt, Artificial Sequence
  derived and/or modified sequence opt11 from anti-influenza_Chain
auggagaaaaucguccuacucuucgcaauaguaagccuuguaaaaagcgaccagaucugcaucggcuaccacgccaacaacagcaccgaacaaguagacaccauaauggagaaaaacgucaccguaacccacgcccaggacauccuugaaaagaaacacaauggcaaacuaugcgacuuagacggcgucaaaccccucauacuccgugacugcuccgucgcaggcuggcuccuaggcaacccaaugugcgacgaguucaucaacgucccagaaugguccuacaucgucgaaaaagcaaaccccgucaacgaccuaugcuaccccggcgacuucaacgacuacgaagaacucaaacaccuacugucucguauaaaccacuucgagaaaauccaaaucauccccaaguccuccugguccagccacgaagcaucccuuggcgucucuucagcaugcccauaccaaggaaaauccagcuucuuccgaaacgucgucuggcugaucaaaaagaacucaaccuacccgacaauaaaacgcuccuacaacaacaccaaccaagaagaccugcucguacuauggggcauacaccacccaaacgacgccgccgaacaaaccaaacuauaccagaaccccaccacauacauaagcguagggacaagcacacucaaccaacgccucgucccccgaaucgcaacacgcuccaagguuaacggacagagcggccgaauggaguucuucuggaccaucuuaaaaccaaacgaugcuauaaacuucgaaagcaacggcaacuucauagcucccgaauacgcguacaaaaucguuaagaaaggagacuccaccaucaugaaaucagaacucgaauacggaaacugcaacaccaaaugccaaacccccaugggcgccauaaacagcuccaugcccuuucacaauauccacccccucaccauuggagaaugcccaaaauacgucaaauccaaccgccucguccucgccacaggccuccgaaacucaccccaaagagaacgucgacgcaagaaacgcggccucuucggagccaucgcaggauucauagaagguggauggcaaggcauggucgacggcugguacggauaccaccacuccaacgaacaaggcagcggcuacgccgcagacaaagaaucaacacaaaaagcaaucgacggcgugaccaacaaaguuaacucaaucaucgacaagaugaacacacaauucgaagccguaggccgcgaguucaacaaccucgaacgccgaaucgaaaaccucaacaagaaaauggaagacggcuuccucgacgucuggacauauaacgccgaacuacucguccuaauggaaaacgaacgaacccuagacuuccacgacagcaacgucaaaaaccucuacgacaaagugcgucuccaacuacgagauaacgccaaagaacucggcaacggaugcuucgaguucuaccacaaaugcgacaacgaaugcauggaauccguccgcaacggaaccuacgacuacccccaauacuccgaagaagcccgccuaaaacgcgaagaaauauccggcgucaaacucgaaucaauaggcauauaccagauccucagcaucuacuccacaguugccagcucccucgcccuugcuaucaugguagcgggccuaucacucuggaugugcucgaacggcucucuccaaugccgc

SEQ ID NO: 58912 - RNA, 1695 nt, Artificial Sequence
  derived and/or modified sequence opt11 from anti-influenza_Chain
auggagaaaauagugcuccucuuugccaucgugucccuugucaaauccgaccagauaugcaucggcuaccaugccaauaacucuaccgaacaaguagacaccaucauggaaaagaacgucaccgucacccacgcucaagacauccucgagaaaacccacaacggcaaacucugcgaccucgacggcgucaaaccccucauccuucgcgacugcuccguggccggauggcuccugggcaaccccaugugcgacgaguucaucaacgugcccgaaugguccuacaucgucgaaaaagcaaacccagucaacgaucucugcuacccaggagacuucaacgacuacgaagaacuaaaacaccuccuuucccgcaucaaccacuucgagaaaauccaaauuauccccaaaagcucauggagcucucacgaagccagccucggcgucuccuccgccugccccuaccaaggaaaaagcucauucuuucgaaacgucguauggcucaucaagaaaaacuccaccuacccuaccaucaaacgauccuacaacaauacaaaccaagaggaccuccuagugcucuggggaauacaccacccaaacgacgccgccgaacaaacaaaacucuaccaaaaccccaccacauacauauccgucggcacaagcacccuuaaccaacgccucguaccccgcaucgcaacaagaagcaaagucaauggacagagcggccgcauggaauuuuucuggaccauccucaaacccaacgacgccaucaacuucgagucaaacgggaacuucaucgcaccggaauacgcauacaaaaucgucaagaaaggagacagcaccaucaugaaauccgaacuagaauacggcaacugcaacacuaaaugccaaaccccaaugggcgccauaaacuccagcaugccauuccacaacauucacccccuaaccauaggugaaugccccaaauacgucaaauccaaccgccugguccucgccaccggccuucgcaacucaccccaacgagaacgccgccgaaagaaacgcggccucuucggagccaucgccggcuuuaucgaggguggauggcaaggcauggucgacgggugguacggguaccaccacuccaacgaacaaggcuccggcuacgcagcagacaaagaaaguacccaaaaagccaucgacggcgucacaaacaaaguaaacagcauaaucgacaaaaugaacacacaauucgaggccgucggccgcgaguucaacaaucucgaaagacgcaucgaaaaccucaacaagaaaauggaagacggcuuccuugacguauggaccuacaacgcagaacuccucguccucauggaaaacgaacgcacccucgacuuccacgacagcaacgucaaaaaccucuacgacaaaguacgccuacaacuccgagauaacgccaaagaacucggcaacggaugcuucgaguucuaccacaaaugcgacaacgaaugcauggaauccguacgcaacggaaccuacgacuacccccaauacagcgaagaagcacgccugaaacgagaagaaauaagcggcgucaaacuggaaucgauaggaaucuaccaaauccucuccauauacucaacagucgccuccucccucgcccuagccaucauggucgccggccuaagccuauggaugugcucaaacggcagccuccaaugccgc

SEQ ID NO: 58913 - RNA, 1695 nt, Artificial Sequence
  derived and/or modified sequence opt11 from anti-influenza_Chain
auggaaaagaucguccuccuccuagccaucgucucacucgugaaaagcgaucaaauaugcaucggauaccacgcaaacaauuccaccgaacaagucgacaccauaauggagaaaaacguaacggucacucacgcgcaagacauccucgagaaaacccacaauggcaaacugugcgaccucgacggcgucaaaccccucauccuaagagacugcagcguagccggauggcuacuaggaaacccaaugugcgacgaauuuaucaacguacccgaauggucuuacauagucgaaaaagccaaccccgccaacgaccucugcuaccccgguaacuucaacgacuacgaagaacucaaacaccuccucagccgcaucaaucacuucgagaaaauacaaauaaucccuaaaagcuccuggucugaccacgaagccagcuccggcgucuccuccgccugccccuaccaaggcaaauccuccuucuuccgcaacguagucuggcucaucaaaaagaacucaucguaccccaccaucaaacgaucguacaauaacaccaaccaagaagaccuacuuguacucuggggaauacaccacccaaacgacgccgcagaacaaaccagacuauaccaaaaccccaccaccuacaucuccguaggcaccagcacacugaaccaacgacuuguacccaaaaucgcuacucgauccaaagucaacggacaaucaggacgcauggaguucuucuggacgauacuaaaaccaaacgaugccauaaacuucgaauccaacggcaacuucaucgcaccugaauacgccuacaaaaucgucaaaaagggcgacucagcaauaaugaaauccgaacuagaauacggaaacugcaacacgaaaugccaaacaccgaugggagccaucaacucauccaugcccuuccacaacauacacccacuaacaauaggcgaaugcccaaaauacguaaaaagcaaccgccugguacuagccacagggcuccggaacagcccacaacgagaacgccgccgcaagaaaagaggccuguuuggagcgaucgccggauucaucgaaggcggauggcaaggcauggucgacggaugguacggcuaccaucacuccaacgaacaaggaagcgguuacgcagccgacaaagaaagcacccaaaaagccaucgacggagucaccaacaaagucaacuccaucauagacaagaugaacacacaguucgaagcagucggacgcgaguucaacaaccuugaacgucgaauagaaaaccuaaacaaaaagauggaagacggcuuccuagacgucuggaccuauaacgcagaacuccuuguccucauggaaaacgaacgcacacucgacuuccacgauuccaacgucaaaaaccucuacgacaagguccgccuccaacuccgagacaacgcaaaggaacucggcaacggcugcuucgaguucuaccacaagugcgacaacgaaugcauggaaucaguccgcaacggaaccuacgauuacccccaauacagcgaagaagcccgccucaaacgagaagaaaucuccggaguaaaacucgaauccaucggaauauaccaaauacugagcaucuacuccacaguagcgucaucccucgcacuugccaucauggucgccggccuaucgcuauggaugugcucaaacggcucccuccaaugccgc

SEQ ID NO: 58914 - RNA, 1695 nt, Artificial Sequence
  derived and/or modified sequence opt11 from anti-influenza_Chain
augaaggucaaacuccucgucuuacucugcacauucaccgccacauacgcagacacaaucugcaucggcuaccacgcaaauaacucaaccgacaccgucgacacaguacucgagaaaaacgugaccgucacccacagcgucaaccuccuugaaaacucgcacaacggcaaacucugccuccuaaaaggcaucgcaccccuccagcucggcaacugcagcguagccggcuggauccucggaaaccccgaaugcgaacuacucauuaguaaagaaagcugguccuacauaguagaaaaaccaaaccccgaaaacgggaccugcuaccccggccacuucgccgacuacgaggaacuccgcgaacaacucagcuccgucuccaguuucgaaagauucgaaauauuccccaaagaaagcucuuggcccaaccacacugucacaggcguauccgccaguugcagccacaacggagaaucaucauucuaccgcaaccuacuauggcucacaggaaagaacgggcucuaccccaacuuauccaaauccuacgcaaacaacaaagaaaaagaaguccuaguccuauggggcguccaccacccacccaacaucggcgaccaaaaagcacucuaccacaccgaaaacgccuacguuucagucgucagcucgcacuacagccgaaaguucacaccagaaaucgccaaacgucccaaaguccgcgaccaagaaggccgcauuaacuaccacuggacccuacucgaacccggagacacaauaauauucgaagccaacggcaaccuaaucgcaccccgguacgccuucacccuaucccgaggcuucggcuccggcaucaucaacagcaacgccccaauggacaaaugcgacgccaaaugccaaacaccccaaggagcaauaaacagcucccuacccuuccagaacguccacccaguaaccaucggagaaugcccaaaauacguccggagcgccaaacuccguauggucaccggccuacgcaacauacccucaauacagagcagaggacucuucggagccauagcaggauucaucgaaggcggcuggaccggaauggucgacggaugguacggcuaccaccaccaaaacgaacaaggauccggcuacgccgcagaccaaaagucgacccaaaacgcaaucaacggaaucaccaacaaagucaacaguguuauagagaaaaugaacacucaguucaccgcagucggaaaagaguucaauaaacuagaacgucgcauggaaaaccuaaacaagaaagucgacgacggauucaucgacaucuggaccuauaacgccgaacuucuuguccugcuggaaaacgaacgaacccucgauuuccacgacuccaacgucaaaaaccuuuaugaaaaaguaaaaagccagcucaaaaacaacgcgaaagaaaucggaaacggcugcuucgaguucuaucacaaaugcaacgacgaaugcauggaaagcgucaaaaacggcacauacgacuaccccaaauacucggaagaaagcaaacucaaccgagagaaaauagacggcguaaaacuugaaucuaugggcgucuaccaaauacucgccauauacagcaccgucgcaagcucccucguacugcucguaagccugggagcaaucagcuuuuggaugugcagcaacggcucccuccaaugccguaucugcaua

SEQ ID NO: 58915 - RNA, 1695 nt, Artificial Sequence
  derived and/or modified sequence opt11 from anti-influenza_Chain
augaaagucaaacuccugguccuucuaugcaccuucaccgcaaccuacgcagacacaauaugcaucggcuaccacgccaacaacuccacugacacaguagacaccguccucgagaaaaacgucaccgucacacacuccgucaaccuccuagaaaacagucacaacggcaaacuaugccuucucaaaggcauagcaccccuccaacucggcaacugcucagucgccggcuggauacucggaaaccccgaaugcgaauuacucaucuccaaagaauccuggucauacauagucgaaaaacccaaccccgaaaacggaaccugcuaccccggccacuucgccgacuacgaagaacuccgcgaacaacucaguuccgucucgagcuucgaacgcuucgagaucuuccccaaagaauccuccuggcccaaccauacagucaccggcguguccgccucaugcucacacaacggcgaauccagcuucuaccgcaaccuacucuggcucaccggcaaaaacggccuauaccccaaccuaagcaaaucguacgccaacaacaaagaaaaagaaguacugguccuguggggcguccaccacccuccaaacaucggcgaccagaaaacgcucuaccacaccgaaaacgccuacgucucagucgucagcucacacuauagcagaaaauucaccccggaaaucgccaaacgcccaaaaguccgcgaccaagaggggcggauaaacuacuacuggacgcuacuggaacccggugacaccaucaucuucgaagcaaacgguaaccuaaucgcuccccgauacgccuucgcccuuucccgcggcuucggcuccggaaucauaaacuccaacgccccaauggacaaaugcgacgccaaaugccaaacaccgcagggggccaucaacuccagcuuacccuuccaaaacguccacccagucaccauaggagaaugcccgaaauacguccgauccgccaaacuccgcauggucacgggccuccgaaacaucccauccauccaaucccgcggccuauucggcgcaaucgccgguuucauagagggcggcuggacaggcaugguugacggcugguacggauaccaccaccaaaacgagcaaggcucaggauacgccgcagaccagaaaucaacccaaaacgcaauaaacgggauaacgaacaaagucaacuccguaaucgagaaaaugaacacccaauucacugcggucggaaaagaguucaacaaacuggaacgucgcauggaaaaccucaacaagaaagucgacgacggauucauagauauauggacauacaacgccgaacuccuuguacuacucgaaaacgaacgcacgcuugauuuccacgauucaaacgucaaaaaccuuuacgaaaaagucaaaucacaacucaaaaacaacgccaaagaaauaggcaacggcugcuucgaguucuaccacaaauguaacgacgaaugcauggaaucggucaaaaacggaaccuacgacuacccaaaauacuccgaagaaagcaaacucaaucgagaaaagaucgacgggguaaaacuagaauccaugggcguauaccaaauacuggcaaucuacagcaccgucgcaucaagccucguccuacucgucagccuaggggcuaucagcuucuggaugugcucaaacggaucacuccaaugccggaucugcaua

SEQ ID NO: 58916 - RNA, 1695 nt, Artificial Sequence
  derived and/or modified sequence opt11 from anti-influenza_Chain
augaaaguaaaacuacucguccuccucugcacauucaccgccacauacgcagacaccauaugcaucggcuaccacgcaaacaacagcaccgacaccgucgacacaguccucgaaaagaacgucaccgugacccacagcgugaaccuccucgaaaacucucacaacgguaaacucugccuccucaaaggcaucgccccucuacaacuaggaaacugcagugucgccggauggauacugggcaacccagaaugcgaacucuuaaucuccaaggaaucauggagcuacaucguagaaaaacccaacccggaaaacgguaccugcuacccaggccacuucgccgacuacgaagaacuccgcgaacaacuuagcuccguauccagcuucgaaagauucgaaauauucccaaaggaauccucuuggcccaaccacaccguaacaggcgucagcgcgucuugcucccacaacggagaauccuccuucuaccguaaccuccuauggcuaaccggcaagaacggccucuaccccaaccuauccaaauccuacgccaacaacaaagaaaaagaaguccucguacucuggggcguacaucacccacccgacaucggagaccagaaaacgcucuaccacaccgaaaacgccuacgucuccgucgucuccagccacuacucccgcaaauucacccccgaaaucgcaaaaagacccaaaguccgcgaccaagaaggacgcaucaacuacuacuggacccuacucgaacccggagacacaauaaucuucgaggcaaacggaaaccucaucgccccacgauacgccuuugcucucucccgcggcuucggaagcggaaucauuaacagcaacgccccaauggacaagugcgacgccaaaugccaaaccccacaaggcgccaucaacuccucccuacccuuccaaaacguacacccaguaacaaucggagaaugcccaaaguacguccguagcgcaaaacuccgcauggucaccggccuccguaacauaccgagcauacaaucccgcggucucuucggcgcuaucgccggcuucaucgaaggcggcuggacaggaauggucgacgggugguacggcuaccaccaccaaaacgaacaaggcuccggauacgccgccgaccagaaaagcacacaaaacgccaucaacggaaucaccaacaaaguaaacagcguaauagagaaaaugaacacccaauucaccgccguaggcaaagaguucaacaaauuagaacgacguauggaaaaccucaacaagaaagucgaugacgguuucaucgacaucuggacauauaacgccgaacuccuuguacuacucgaaaacgaacgcacacucgacuuccacgacucaaacgugaaaaaccucuacgaaaaaguaaaaucacagcuaaagaacaacgccaaagaaaucggcaacggcugcuucgaguucuaccacaagugcaacgacgaaugcauggaaucugugaaaaacggaaccuacgacuaccccaaauacuccgaagaaagcaaacuaaaccgagaaaagaucgacggcguaaaacucgaauccauggguguguaucagauccucgccauauauucgaccgucgccuccucccuaguccuccuagucucccuaggcgcaaucagcuucuggaugugcagcaacggaucccuacaaugccgaauauguauc

SEQ ID NO: 58917 - RNA, 1695 nt, Artificial Sequence
  derived and/or modified sequence opt11 from anti-influenza_Chain
augaaaguaaaacuacucguccuccucugcaccuucaccgcaacuuacgccgacacaauaugcaucggcuaccacgcgaacaacagcaccgacacagucgacaccguccucgagaaaaacguaaccgucacccacucagucaaccuccuugaaaacucccacaacggaaaacucugccuacuaaaaggcaucgcaccccuacagcucggcaacugcucagucgccggcuggauccucggcaacccggaaugcgaacuucuuaucagcaaagaaucauggucuuacaucguagaaaaacccaacccugaaaacggcacuugcuaccccggccauuucgcugacuacgaggaacuacgugaacagcucucaagcgucucauccuucgaaagauucgaaaucuuccccaaagaauccagcuggccaaaccacaccgucaccggcguguccgcaagcugcagccacaacggcgagagcucauucuaccgcaaccucuuauggcucacagguaaaaacggacucuaccccaaccuuuccaaaaguuacgcgaacaacaaagagaaagaaguccugguacuauggggcguccaccaucccccaaacaucggcgaccaaaaagcgcuauaccacacagaaaaugccuacgucucagugguaagcucccacuacucacgcaaauucacacccgaaauagccaaaagaccaaaaguccgagaccaagaaggcaggauaaacuacuacuggacccuccuagagccaggcgacaccaucauauucgaagccaacggaaacuuaauagccccgcgauacgcauuugcccucucccgaggauuuggcuccggaaucaucaacagcaacgcccccauggauaaaugcgacgccaaaugccaaacuccccaaggcgccaucaacucuucacuuccguuccaaaacguccaccccguaaccaucggagaaugccccaaauacguacgauccgcuaaacucagaauggucaccggccuccgaaacauaccauccauccaaucucgcggccucuuuggugcgaucgccggcuucaucgaaggcggauggaccggaauggucgacggaugguacggcuaccaccaccaaaacgaacaaggcuccggcuacgccgccgaccaaaaauccacccaaaacgccaucaacggaauuaccaacaaagucaacuccgucaucgagaaaaugaacacccaauucaccgcagucggaaaagaguucaacaaacuggaacgccgcauggaaaaccuaaacaagaaagucgaugacggauucaucgacaucuggaccuacaacgccgaacuccuuguccuacucgaaaacgaacgcacccucgauuuucacgacuccaacgucaaaaaccucuaugaaaaaguaaaaagccagcucaaaaacaacgccaaggaaaucggcaauggcugcuucgaguucuaccacaagugcaacgacgaaugcauggaaaguguaaagaacggaaccuacgacuacccaaaauacucagaagaauccaagcuaaaccgagaaaagauagacggcguaaaacuagaauccaugggcgucuaccaaauccuagcuauauacuccaccgucgccuccucccugguacuccucguaagccugggcgcaaucucauucuggaugugcuccaacggcucccuucaaugccgcaucugcauc

SEQ ID NO: 58918 - RNA, 1695 nt, Artificial Sequence
  derived and/or modified sequence opt11 from anti-influenza_Chain
augaaggcaaaacuauuaguccuacuaugcaccuucaccgcaacauaugccgacaccaucugcaucggcuaccacgcaaacaacuccaccgacacaguagacacaguccucgagaaaaacgucaccgucacccacuccgugaaccuccuggaagacucccacaacggcaagcuaugccuacucaaaggcauagcuccccuccagcucgggaacugcuccgucgccggcuggauccucggcaaccccgaaugcgaacuacuaauauccaaagaauccugguccuacaucguagaaacgcccaacccggaaaacggaacaugcuaccccggauacuucgccgacuacgaagaacuacgcgaacaauuauccuccgucucauccuuugaacgcuucgaaaucuucccaaaagaaucaagcuggccuaaccacaccguaacaggugucagcgcguccugcagccacaacgggaaaucguccuucuaccgcaaccuccuuuggcuaacgggcaagaacggacucuacccaaaccucucaaaauccuacguuaacaacaaagaaaaagaaguucuuguccuauggggcguccaccauccacccaacaucggcaaccaaagagcacucuaccacaccgaaaaugccuacgucagcguagucagcucccacuacucccgccgcuucacacccgaaaucgcaaagcgccccaaaguccgcgaccaagaaggacgcauaaacuacuacuggacacuccuggaacccggagacaccaucaucuucgaagcgaauggaaaccucauagcccccugguacgcguucgcacugucacgaggcuucgggagcggcaucaucaccuccaacgcacccauggacgaaugcgacgcaaaaugccaaacaccacaaggagcaaucaacucaucccucccauuucaaaacguacacccagucaccaucggcgaaugccccaaauacguacguagcgccaaacuucgcaugguaaccggccugcgcaacauacccuccauccaaucacgcggacuauucggcgcaauagccggcuucaucgaaggcggcuggacaggcaugguagacggcugguacggcuaccaccaccaaaacgaacaaggaucaggauacgcagcugaccaaaagaguacccaaaacgcaaucaacggcaucaccaacaaaguaaacagcgugaucgagaaaaugaacacccaauucacagccgucggcaaagaguucaacaaacucgaaagacgcauggaaaaccuaaacaagaaagucgacgacggauuccucgacaucuggacauacaacgccgaacuccucguccuacuggaaaacgaacguacacucgacuuccacgacagcaacgucaaaaaccuauacgaaaaagucaaaucacaacucaaaaacaacgccaaagagaucggcaacggcugcuucgaguucuaucacaaaugcaacaacgaaugcauggaaucagucaaaaacggaacauacgacuaccccaaauacuccgaagaaucuaaacucaacagagagaaaauagacggaguaaaacucgaaagcaugggaguauaccaaauacucgccaucuacucaaccguagccucgucccugguccuccuagucucacuaggagccaucuccuuuuggaugugcagcaacggaucccuccaaugcagaauaugcauc

SEQ ID NO: 58919 - RNA, 1695 nt, Artificial Sequence
  derived and/or modified sequence opt11 from anti-influenza_Chain
augaaggucaagcuccucguccuacugugcaccuucacagcaacuuacgccgacaccaucugcaucggcuaccacgccaacaacagcacagacacaguagacaccguccucgaaaagaacgucaccgucacacacuccgucaaccuccuagaagacagccacaacggcaagcuaugccuccugaagggaauagcaccacuacaacuaggcaacugcucagucgcaggauggauccucgggaaccccgaaugcgaacuccucauaucccgagaauccuggucauauaucguagaaaaacccaaccccgaaaacggaaccugcuaccccggccacuucgccgacuacgaagaacuccgagaacaacuaucgucugucuccuccuucgaacgcuucgaaaucuuccccaaagaaucgaguuggcccaaccacaccaccacgggcguguccgccagcugcucccacaacggcgaauccagcuucuacaaaaaccuccuauggcucacuggcaaaaacggccucuacccgaaccucagcaaaucguacgccaacaacaaagagaaagaaguccucguccuauggggcguccaucacccgcccaacaucggggaccaacgcgcccuauaccacaaagaaaacgccuauguuuccguagucagcucucacuacuccaggaaauucaccccugaaaucgcuaaacgucccaaaguccgcgaccaggaaggccgcauaaacuacuacuggacacuacucgaacccggcgacacaaucaucuucgaagccaacggcaaccuaaucgcuccccgcuacgccuucgcccucucccggggauucggcuccggcaucaucaacucuaacgcccccauggacgaaugcgacgccaaaugccaaacaccccagggagccauaaauucgagccucccauuccaaaacguccaccccgucacaauaggcgaaugccccaaguacguccgcucagccaaacucagaauggucacaggacuucgaaacauccccagcauacaaucccgcggccucuucggcgccauagccggcuucaucgaaggaggauggacuggcauggucgacggcugguacggcuaccaccaccaaaacgaacaaggaagcggcuacgccgcagaccaaaaauccacccagaacgcaaucaacggcaucaccaacaaagucaacagcgucaucgagaaaaugaacacccaauucacagccguaggcaaagaguucaacaaacucgaacgacgaauggaaaaccucaacaagaaagucgacgacggauucaucgacaucuggaccuacaacgccgaacuacucguacugcucgaaaacgaacgcacacucgacuuccacgacuccaacgucaaaaaccucuaugaaaaaguaaaaagucaacucaaaaacaacgcuaaagaaaucggaaacgggugcuuugaguucuaccacaagugcaacgacgaaugcauggaaucggucaaaaacgguaccuaugacuaucccaaauacucugaagaaucaaaacuaaaccgagagaaaaucgacggaguaaaacucgaaagcaugggcguauaccagauccuugcaaucuacuccaccguugccuccucacucguccuacucguaagccucggcgccaucucauucuggaugugcagcaacggcucccuccaaugcagaauaugcaua

SEQ ID NO: 58920 - RNA, 1698 nt, Artificial Sequence
  derived and/or modified sequence opt11 from anti-influenza_Chain
augaagacaaucaucgcacuauccuacauucucugccuaguauucgcccaaaaacuccccggcaacgacaacucaaccgccacacuaugucuaggccaccacgccguaccaaaugggacaauagucaaaaccaucaccaacgaccaaaucgaagucacuaacgcaaccgaacucguccagaguuccucgacaggcggcauaugugacucuccucaccaaauacucgacggcgaaaacugcacccucauugacgcacuccucggagacccgcaaugcgacggauuccaaaacaaaaagugggaccuauucguggaaagauccaaagccuacucaaacugcuaccccuacgacguucccgacuacgcaucacuccgcucccuuguagccagcuccggcacacucgaguucaacaacgaaucauucaacuggaccggcguuacccaaaacggaaccagcucagccugcaaacgccgauccaacaacagcuucuucagccgacucaacuggcucacccaucucaaauucaaauacccugcccuaaaugucaccaugcccaacaacgaaaaauucgacaaacuuuacaucuggggcgugcaccaccccgggaccgacaacgaccagauuagccucuacgcccaagcauccggucgcaucacagucagcaccaaacgcucccaacaaaccguuauacccucgaucggaucuagaccccgcauacgcgacguacccucgcgcaucuccauauacuggacaaucgucaaaccaggcgacauccuccuaaucaacuccaccggcaaccucaucgcaccccggggcuacuucaaaauccgcuccggaaaguccuccaucaugagauccgacgcccccaucggaaaaugcaacucagaaugcauaacccccaauggaagcauccccaacgacaaacccuuccaaaacguaaaccgaauaaccuacggcgccugcccucgauacgucaaacaaaacacacuaaaacucgcaaccggaaugcgcaacguaccggaaaaacaaacccgcgggauauucggcgccaucgccggcuucaucgaaaacgggugggaaggaauggucgacggcugguacggcuuccgccaccaaaacucagaaggcaccggacaagcugccgaccucaaaagcacacaagccgccauaaaccaaauaaacggcaaacucaaccgacucauaggaaaaacaaacgaaaaguuccaccaaaucgaaaaagaguucucugaagucgaaggacgcauccaagaucuagaaaaauacguagaagacacaaaaauagaccucuggagcuacaaugccgaacuccuugucgcccucgaaaaccaacacaccaucgaccucacugacuccgaaaugaacaagcuauucgaaagaaccaagaaacaacucagagaaaaugcggaagacaugggcaacggcugcuucaaaaucuaccacaagugcgauaacgcgugcaucggcuccauccgaaacggcaccuacgaccacgacguauaccgagacgaagcgcugaacaaccgcuuccaaaucaaaggagucgaacucaaauccggauacaaggacuggauccuauggauauccuucgccaucuccugcuuucuucuaugcgucgcccuccucgguuucaucaugugggccugccaaaaagggaacauccgaugcaacaucugcaua

SEQ ID NO: 58921 - RNA, 1698 nt, Artificial Sequence
  derived and/or modified sequence opt11 from anti-influenza_Chain
augaaaaccauuaucgcguuauccuacauccucugucucguaagugcccaaaaauucccaggcaacgacaacucaacagccacacucugucuuggacaccacgccguccccaacggaaccauuguaaaaacaauaaccaacgaccaaaucgaaguaaccaacgccacagaacuaguccaauccucaucaaccggcgaaaucugugacucaccacaucaaauccucgacggcgaaaauugcacccugaucgacgcccugcugggagacccccaaugcgacggauuccaaaacaaaaaaugggaccuauucguagaacgcuccaaggccuacuccaacugcuaccccuacgacguucccgacuacgcaucccuacgaucccuaguagccuccagcggcacucucgaauucaacaacgaauccuucaacuggacaggagucacgcaaaacggcaccuccagcgccugcauccgccgcuccaacaacucguucuucagccgacugaacuggcuaacccaccucaaauucaaguacccagcacucaacguaacuaugcccaacaacgaagaguucgacaaacucuacaucuggggcguccaccacccugggaccgacaacgaccaaaucuuccucuacgcccaagccucaggacgcaucaccguuaguaccaagcgaagccaacaaaccgucaucccgaacaucaggagccgcccacgcguuagaaacauacccucacgcaucagcaucuacuggaccauagucaagcccggcgacauacuccuuauaaacuccacaggcaaccuuauagcaccaagaggauacuucaaaauccgcucagguaaauccuccauaaugagaucagacgcuccaaucggaaaaugcaacagcgaaugcaucaccccaaacggcucaauaccaaacgacaaaccauuccaaaacgucaaccgaaucaccuacggcgccugcccccguuacgucaaacaaaacacccuaaaacucgcuacgggaaugagaaacgucccagaaaaacaaacccgaggcauauucggagcaaucgccggcuucaucgaaaacggcugggaaggaaugguagacggcugguacggauuccgccaccaaaacucggaaggcaucgggcaagccgccgaccucaaauccacacaggcagcaaucgaccaaauaaacggcaaacuaaaccgccuaaucggaaaaaccaacgaaaaguuccaccaaaucgaaaaagaauucucggaagucgaaggacgcauccaagaucucgaaaaauacguagaagacaccaaaauagaccugugguccuacaacgcugaacuccucgucgcccucgagaaccagcacaccaucgaccucacagauuccgaaaugaacaaacucuucgaaaagaccaaaaaacaacuccgagaaaacgccgaagacaugggaaacggaugcuucaaaaucuaccauaaaugcgacaacgccugcaucgguuccauucgaaacggaacuuacgaccacgacguauaccgcgacgaagcccuaaauaaccgcuuccaaaucaaaggcgucgaauuaaaaagcggauacaaagacuggauccucuggauaagcuucgccaucuccugcuuccuccuaugcgucgccuuacucggcuucauaaugugggcaugccaaaaaggaaacauacgaugcaacauaugcauc

SEQ ID NO: 58922 - RNA, 1698 nt, Artificial Sequence
  derived and/or modified sequence opt11 from anti-influenza_Chain
augaaaaccaucaucgcacucagcuacauccucugucucgucuucgcccaaaaacuccccggaaacgacaacuccacggccacucucugccucgggcaccacgccguccccaacggaacaaucgucaaaaccaucacaaacgaccaaauugaagucacaaaugccaccgaacugguacaaagcagcagcaccggcgaaauaugcgacuccccacaccaaauccuggacggcgaaaacugcacccucaucgacgcccuccuaggcgacccccaaugugauggguuccaaaacaagaaaugggaccucuucgucgaacgcuccaaagcauacucaaacugcuaucccuacgacguccccgauuacgcaagccuacgcagccucgucgcauccuccggcacccuggaguucaagaacgaaucauucaacuggaccggcguuacacaaaacggcacgagcagcgccugcauccgccgcuccaacaauuccuucuucucccgccucaauuggcucacccaccuuaaauuuaaguaccccgcccucaacguaacaaugcccaacaaagaaaaauucgacaaacuuuacaucuggggcguccaccaccccggaacagacaacgaccaaaucuuccucuacgcccaagccucaggacgcaucaccguaagcaccaaacgaucucaacaaacaguaaucccaaacaucggcucccgccucagaguccgcgacauccccagccgcaucuccaucuacuggacaauaguaaaaccaggagacauccuccuaauaaacagcacaggaaaccuaaucgcaccccgaggauacuucaaaauccgcagcggcaaguccuccauaaugcguuccgacgccccaaucggaaaaugcaacucagaaugcauaacacccaacggauccauccccaacgacaagcccuuccaaaacgucaaccgaauaacauacggagccugcccccguuacguaaaacaaaacacacucaaguuggccaccggaaugcgcaacguccccgaaaaacaaacacgcgguaucuucggcgccaucgccggauucaucgaaaacggaugggaaggcauggucgacggaugguacggauucagacaccaaaacucagaaggcacaggccaagcggcagaccucaaauccacgcaagcggccaucgaccagaucaacggaaaacuuaacagacuaaucggcaaaaccaacgaaaaauuccaccaaaucgaaaaggaguucucagaaguagaaggacgcauccaagaccucgaaaaauacguagaagacacaaaaaucgaccuauggucauacaacgcggaacuccucgucgcccuagaaaaccaacacacgaucgaccuaacggacagcgaaaugaacaaacucuucgagaaaacgaagaaacaacuccgggaaaacgccgaagacaugggcaacggcugcuucaagaucuaccacaagugugacaacgccugcauaggaaguauccgcaaugggaccuacgaccacgacguauaucgggacgaagcccuaaacaaccgauuccaaaucaagggagucgagcucaaguccggcuauaaagacuggauccuauggauaucauucgccaucuccugcuuccuccuaugcguagcccuccuaggcuucauaaugugggccugccaaaaaggcaacauccgaugcaacaucugcaua

SEQ ID NO: 58923 - RNA, 1698 nt, Artificial Sequence
  derived and/or modified sequence opt11 from anti-influenza_Chain
augaaaaccaucaucgcccucagcuacauccucugccuagucuucgcccaaaagcuccccggaaacgacaacaguacagccacacucugccucggccaccaugccgugcccaacggcacaaucgugaaaacaauaacaaacgaccaaauagaagucaccaacgcaacugagcuaguccaaucaucaagcaccggcgaaauaugugacaguccccaccaaauacucgacggagaaaauugcacccucauagaugcccuucuaggcgacccccagugcgacggauuccaaaacaaaaagugggaccuauucguggaacgcuccaaagccuacuccaaaugcuacccauacgacgucccagacuacgccucccuaagaucccuuguagccuccuccggcacccucgaguucaacaacgaauccuucaacuggaccggcgucacacaaaacggaaccuccagcgccugcauccgccgauccaacaacagcuucuucucccggcuaaacuggcucacccaccucaaauucaaauacccagcccucaaugucacaaugcccaacaaugaaaaauucgauaaacucuacaucuggggcguccaccacccaggcaccgacaacgaccaaaucuuccucuacgcgcaagcgagcggacgcauaaccgucucaaccaaacggucccaacaaacaguaaucccgaacaucggcucacgcccucgaguccgcgacauccccucccgcaucagcaucuacuggaccauagucaaaccaggcgacauccuccuaaucaacagcacaggcaaccuaauagcgccccgcggcuacuucaaaauccguucaggaaaguccagcaucaugcgcuccgaugccccaaucgguaaaugcaacucagaaugcaucacccccaacggcuccauccccaacgacaaacccuuccaaaacgucaaccgcauaacauacggagccugccccagauacguaaaacaaaacaccuugaaacuagcaaccggaaugcgaaacguccccgaaaagcaaacccguggaaucuuuggagccaucgccggcuucauagagaacggcugggaaggcauggucgacggcugguacggcuuccgccaccagaacuccgaaggcaucggccaagcagccgaccucaaauccacccaagccgccaucgaccaaaucaacgguaaacucaaucgucuaaucggcaaaacaaacgagaaguuccaccaaauagaaaaagaguucucagaggucgaaggccgcauccaagaccucgaaaaguacguggaagacacaaaaauagaccuaugguccuacaacgccgaacuacucguagcccuagagaaccagcacaccaucgaccugacagacuccgaaaugaacaaacucuucgagaaaaccaagaaacaacuccgcgaaaacgccgaagacauggguaacggcugcuucaaaaucuaccacaaaugcgacaacgccugcauaggcucaaucaggaacggaacauacgaccacgacguauaccgugacgaagcacuaaacaaccgguuccaaauuaaaggaguagaacucaaauccggauacaaagacuggauccuguggaucuccuucgccaucuccugcuucuuacucugugucgcccuccugggauucauaaugugggcaugucagaaaggaaacauccgcugcaacauauguauc

SEQ ID NO: 58924 - RNA, 1698 nt, Artificial Sequence
  derived and/or modified sequence opt11 from anti-influenza_Chain
augaaaacuauuaucgcacuauccuacauccuaugccucguuuucgcacagaagcucccugguaacgacaacaguaccgccacccuaugccuaggccaccacgccguacccaacggaacaaucguaaaaacaauaaccaacgaccaaaucgaagucacaaacgccaccgaacucguacaauccucaucaaccggcgaaaucugcgacucaccccaccaaauccuagacggagaaaacugcacccuaauagacgcccuacucggcgacccccaaugcgacggcuuccagaacaagaaaugggaccucuucguagaacgauccaaagccuacagcaacugcuaccccuacgacguccccgacuaugcuucccuacgaagccucgucgccuccuccggcacccucgaguucaacaacgaauccuucaacuggaccggcgucacccaaaacggcacauccuccgccuguauccgccgcagcaacaacuccuucuucucccggcuuaacugguuaacccaccucaaauucaaauaccccgcacucaacgucacuaugccuaacaacgaaaaauucgacaaacuauacauauggggcgugcaccaccccggcacagacaacgaccaaaucuuccuauacgcacaagcaucaggccgaauaacagucuccacaaaacgaucccaacaaacagucauccccaacauaggcucccgcccacggguccgaaacaucccuucccgcaucuccaucuacuggaccaucgucaaacccggcgacauucuccucaucaacagcaccggaaaccuaauagcuccacggggcuacuuuaaaauacgaucaggcaaaagcuccauaaugcgcucagacgcacccaucggcaaaugcaacucagaaugcauaacuccaaacggcuccaucccuaacgacaaaccauuccaaaacgucaaccgaauaacauauggugccugcccccguuacgucaaacaaaacacacucaaacuagcaacaggcaugcgcaacguacccgaaaaacaaacacgcggaauuuuuggcgcaaucgccggauucaucgaaaacggcugggaaggcauggucgacggcugguauggauuccgccaccaaaacucagaaggaaucgggcaagcagcugaccucaaauccacacaagcagccaucgaccaaaucaacggcaagcucaaccggcucaucggcaaaaccaacgaaaaauuccaucaaaucgaaaaggaguucuccgaaguagaaggccgcauccaagaccuagaaaaauacgucgaagacaccaaaaucgaccuauggucuuacaacgcagagcuccucguugcccuagaaaaccaacacacgaucgaccuaaccgacucagaaaugaacaaacucuucgagaaaacaaagaaacaacuuagagaaaacgcagaagacauggggaacggcugcuucaaaauauaccacaaaugcgacaacgccugcaucggaagcauccgcaaugggaccuacgaccacgacgucuaccgcgacgaagcucuaaacaaccgauuccaaauaaagggagucgaacucaaaagcggcuacaaggacuggauacucuggaucucauuugccauaucaugcuuccuccuuugugucgcacuacuaggauucauuaugugggccugccaaaaaggcaacauccgaugcaacaucugcauc

SEQ ID NO: 58925 - RNA, 1698 nt, Artificial Sequence
  derived and/or modified sequence opt11 from anti-influenza_Chain
augaagaccauaaucgcccucuccuauauccuaugccuaguauucucccaaaaacugccaggaaacgacaacaguacagccacccucugccuaggacaccacgcaguccccaacggaaccauagucaagacaaucaccaacgaccaaauagaagucaccaacgccaccgagcucguccaaucuagcucaacaggcgguaucugcgacucaccccaccaaauccuagacggagaaaacugcacccuaaucgacgcacuccucggagacccgcaaugcgacggcuuccaaaacaagaaaugggaccucuucguagaaagauccaaagccuacagcaacugcuaccccuacgacgucccagacuacgccagccuacgaucacucgucgccuccagcgguacccuagaguucaacaacgaauccuucaacugggccgguguaacccaaaacggcaccucaucggccugcaagcgccgaucaaacaaguccuucuucucccgacucaacuggcucacccaccuaaaauacaaauaccccgcccucaacguaacaaugccaaacaacgaaaaauucgacaagcucuacauauggggcguccaccaucccguaaccgacucagaccaaaucucucuauacgcacaggcaagcggccgcauaacaguauccacgaaacgcucacaacagaccgucauccccaacauaggcuaccgccccagaguacgcgacauaagcucccgaauaagcauuuacuggacaauaguaaaacccggagacauacuccucaucaacaguacgggcaaccuaaucgcaccccgaggauacuucaaaauacgcagcggcaaauccucaaucaugcgguccgacgcacccaucggaaaaugcaacagcgaaugcauaacccccaacggcuccaucccaaacgacaaaccguuccaaaacgucaaccgcauaaccuacggcgccugcccccgguacgucaaacagaacacucuaaaacucgcuaccggcaugcgaaacgucccagaaaaacaaacccgcggcaucuucggagccaucgcaggcuuuaucgaaaacggcugggaaggcaugguagacggaugguacggauuccgccaccagaacuccgaaggcaccggccaagccgcagaccuaaaauccacacaggccgccaucaaccaaauuaacggcaaacuaaaccgccuuauaggcaaaaccaacgagaaauuccaccaaauugaaaaggaguucuccgaagucgaaggucgcauccaagaccuugaaaaauacgucgaagacaccaaaaucgaccucuggagcuauaacgcggaacuccuagucgcccucgaaaaccaacacacaaucgaccugacagacagcgaaaugaacaaacuauucgaacgcaccaagaaacaacuaagagaaaacgccgaagacaugggaaacggcugcuucaaaauuuaccacaaaugcgacaacgcgugcaucgaauccauccgcaacgggaccuacgaccacgacgucuaccgugacgaagcccuaaacaaccgcuuccaaauuaaaggagucgaacucaaaagcggcuacaaagacuggauccuguggauauccuucgcaauuagcugcuuccuccuuugcgucgcucuccuaggcuucaucaugugggccugccaaaaaggaaacauaagaugcaacauauguauc

SEQ ID NO: 58926 - RNA, 1698 nt, Artificial Sequence
  derived and/or modified sequence opt11 from anti-influenza_Chain
augaagaccauaauagcacuauccuacauccuaugccugguauucgcccagaagcucccgggaaacgacaacuccacagccacacucugccuaggccaccacgcaguacccaacggcaccaucgucaaaaccaucacaaacgaccaaaucgaagucaccaacgccacagaacucguccaguccucaucaaccggcggcauuugcgacuccccacaccaaauccuugacggcgagaacuguacccugaucgacgcccuucucggcgacccccaaugcgacggauuccaaaauaagaaaugggaccucuucgucgaacgaucaaaagccuacuccaacugcuaccccuacgacgucccugacuacgccucccuccgcucgcucgucgcaucauccggaacccuagaguucaacgacgagagcuucaacuggaccggagucacccaaaacgggaccagcuccuccuguaaacgcagaagcaacaacuccuucuucucccgacucaacuggcucacacaccuaaaauucaaauaccccgcucuaaacgucaccaugccaaauaacgaaaaauucgacaaacucuacaucuggggaguccaccaccccguaacugacaacgaccaaaucuuccuuuacgcccaagccuccggacgcaucaccgucuccacaaaacgcucccagcaaaccgucauacccaacaucggcagcagaccacgcauccgaaacauacccucccgcauauccaucuacuggaccauagucaaacccggagauauccuucuaaucaacucaaccggcaaccugaucgcaccucgaggauacuucaaaauccgaagcggcaaauccucgauaaugcggucagacgcgccgaucggcaaaugcaacuccgaaugcauuacccccaacggauccaucccaaaugacaaacccuuccaaaacgucaaccgaaucacauacggcgccugcccccgcuacguaaaacagaacacccuaaaacuagcaaccggcaugagaaacguaccagaaaaacaaacccgcggcaucuucggcgccauagccggguucaucgaaaacggaugggaaggcaugguugacggcugguacggcuuccgccaccaaaacuccgaaggcauaggccaagcagccgaucucaagucaacccaggccgccauaaaccagauuaacggcaagcucaaccggcuaaucggcaaaacaaacgaaaaauuccaccaaauagaaaaagaguucuccgaagucgaaggaagaauccaagaccucgaaaaauacgucgaagacacaaaaaucgaccucugguccuacaacgccgaacuccuagucgcacuagaaaaccaacacacaaucgaccucacagacuccgaaaugaacaaacuauucgaacgcaccaaaaagcaacuccgggaaaacgcggaagacaugggcaacggcugcuucaagauuuaccacaaaugcgauaacgcaugcaucggcucaauccggaacggcaccuacgaccacgacgucuaccgagacgaagcccuaaacaaccgauuccaaauaaaaggagucgaacuuaaaucaggguacaaagacuggauccuauggaucuccuucgccauauccugcuuccuucuaugcguggcccuucuaggcuucaucaugugggccugccaaaaaggaaacauccguugcaacauaugcauc

SEQ ID NO: 58927 - RNA, 1698 nt, Artificial Sequence
  derived and/or modified sequence opt11 from anti-influenza_Chain
auggaaaagaucguccuccuccucgccaucguaucacucguaaaaucagaucaaaucugcauaggcuaccacgcaaacaacuccaccgaacaaguagacaccaucauggaaaaaaacgucaccguaacccacgcucaagacauacuagaaaaaacacauaacggcaaacuaugcgaccucgacggagucaaaccacucauacuacgagacugcucagucgcaggcuggcuacuagggaaccccaugugcgacgaauucaucaaugucccagaaugguccuacauagucgaaaaagccaaccccacaaacgaccugugcuacccaggaagcuucaacgacuacgaagagcuaaaacaccuccucuccagaaucaaccacuucgaaaaaauccaaaucaucccuaaauccucaugguccgaccacgaagcaagcuccggcguuucauccgcaugccccuaccuaggcuccccaucauucuuccgaaacgucguauggcucaucaaaaaaaacagcacauacccgacaauuaaaaaaucauacaacaacacaaaccaagaagaccuacucguccuaugggguauccaccacccuaacgacgcagccgaacaaacacggcucuaccagaacccuaccaccuacaucuccauaggcaccuccacccucaaccaacgucuagugccgaaaaucgcaacacguucuaaagucaauggacaaagcgggcgcauggaauucuucugggccauacucaaaccaaacgacgcaaucaacuucgaguccaacggcaacuucaucgcaccagaauacgccuacaaaaucguaaaaaaaggcgacuccgcaaucaugaaguccgaacucgaguacgguaacugcaacacuaaaugccaaacccccaugggcgccauaaacucaucaaugcccuuccauaacauacacccacucacuauaggagaaugcccaaaauacgucaaauccaaccgacucgugcucgccaccggccuccgaaacuccccccaacgcgaaucccgacgcaaaaagcgaggauuguuuggggcgaucgccggauucaucgaaggcggcuggcaagguauggucgacggcugguacggauaccaccacagcaacgaacagggcuccggcuacgccgccgacaaggaaucaacacaaaaagccauaggagucacuaacaaagucaacuccauaaucgacaaaaugaacacccaauucgaagcggucggcagagaauucaacaaccucgaacgccgcauagaaaaccuaaacaaaaaaauggaagacggauuccuagacgucuggaccuacaacgccgagcuccucguacuaauggaaaaugaacgaacccuugacuuccacgacuccaacgucaaaaaccucuacgacaagguccgacuacaacuccgagacaacgccaaagaacugggcaacggaugcuucgaauucuaccacaaaugcgacaacgaaugcauggaauccauccgaaacggcaccuacaacccccaauauagcgaagaagcccgacucaaacgagaagaaaucuccggagucaaacuagaauccaucggcaccuaucagauccucucaaucuacagcaccgucgcaucaucacuagccuuagccauaaugauagccggccucucccucuggaugugcucgaacggcucacuccagugccgcauaugcauc

SEQ ID NO: 58928 - RNA, 1698 nt, Artificial Sequence
  derived and/or modified sequence opt11 from anti-influenza_Chain
augaaagcaauccuaguaguccuacuauacacauucgccacagccaacgcagacacccucugcaucggauaccacgccaacaacuccacagauaccgucgacacaguauuagagaaaaacgucaccgucacccacuccgucaaccuccucgaagacaaacacaacggcaaacucugcaaacuacgcgggguagcaccccuccaccuagggaaaugcaacaucgccggcuggauccucggaaaccccgaaugcgaaucccucuccaccgcaucuucaugguccuacaucgucgaaacauccuccagcgacaacgguacaugcuaccccggcgacuucaucgacuacgaagaacuacgcgaacaacucucauccgucagcuccuuugagcgcuucgagauauucccaaaaaccagcucuuggcccaaccacgacagcaacaaaggcgucaccgcagccugcccccacgccggagccaaaucauucuacaaaaaccucauauggcucgucaagaaaggcaacucguaccccaaacucucgaaaucauacaucaacgacaaaggcaaagagguacugguccucuggggaauccaccacccaucgacgucagcugaccaacaaagucucuaccaaaacgcagacgcauaugucuucgucggaacaucccgauacucaaagaaauucaaacccgagaucgccauccgccccaaaguacgcgaccaagaaggaagaaugaacuacuacuggacccucguagaaccaggcgauaaaauaacauucgaagcaaccggcaaccuagucgucccccgauacgcauucgccauggagcgaaacgcgggcuccggcaucaucaucagcgacacccccguccacgauugcaacacaaccugccaaacccccaaaggcgccauaaacacuucucuacccuuucagaacauccacccgauaaccaucggcaaaugcccaaaauacgucaaauccaccaaacuccgccucgcaacaggccuccgcaacguccccuccauacaaucccguggacucuucggcgccaucgcgggcuucaucgagggcggauggaccggcaugguagacggcugguacggcuaccaccaccagaacgaacagggaucaggauacgccgccgaccucaaauccacccaaaacgccauagacgaaaucacgaacaaagucaacucggucauagagaaaaugaacacccaauucacugcaguaggaaaagaauuuaaccaccucgaaaaacgaaucgaaaaccuaaacaagaaaguggacgauggcuuccucgacauauggaccuacaacgcagaacuacuuguccucuuagaaaacgaacgcacccuggacuaccacgacuccaacgucaaaaaccuauacgaaaaaguacgcucucaacucaaaaacaacgccaaagaaauaggaaacggcugcuucgaguucuaccacaaaugcgacaauaccugcauggaaucggucaaaaacggcaccuacgacuacccaaaauacuccgaagaagccaaacuaaaccgcgaagaaaucgacggagucaaacuagaaagcacacgcauauaccaaauccuagcaaucuacagcaccguagcaagcagcuuaguccuaguaguaucccucggcgccaucucauucuggaugugcagcaacggaucacuucaaugcagaaucugcaua

SEQ ID NO: 58929 - RNA, 1698 nt, Artificial Sequence
  derived and/or modified sequence opt11 from anti-influenza_Chain
augaaagccauccuagucguucuccucuacaccuucgcaacagcaaacgccgacacccucuguaucggcuaccacgcaaacaacucaacagacaccguagacaccgugcucgagaaaaacguaaccgucacccacagcguaaaccuccucgaagauaaacauaacggcaaacuauguaaacuccguggagucgcgccccugcaccucggcaaauguaacaucgccggcuggauccucggcaacccagaaugcgaaucccucuccacugccagcuccuggucauacaucguagaaaccuccuccucugacaacggaaccugcuaccccggugacuucaucgacuacgaagaacuaagagaacaacuuagcucaguaagcuccuucgaacgauucgaaaucuucccaaaaacgagcucguggcccaaccacgacuccaacaaaggcgucacggccgccugcccucacgccggcgccaaaucauucuauaaaaaccugaucuggcuggucaagaaaggcaacagcuaccccaaacucuccaaaucauacauaaacgacaaaggcaaagagguccuaguacuauggggcauccaccacccacccaccucggccgaccaacaaagccucuaccaaaaugcagacgccuaugucuucgucgggucaucccgcuacuccaagaaauucaaaccagaaaucgccauccgaccaaaaguccgagaccaggagggccgcaugaacuacuacuggacccuaguagagccaggcgauaagauaaccuucgaggccaccggcaaccucgucguaccccgcuacgccuucgccauggaacggaacgccgguuccggaauaaucaucagcgacaccccuguacacgauugcaacaccaccugucaaacacccaaaggagcuauaaauacaucgcuacccuuccaaaacauucaccccauaaccauaggcaaaugcccaaaauacguuaaaucgaccaaacuccgccucgccaccggacuccgcaacauccccucuauccaaucccgcggccuuuucggcgccaucgccggauucaucgaaggcgguuggaccggaauggucgacgggugguacggguaccaccaccaaaacgaacaaggaagcggcuacgcggccgaccucaaauccacacagaacgccauagacgaaaucacgaacaaaguuaacagugucaucgagaaaaugaacacccaauucacagccguaggcaaagaguucaaucaccuagaaaaacgcaucgaaaaccucaacaagaaagucgaugacggcuuccuagacauauggaccuacaacgccgaacuccucguacuuuuagaaaacgaacgcacacuagacuaccacgacuccaacgucaaaaaccucuacgaaaaaguccgcagccaacucaaaaacaacgccaaagaaauaggcaauggaugcuucgaguucuaccacaaaugcgauaauaccugcauggaauccgucaaaaacggcacauacgacuaccccaaauacucagaagaagccaaacuaaaccgcgaagaaaucgacggaguaaaacuagaauccacccgaauauaccagauacuagccauauacucaacaguagccuccucccucguacucguagugagccuaggagcaaucuccuucuggaugugcucaaacggcucacuccaaugcagaaucugcauu

SEQ ID NO: 58930 - RNA, 1698 nt, Artificial Sequence
  derived and/or modified sequence opt11 from anti-influenza_Chain
auggagaagaucgugcuacuccuagccaucgucucccuagucaaaucagaccaaaucugcaucggcuaccacgcuaacaacuccaccgaacaagucgacacaauuauggagaaaaaugucacagucacacacgcacaagacauacuagagaaaacacacaacggaaaacucugcgaccucgauggcgucaaaccccucauccuuagagacugcagcgucgccgguuggcuccuuggcaaccccaugugcgacgaauuuauuaacguccccgaauggucguacaucguagaaaaagccaaccccaccaacgaccucugcuaucccggauccuucaacgacuacgaagaauuaaaacaccucuuaucacgcaucaaccacuucgaaaagauacaaauaauacccaaaucgagcuggucagaccacgaagccucauccggcgucuccagcgcaugccccuaccucggaucucccucauucuucagaaacguaguauggcucaucaaaaagaacucaaccuaccccacaauaaagaaaagcuacaacaacaccaaccaagaagaccuccuaguucucuggggcauccaccaccccaacgacgcagccgaacaaacucgacucuaccagaaccccaccacguacauaucaauuggcacguccacacugaaccaacgccucgucccgaaaaucgccacccgcuccaaaguaaacggacaauccggccgaauggaguucuucugggccauccucaaacccaacgacgcgauaaacuucgaaucaaauggaaacuuuaucgcacccgaauacgcauacaaaauagucaagaaaggcgacagcgccauaaugaaauccgaacucgaauacggcaacugcaacaccaaaugccaaaccccaaugggggcaaucaacuccuccaugcccuuccacaacauccacccgcuaaccaucggcgaaugcccaaaauacguaaaauccaaccgacucguccucgccaccggccuccggaacuccccgcaacgcgaaucccgccgcaagaaacgcggccuguucggcgccauagcaggauucaucgaaggcgguuggcaaggcauggucgacggaugguacggcuaccaccacagcaacgaacaaggaucaggauacgcagccgacaaagaaagcacucaaaaagccauaggcgucaccaacaaagucaacucaauaaucgacaaaaugaacacccaauucgaagcagucggcagggaguucaacaaccucgaacgcagaaucgaaaaccugaacaagaaaauggaggacggcuuccucgacgucuggacauacaacgccgaacuccucguccucauggaaaaugaacgcacacuagacuuccacgacagcaacgucaaaaaccuauacgacaaaguccgacuccaacuucgcgacaacgccaaagaacucggaaacggcuguuucgaguucuaucacaaaugugacaacgaaugcauggaauccaucagaaacggaaccuacaacccccaauacucagaagaagcaagacucaaacgcgaagaaauaagcggcgucaaacucgaaucgaucggcaccuaccaaauacucagcaucuacagcacaguggccuccucccuugcacucgccaucaugauagccggucuaagccucuggaugugcucaaacggcucccuccaaugcagaaucugcauc

SEQ ID NO: 58931 - RNA, 1698 nt, Artificial Sequence
  derived and/or modified sequence opt11 from anti-influenza_Chain
augaaaaccaucauagcccuauccuacauccucugccucguauucgcccaaaaacuccccggcaacgacaacuccacagccacccuaugucucggccaccacgcaguccccaacggcacgaucgucaaaaccaucacaaacgaccaaauugaagucaccaacgccaccgagcuaguccagagcucaagcaccggcggaaucugcgacucaccccaccaaauauuagacggcgaaaacugcacucucaucgacgcccuccucggcgauccccaaugcgacggguuccaaaacaaaaagugggaccuuuucgucgaaagaucuaaagcauauagcaacugcuaccccuacgacguccccgacuacgccucccugcgcucacucguagccaguucaggcacacuagaguucaacaacgaauccuucaacuggacuggcgugacacaaaacggcaccuccucagccugcaaacgacgaucgaauaacuccuucuucucccgacucaacuggcucacacaccuuaaauucaaauaccccgcgcugaacgucaccaugccaaacaacgaaaaauucgacaaacucuacaucuggggaguacaccaccccggcacagacaacgaccaaaucagccuauacgcccaagcaucaggacgaaucacagucucuacaaagcgaucccaacaaaccgucauucccagcaucgggucucgcccacgcauacgcgacguacccucacgcaucucaaucuacuggaccaucguaaaaccaggcgacauucuacucaucaacagcaccggaaaccucaucgcuccccgcggcuacuucaaaauccgcaguggcaaaagcuccauaaugcgguccgacgcaccaaucggcaaaugcaacagcgaaugcaucacccccaacggcagcauccccaacgacaagccauuccagaacgucaaccgaauaaccuacggagcaugcccccgauacgucaaacaaaacacucucaaacucgccacaggcaugagaaacguccccgaaaagcaaacccgcgggaucuucggagccaucgcaggcuuuaucgaaaacggaugggaaggaauggucgacggcugguacggauuuagacaccaaaacucagaagggacaggccaagcagcugaccuaaaaucaacccaagccgccauuaaccagaucaacgggaaacuaaaccgccucaucgguaaaacgaacgaaaaauuccaccaaaucgaaaaagaguucucagaaguagaaggccgcauccaagaccucgaaaaauacgucgaagacacaaaaaucgaccucuggucauacaacgccgaacuccucgucgcacucgaaaaccagcacacaaucgaccucacagacucagaaaugaacaaacucuucgaaaggaccaagaaacaacuccgagaaaacgccgaagacaugggaaacgguugcuucaaaaucuaccacaagugcgacaacgcuugcaucggcuccauccgcaacggcaccuacgaccaugacguguacagagacgaggcccuaaacaaccgauuccaaaucaaaggaguugaacuaaaaagcggcuacaaagacuggauccucuggauauccuuugccaucuccugcuuccuacucugcgucgcccuccugggcuucaucaugugggccugccaaaaaggcaacauccgaugcaacauaugcauc

SEQ ID NO: 58932 - RNA, 1698 nt, Artificial Sequence
  derived and/or modified sequence opt11 from anti-influenza_Chain
augaaagccauccuagucguccuccucuacaccuucgccaccgccaacgccgacacucuuugcaucggauaucacgccaacaauuccacagacaccgucgacacaguccuggagaaaaauguaacaguuacgcacuccgucaaccuccuagaagacaagcauaacggcaaacuaugcaaacuccgcggaguagcaccucuccaccucgggaaaugcaacaucgccggcuggauccuaggcaaccccgaaugcgagucacuauccacagccucauccuggagcuacauagucgaaaccuccucaagcgacaacggcacaugcuaccccggagacuucauugacuacgaagaacuccgcgaacaacuguccagcgucagcagcuucgaacgauucgaaauauucccaaaaacauccuccuggcccaaccacgauucaaacaaaggcguaaccgccgccugcccacacgcuggcgccaaauccuucuacaaaaaccucauauggcucguaaagaaaggcaacuccuaccccaaacucuccaaaucauacauaaacgacaaaggcaaagagguccuaguauuguggggcauccaccacccauccaccuccgcagaccaacaaucguuauaccaaaacgccgacgccuacgucuucguaggcaccucacgcuacuccaagaaauucaaaccugaaaucgccauccgacccaaaguccgagaccaagagggacgaaugaacuacuacuggacucucguggaacccggcgauaaaauaaccuucgaagccacaggaaaccuagucguccccagauacgccuucgccauggaacgaaacgccggaagcggaaucauaaucuccgacacaccaguccacgacugcaacacgaccugccaaacccccaaaggagccauuaacaccucacuccccuuccagaacauacaccccauuaccauaggaaaaugcccaaaauacgucaaauccacaaaacuacgccucgcuaccggccuccgaaacgucccaagcauccaaucccgcggccucuucggcgcaaucgcaggauucaucgaaggcggguggaccggcauggucgacgggugguacgguuaccaccaccaaaacgaacaaggaucaggcuacgcggccgaccuaaaaagcacccagaacgccauugacgaaaucacaaacaaaguaaacuccgucauagagaaaaugaacacccaauucaccgcugucggcaaagaguucaaccaccucgaaaaacgaauugagaaccuuaacaagaaagucgacgacggauuccucgacauauggaccuacaacgcagaacuucuaguccuacuagagaacgaacguacccucgacuaccacgacucaaacgugaaaaaccucuacgaaaaaguccgcagccaacuuaaaaacaacgcaaaagagaucggaaacggcuguuucgaguucuaccacaaaugcgacaauaccugcauggaauccgucaaaaacgggaccuacgacuaccccaaauacucugaagaagcaaaacucaacagagaggaaauagacggagucaaacuggaaagcacacgcaucuaccaaauccuagccauauacuccaccguagcauccagccucguccucgucguaagccucggagccaucuccuucuggauguguuccaacggcucccuccaaugccgcaucugcaua

SEQ ID NO: 58933 - RNA, 1698 nt, Artificial Sequence
  derived and/or modified sequence opt11 from anti-influenza_Chain
augaaagccauccucgucguccuacuauacacauucgcgacagcgaaugcagacacccucugcaucggauaccaugccaauaacuccacagacacagucgacacgguccucgaaaagaacgucaccgucacccacagcguaaaccuccuggaagacaaacacaacggcaaacugugcaaacuccgcggaguagcaccccuacaucucggcaaaugcaacaucgccggcuggauccucggaaaccccgaaugcgaaucccugaguacagccuccagcugguccuacaucguagaaacauccucgagcgacaacggaaccugcuacccgggcgacuucaucgauuaugaagaacuccgggagcaacucuccuccgucagcuccuucgagagauucgaaauauucccaaaaacauccuccuggccaaaccacgacucaaacaaaggcgucacagccgccugcccccacgcaggagccaaauccuucuacaaaaacuuaaucuggcucgucaaaaagggaaacagcuaccccaagcuaagcaaaucguacaucaacgauaagggcaaagaaguacucguccucuggggcauacaucacccaccaaccuccgccgaccaacaaucacucuaccaaaacgccgacgccuacgucuucgucggauccucgcgauauagcaagaaauucaaacccgagaucgccauacgacccaaaguacgcgaccaagaaggacgcaugaacuacuacuggacgcuuguagaaccaggcgacaaaaucaccuucgaagccaccggaaaccucgucguaccuagguacgccuucgccauggaacguaacgcaggcagcggcaucauuaucuccgacacaccaguacacgauugcaauaccaccugucagacaccaaaaggcgccauaaacacaucccuuccuuuucaaaacauccaccccauaaccaucggaaaaugcccaaaauacguaaaaagcaccaaacuacgccucgcaacaggacuccgcaauaucccaaguauacaaucacgcggacucuucggcgccaucgccggcuucauagaaggcggcuggacaggcaugguagacgguugguacggcuaccaccaccaaaacgagcaggggagcggauacgcggccgaccucaaauccacacaaaacgcaauagacgaaauuaccaacaaaguaaacagcgugauagaaaagaugaacacacaguucaccgcagucggaaaagaguucaaccaccuagaaaaacgaaucgaaaaccuaaacaagaaagucgacgacggauuccucgacaucuggacauacaacgccgaacugcucguacuccuugaaaacgaacggacacucgacuaccacgacucaaacguaaagaaccucuacgaaaaaguacgcagccaacucaaaaacaacgccaaagaaaucggcaacggcugcuuugaguucuaccacaaaugcgacaauacaugcauggaaagcgucaaaaauggcacauacgacuaccccaaauacucagaagaagccaaacucaaccgcgaagaaaucgacggaguaaaacucgaaagcacacguauuuaccaaauccucgcaaucuacuccacagucgcauccucccucguccuagucgucucccuaggagcaaucucauucuggaugugcaguaacggcucacuccagugcaggaucugcauc

SEQ ID NO: 58934 - RNA, 1698 nt, Artificial Sequence
  derived and/or modified sequence opt11 from anti-influenza_Chain
augaaaacaaucaucgcacucucauacauccuaugccucgucuccgcccaaaaguuccccggaaacgacaacagcacagccacccucugccucggccaccacgccgucccaaacggcaccaucguaaaaaccaucaccaacgaccaaauagaagucacaaacgcgacagaacucguccaaagcucaagcacaggcgaaauaugcgacagcccccaccaaauucucgacggagaaaacuguacccuaaucgacgcacuuuuaggagacccccagugcgacggauuccaaaacaagaaaugggaccuguucguagagagaagcaaagccuauagcaacugcuaccccuacgacgucccagacuacgccagccugagaucacucgucgcaucguccggaacccucgaauuuaacaacgaauccuucaacuggacaggcgucacccaaaacggcaccuccuccgcuugcauccgucgcucaaacaacuccuucuuuucccgccucaacuggcuaacccaccuaaaauucaaauacccagcccucaaugugaccaugccaaacaacgaagaguucgacaaacucuacaucuggggcguccaccaccccgggaccgacaacgaccaaaucuuccuuuacgcccaagccuccggacgcauaaccguaucaacgaaacggucacagcaaacggugauaccuaacauccggagccgcccaagaguccgcaacauccccucccguaucucaauauacuggaccauugucaaacccggcgacauccuucuaaucaacucaacuggcaaccuaaucgcaccccgcggauacuucaaaauucgaucgggcaaguccuccaucaugcgcucagacgcccccaucggcaaaugcaauuccgaaugcauaaccccaaacggauccaucccaaacgacaaacccuuccaaaacgugaaccgcaucaccuauggcgccugcccccgcuacgucaagcaaaacacccucaaacuggccaccggcaugcgaaauguacccgaaaaacaaacacgagggaucuucggcgccauagccggcuucauagaaaauggaugggaaggcaugguagacgggugguacggcuuccgccaccaaaacuccgaaggaaucggccaagccgcagaccuaaaauccacacaagccgcaaucgaccaaaucaacggaaaacuuaaccgccuaauagggaaaaccaacgaaaaauuccaccagaucgaaaaagaguucuccgaaguggaaggccgcauccaagacuuagaaaaauacgucgaagacacaaaaauagaccucuggucauacaacgccgaacuucuagucgcacuagagaaccaacacacuaucgaccuaacagacucggaaaugaacaaacuuuucgagaaaacaaagaaacaacuccgcgaaaacgcagaggacaugggcaauggcugcuucaaaauauaccacaaaugcgacaacgccugcauaggcucaaucagaaacggaaccuacgaucacgacgucuaccgagacgaagcccucaacaaccgcuuccaaauaaaaggcguagaacuuaaauccggguacaaagacuggauucuauggauuagcuucgccauauccugcuuccuccucugcgucgcccuacugggauucaucaugugggccugccaaaaagggaacauccgcugcaacaucugcaua

SEQ ID NO: 58935 - RNA, 1698 nt, Artificial Sequence
  derived and/or modified sequence opt11 from anti-influenza_Chain
augaaaaccaucaucgcccucagcuacauccucugccucgucuucgcccaaaaacuccccggcaacgacaauucaaccgccacauuaugucucggccaccacgccguccccaauggcaccauagucaaaaccaucaccaacgaccaaaucgaagugacaaacgcaacagaacucguccaaagcucgagcaccggcgaaaucugcgauucaccacaucaaauccuagacggagaaaacugcacccuaaucgacgcccuauuaggagacccccaaugcgacggauuccaaaacaagaaaugggaccucuucgucgaacgcuccaaagcauacucaaacuguuaucccuaugacgucccagacuacgccucccuccgcucccuaguagccagcagcggcacccuugaguucaaaaacgaauccuucaacuggacaggcguaacccaaaacggaacguccucagccugcauacgacgaagcaacaacuccuucuucucccgguuaaacuggcucacccaccucaaauucaaauacccagcacugaacguaacaaugccaaacaaagaaaaauucgacaaacucuacaucuggggaguacaccaccccggcaccgacaacgaccaaauauuccucuacgcccaagccagcggacgcaucaccgucucgaccaaacgcagccaacaaaccgucauacccaacaucggcucccgguuacgcgucagagacauccccucaagaauauccaucuacuggacaaucguaaaacccggagacauacuccuaaucaacagcaccggaaaccuuaucgcaccccgcggcuauuucaaaauacgaucaggcaaaucuuccaucaugcgcuccgacgcccccaucggcaagugcaacuccgaaugcauaacacccaacggcuccaucccgaacgacaaaccauuccaaaacgucaaccgcaucaccuacggcgccugcccgcgauacgucaagcaaaacacccucaaacucgccaccggaaugcgcaacgucccagaaaaacaaacacgagguaucuucggcgccaucgcagguuucaucgaaaacggaugggaagguaugguugacggaugguacggauuccgacaccaaaacagcgaaggaacuggccaagccgcagaccucaaguccacacaagccgccauugaccagauaaacggaaaacucaaccgccuuaucggcaaaacgaacgaaaaauuccaccaaaucgaaaaagaguucuccgaagucgaaggccggauccaagaucuagaaaaauacgucgaagacaccaaaaucgaccuguggagcuacaacgccgaacuccuagucgcccuagaaaaccaacacaccaucgaccuaacagacuccgaaaugaacaagcuauucgagaaaaccaagaaacaguuacgagaaaacgcagaagacaugggcaacggaugcuuuaaaauuuaccacaaaugcgacaacgccugcaucggauccauccgcaacggcaccuacgaucacgacgucuaccgggacgaagcucucaauaaccgauuccaaauaaaaggcgucgaacuaaaaucaggcuacaaagacuggauacucuggauaucguucgcaaucagcugcuuccugcucugcgucgcccuacucggauucaucaugugggccugccaaaaaggcaauauccgcugcaacaucugcaua

SEQ ID NO: 58936 - RNA, 1698 nt, Artificial Sequence
  derived and/or modified sequence opt11 from anti-influenza_Chain
augaaaacaaucaucgcccuuuccuacauacucugccuaguguucgcccagaagcuacccggcaacgacaacagcacggccacccuaugccuaggccaccacgccguccccaacggcaccauagucaaaacgaucaccaacgaccaaauagaaguuaccaacgcaacagaacucguccaaucauccagcaccggcgaaaucugcgacucaccccaccaaauacuagacggcgaaaacugcacccucaucgaugcccuucucggagacccccaaugcgacggauuccaaaacaagaaaugggaccuguucguagaaagauccaaagccuacuccaaaugcuacccauacgacguacccgacuacgccagccuucgaucccuaguggccuccuccggcacccucgaguucaacaacgaauccuucaacuggaccggagucacucaaaacggcaccuccucagcaugcauacgaagaucuaacaacagcuucuucucccgccuaaacuggcuaacccaccucaaauucaaauacccagcucucaacgucaccaugcccaauaacgaaaaguucgauaaacuauacaucugggguguccaccacccugguaccgacaacgaccaaaucuuccuauacgcacaagcaagcggccgcauaaccguaagcacaaaacgcucccaacaaaccgucauccccaauaucggaucccgcccccgaguccgugacauaccaucccgcaucuccauauacuggaccauagucaagccaggagacauccuccuaauaaauuccaccggcaaccucauagccccacgcggcuacuucaaaauccguucaggaaaauccuccauaaugcguucagacgcacccauaggcaagugcaacuccgaaugcaucaccccaaacggauccauccccaacgacaaaccauuccaaaacguaaaccgcauaaccuacggcgcuugcccacgcuacgucaaacaaaacacccucaaacuagccaccggcaugcgcaacguacccgaaaaacaaacacgaggaaucuucggugcgaucgccggauucaucgaaaacggcugggaaggcauggucgacggcugguauggcuuccgacaccagaacuccgaaggaauaggacaagccgccgaccuaaaaaguacccaagcggccauugaucaaaucaacggcaaacuaaauagacuaaucggaaagaccaacgaaaaauuccaccagaucgaaaaagaguucuccgaaguggaaggccguauccaagaccucgaaaaauacgucgaagacaccaaaaucgaccuauggagcuauaacgccgaauuacucguugcacucgaaaaccaacacacgaucgaccucaccgacuccgaaaugaacaaacucuucgagaaaaccaagaaacaacucagagaaaacgccgaagacaugggaaacggcugcuucaaaaucuaccacaaaugcgacaacgcguguaucggaucaauccgaaacggcaccuacgaccacgacgucuaccgagacgaagcccucaacaacagauuccaaaucaaaggagucgaacuaaaaagcggauacaaagacuggauccucuggauaucauucgccaucagcuguuuccuacucugcgucgcgcuccuaggcuucaucaugugggccugucaaaaaggaaacauacgcugcaauaucugcaua

SEQ ID NO: 58937 - RNA, 1698 nt, Artificial Sequence
  derived and/or modified sequence opt11 from anti-influenza_Chain
augaaaacaaucaucgcacucagcuacauccucugucucguauucgcacaaaaacuccccggaaacgacaauagcacagccacacucugccucggccaccacgccgucccaaacggcacaaucguaaaaaccaucaccaacgaccagaucgaaguaaccaacgcaaccgaacucguccaauccagcuccaccggagaaaucugcgauagcccacaccaaauccuagauggcgaaaauugcacacucaucgacgcacuacucggagacccccagugcgacggauuccagaauaagaaaugggaccucuucgucgaacgcagcaaagccuacagcaauugcuacccauacgacguaccagacuacgccucacuacgcucccuaguagcauccuccggcacccuagaguucaacaacgaaucauucaacuggaccggagucacacaaaacggaacaucaagcgccugcauucggagaagcaacaacucauucuucucaagacucaacuggcuaacccaccuaaaauucaaauaccccgcccuaaacguaaccaugccuaauaacgaaaaauucgacaaacuauacaucuggggcguccaccaccccggcaccgacaacgaccaaauauuccuguacgcccaagccagcggacgcauaaccgucagcacgaaacgcagccaacaaacagucauaccaaacaucggauccagaccaagaguccgcaacauucccucccgaaucagcauauacuggaccaucguaaaacccggagacauacuccucaucaacucaaccggcaaccucauugcgccacgcggcuacuucaaaauacgcucgggcaaguccuccaucaugcgcuccgaugcccccaucggcaaaugcaacuccgaaugcaucaccccaaacggaucaauucccaacgauaaacccuuccaaaacgucaaccgcauaaccuacggcgcaugcccccgcuacguaaaacaaaacacucuaaaacuagcaacaggaaugcgcaacguccccgaaaaacaaacacgaggaaucuucggggccaucgccggcuucaucgaaaacggaugggaaggcauggucgacggcugguacggcuuccgccaccaaaacagcgaaggaauagggcaagcagccgaccucaaaagcacgcaagcggccaucgaccaaaucaacggcaaacucaaccgccucaucgggaaaacaaacgaaaaauuccaccaaauugaaaaagaguucucagaagucgaaggccgaauacaagaccucgaaaaauacgucgaagacaccaaaaucgaccuaugguccuacaacgcagaacuccuggucgcccucgaaaaccaacacacgauagaccuaaccgacucagaaaugaacaaacucuucgaaaagaccaagaaacaacuacgagaaaacgccgaagacaugggaaacggauguuucaagaucuaccacaaaugcgacaacgccugcaucggcucuaucaggaacggcaccuacgaccacgacgucuaccgagacgaagcacugaacaaccgauuccaaauaaaaggcguagaacugaaaagcggcuacaaagacuggauccucuggauaucauucgcuauaagcugcuuccuccucugcgucgcacuauuaggcuucaucaugugggccugccaaaaagggaacauaagaugcaacauaugcaua

SEQ ID NO: 58938 - RNA, 1698 nt, Artificial Sequence
  derived and/or modified sequence opt11 from anti-influenza_Chain
augaaaaccauaaucgcccuaucauacauccuaugucucgucuucucacaaaagcuccccggcaacgacaacagcacagccacccucugucucggacaccacgccguacccaacggcacaaucguaaaaacaaucaccaaugaccaaaucgaagucacaaaugcaacggagcuaguccagagcuccagcaccggaggaauaugcgacucgccccaccaaauacucgacggcgaaaacugcacccugaucgacgcgcuccucggagacccccaaugcgacggcuuccaaaacaagaaaugggaucucuucguagaacggucaaaagcauacucaaacugcuaccccuaugacguccccgacuacgcgagccuccgaucccuugucgccagcuccggcacccuggaguucaacaacgagagcuucaauugggccggagucacacaaaacggcacaucguccgccugcaaacgccgaagcaacaaaucauuuuucucccgacucaacuggcugacacaccuaaaauacaaguaccccgcacucaacgucaccaugcccaauaacgaaaaauucgacaaacucuacaucuggggcguccaccaccccguaaccgacagcgaccaaauaagccuauacgcccaagcauccggccgaauaaccguaucaaccaaacgcagccaacaaaccgucauccccaacaucggcuaccgaccccggguacgcgacauaagcucccguaucagcauauacuggaccaucgucaaacccggggacauccuacuaaucaacuccaccggcaaccucauagcgccgcgaggauacuucaagauccgcucaggcaaaucauccaucaugcgcucugaugcccccaucggcaaaugcaacucagaaugcauuacccccaacggcuccauccccaacgacaaacccuuccaaaacguuaaccgaauaaccuacggcgccugcccccgauacgucaaacaaaacacccucaaacuagcaacgggcaugcgcaacgucccggaaaaacaaacacgcggcauuuucggggcaaucgccggguucaucgaaaacggcugggaaggaauggucgacgggugguacggauuccgccaccagaacuccgaaggaaccggccaagcagccgaccucaaaagcacacaagccgcgauaaaucaaaucaacggcaaacucaacagacucaucggcaaaacaaacgaaaaguuccaucaaaucgaaaaagaguucucagaagucgaaggccgaauacaagaccucgaaaaauacgucgaagacacgaaaaucgaccucugguccuacaacgccgaacuacuggucgcccuagaaaaccagcacacgauagaccuaaccgacagcgaaaugaacaaacuauucgagaggacaaagaaacaacuacgcgaaaacgcagaagacaugggaaacggcugcuucaaaauauaccacaaaugcgacaacgcguguauagaaucaauccgcaacggcacguacgaccacgacgucuauagagacgaagcccugaacaaccgcuuccaaaucaaaggagucgaacucaaaagcggcuacaaagacuggauacuauggaucagcuucgccauauccugcuucuugcuaugcgucgcacuucucggcuuuaucaugugggccugccagaaaggcaacauacgcugcaacaucugcaua

SEQ ID NO: 58939 - RNA, 1698 nt, Artificial Sequence
  derived and/or modified sequence opt11 from anti-influenza_Chain
augaagaccaucaucgcccugagcuacauccugugccugguguucgcccagaagcugcccggcaacgacaacuccaccgcgacacucugccuggggcaccacgccgucccgaacggcacaauagucaagacgaucacuaaugaccagaucgaagugacgaacgcaaccgaacugguccagagcuccuccaccgggggcaucugcgacagcccccaccagauccucgacggagagaacugcacccugaucgacgcccugcucggugacccacagugcgacggcuuccagaacaaaaagugggaccuguuuguugagcgcagcaaggccuacuccaacugcuaccccuacgacgugccggacuaugcgucccugcgaucccucgucgcaagcuccgggacgcuggaguucaacgacgagagcuucaacuggaccggcgugacccaaaacgggaccuccagcuccugcaagcgccggagcaacaauuccuucuucagccgccugaacuggcucacgcaccugaaguucaaguacccggcgcugaacgugacaaugcccaacaacgagaaguucgacaagcucuacauauggggcguccaccaccccgugaccgacaacgaccagaucuuccuuuacgcccaggcguccgggcgaaucaccguguccacuaagcgcagccagcagaccgucaucccgaacaucggcucccggccccgcaucagaaacauccccucucgcauuuccaucuacuggaccaucgugaagcccggcgacauccugcucaucaacagcaccgggaaccugaucgcaccgagagguuacuucaagauccgcucaggaaaauccuccaucaugcguagcgacgcccccaucggcaagugcaacuccgagugcauaacccccaacggcagcaucccuaacgacaaaccauuccagaacgugaaccgcaucaccuacggggcgugcccccgauacgucaagcaaaacacccugaaacucgccaccggcaugcgcaacgugcccgagaagcagacgcgggggaucuuuggcgcgauagcgggguucaucgagaacggcugggagggcaugguagacgggugguacggcuuccgccaccagaacuccgaagggaucggccaggccgcagaucucaagucuacccaggccgcgaucaaccagaucaacgggaagcugaaccggcugaucggcaagaccaacgagaaguuucaccaaaucgagaaggaguucuccgaggucgagggccgaauccaggaccucgagaaguauguggaggacaccaagaucgaucuguggucuuacaacgccgagcuccugguggcccuggagaaccagcacacgaucgaucucaccgacuccgagaugaacaagcuguucgagcggaccaagaagcagcugcgcgaaaacgccgaggacauggggaacggcugcuucaagaucuaccacaagugcgacaacgccugcaucgggucuauccgcaacggcaccuacgaccacgacgucuaccgggacgaggcgcucaacaaccgcuuccagaucaagggcguggagcugaaguccggcuacaaggacuggaucuuguggaucagcuucgccaucuccugcuuccuccugugcguggcccuucucggcuucaucaugugggccugccaaaaggggaauauccggugcaacaucugcauc

SEQ ID NO: 58940 - RNA, 1683 nt, Artificial Sequence
  derived and/or modified sequence opt11 from anti-influenza_Chain
auggagaaaauaguccuccucuucgcaauaguaagccucgucaaauccgaccaaaucuguaucggcuaccacgcgaacaacuccacagaacaagucgacacaaucauggagaaaaacguaaccguaacacacgcacaagacauccucgagaaaacgcacaacggcaaacucugcgaccucgacggaguaaaaccccucauccucagagacugcagcguagccggauggcuacucggaaacccuaugugcgacgaguucauaaacgugccagaaugguccuacauagucgaaaaagcaaacccagucaaugaccuaugcuaccccggcgacuucaacgacuacgaagaauuaaaacaccuccuaagucgcaucaaccacuucgagaaaauccaaaucauccccaaaagcagcuggucaagccacgaagccucccucggggucagcuccgcuugccccuaccaagggaaauccuccuucuuccgcaacguagucuggcugauaaagaaaaacuccacauaccccacaaucaaacgaagcuacaacaacacaaaccaggaagaccuccuaguccuauggggaauacaccacccaaacgaugcugccgaacagacaaaacuauaccaaaaccccaccacauacauaagcgucggcacaagcacacucaaccaacgacucguaccacgcaucgccacccgcuccaaaguaaacggccagagcggcagaauggaguucuucuggaccauccuaaaacccaacgacgccauaaacuucgaauccaacggcaacuucaucgcccccgaauacgcguacaaaauagucaaaaagggagacucuaccauaaugaaguccgaacucgaauacggcaacugcaacaccaagugccaaacucccaugggcgcgaucaacuccagcaugccauuccacaacauacacccauuaaccaucggggaaugcccaaaguacgucaaaucaaaccgccuaguacuggcaaccggacuccgcaacagcccccaacgcgagcggcgccgcaaaaagcgaggacuauucggagcgauagcaggcuucauagaaggcggauggcaaggcaugguagacggcugguacggauaccaccacuccaacgaacaaggaagcggcuacgccgccgacaaagaaucuacucaaaaagccaucgacggcgucacaaacaaagugaacagcauaauagacaaaaugaacacacaauucgaagcaguuggccgcgaguucaacaaccucgaacgccgcaucgaaaaccuuaacaagaaaauggaagacggcuuccuagacgucuggacuuacaacgcagaacuccuagugcucauggaaaacgaacgcacacuagacuuccacgacagcaacgucaaaaaccucuacgacaaaguccgccuacaacuccgcgacaacgcaaaagaacucggcaacggcugcuucgaguucuaucacaaaugcgacaacgaaugcauggaauccguccguaacggaacauacgauuacccccaauacuccgaagaagccagacugaaaagggaggaaauaagcggcgucaaacucgaaagcaucggcaucuaccagauccaacacucaggcggccgcuccucccucgaaggcccccgguucgaacaaaaacucaucucagaggaagaccucaacaugcacacagga

SEQ ID NO: 58941 - RNA, 1683 nt, Artificial Sequence
  derived and/or modified sequence opt11 from anti-influenza_Chain
auggaaaagaucguacugcuccuagccaucgucucccucgucaaaagcgaccaaauaugcaucggcuaccacgcaaacaacagcacagaacaagucgacacaaucauggaaaagaacgucaccgucacacacgcccaagacauacucgagaaaacacacaacggaaaacuuugcgaccuagacgggguuaaaccacucauacucagagacugcucggucgcaggcuggcuccucggcaaccccaugugcgacgaauuuauaaacguaccugaauggagcuacauaguagaaaaagcuaaccccgccaacgaccuauguuaccccggcaacuucaacgacuaugaggaacucaaacaccuacucucacgcauaaaccacuucgagaaaauacaaauaauaccaaaauccuccugguccgaccacgaagccuccuccggcgucagcucugcaugcccguaccaaggaaaaagcuccuucuuccgaaacgucgucuggcuaaucaagaaaaacaguuccuacccgaccaucaaacgauccuacaacaacacgaaccaagaagaccuccucguacucuggggcauccaccaucccaaugacgccgccgaacaaacgcgacucuaccaaaacccaacaacuuacauauccguaggaacuuccacacucaaccaacgccucgucccgaaaaucgcaacccgcagcaaagucaacggacaauccgggcgcauggaauuuuucuggaccauccucaaacccaacgacgcaaucaacuucgaauccaacggcaacuuuaucgcccccgaauacgccuacaaaaucguaaagaaaggcgacucagccaucaugaaguccgaacuagaauacggcaacugcaacacaaaaugccaaacacccaugggcgcaaucaauagcucaaugccauuccacaacauacacccccuaacaaucggugaaugcccgaaauacgucaaauccaaccgccuaguccuugccaccgggcucagaaacagcccccaaagagaacgccgacgcaagaaacggggacucuucggagcaaucgccggguucauagaaggcggauggcaagguauggucgacggcugguacggcuaccaccacuccaacgaacaaggcucgggcuacgccgccgacaaagaauccacccaaaaagccaucgacggcgugacaaacaagguaaacagcauaaucgacaaaaugaacacacaauucgaagccgucggccgagaguucaacaaucucgaacgcaggauagaaaaccuaaacaaaaagauggaagacggguuccucgacguauggacauacaacgccgaacuccuagugcucauggaaaacgaacgcacccucgacuuccacgacucaaaugucaaaaaccucuacgacaaaguacgccuccaacuacgagacaacgcuaaagaacuaggaaacgggugcuucgaguucuaucacaaaugcgacaacgaaugcauggaaagcgugcggaacggcaccuacgacuauccacaauacuccgaagaagcccgccucaaacgcgaagaaauaucaggagucaagcucgaaucaaucggcaucuaccaaauccaacacucuggcggccgauccucccuagaaggaccccgcuucgaacaaaaacucaucuccgaagaagaccucaacaugcacaccggu

SEQ ID NO: 58942 - RNA, 1701 nt, Artificial Sequence
  derived and/or modified sequence opt11 from anti-influenza_Chain
auggaaaaaauaguacucuuacuagcaauagucucccucgucaaauccgaccaaauaugcaucggauaccacgccaacaacagcaccgaacaaguugacaccaucauggaaaaaaacgucaccgucacacacgcacaggacauucuagaaaaaacacacaacggaaaauuaugcgaccuagacggcgucaagccccucauccuccgugacugcucgguagcgggcuggcuauuaggcaaccccaugugcgacgaauucauaaacgucccagaauggagcuacaucguugaaaaagccaaccccgccaacgaccucugcuacccaggaaacuucaacgacuacgaggaacucaaacaccuucucucccgcaucaaccauuucgagaaaauacaaaucaucucgaaaucuuccuggucagaccacgaagcuuccuccggcgucuccagcgcaugccccuaccaaggaacccccucauucuuccggaacgucgucuggcuaauaaaaaaaaacaacaccuaccccacaaucaaacgguccuauaacaacaccaaucaagaggaccugcuaauccucuggggcauccaccacagcaacaacgccgccgaacaaacaaaacuguaccaaaacccaaccaccuacaucuccguaggcacuucaacccuaaaccuacgccuagugccaaaaaucgccacccgcuccaaagucaacggacaaagcggccgcauggacuucuucuggaccauccuaaaacccaacgacgccaucaacuucgaaucaaacggaaauuucaucgcccccgaauacgccuacaaaaucguaaagaaaggggacucagcaauaaugaaauccgaaguagaauacggcaacugcaacaccaaaugucaaacaccaauaggugccauaaacuccuccaugccauuccacaacauccacccccucaccauaggcgaaugcccuaaauacgucaaauccaacaaacuugugcuugccacaggccuccgcaacucaccacuccgagagcgaagacgcaaacggggacucuuuggcgccauagccggauucaucgaaggaggcuggcaaggcaugguagaugggugguacggcuaccaccacucaaacgaacaaggauccggauacgcagcagacaaagaauccacccagaaagccaucgacggcguaaccaacaaagucaacucaauuauagacaaaaugaacacacaguucgaagcgguaggucgagaauucaacaaccuagaacgccgcaucgaaaaccucaacaaaaagauggaagacggauuccucgauguauggaccuacaacgcugaacuccucguacuaauggaaaacgaacguacacucgacuuccacgacucaaacgucaaaaaccucuacgacaaaguccgccuccaacuacgagacaacgccaaagaacucggaaacggcugcuucgaauucuaccacaagugugacaacgaaugcauggaauccguccgaaacggcaccuacgacuacccccaauacuccgaagaagccagacucaagcgcgaagaaaucagcgggguaaaacucgaaagcaucggcaccuaccaaauccucucuauauacucgacaguagcaagcucacucgcccuagccaucauggucgcaggccucucccuguggaugugcagcaacggaucacuccaaugccgaaucugcauc

SEQ ID NO: 58943 - RNA, 1701 nt, Artificial Sequence
  derived and/or modified sequence opt11 from anti-influenza_Chain
auggagaaaauuguccuccuccuagccauagucucccuagucaaauccgaccaaauaugcauaggauaccaugccaacaacuccaccgaacagguagacaccauaauggagaaaaacguaacagucacacacgcccaggacauacucgagaaaacacacaacggaaaauuaugcgaccucgacggcgucaaaccccuaauccuccgagacuguagcgucgccggauggcuacucggcaaccccaugugcgacgaguucaucaacguccccgaaugguccuacauugucgaaaaagccaaccccgcaaacgaccucugcuacccaggaaacuucaacgacuacgaagaacuaaaacaccuacuaucccguaucaaccacuucgagaaaauccaaaucauaccaaaaagcuccuggucugaccaugaagccagcagcggaguaagcucugccugcccauaccaaggcaccccaucauucuuccggaacguggucuggcucaucaagaaaaacaacaccuaccccacaaucaaacgcuccuacaacaacaccaaccaagaagaccuccucauccuauggggaauccaccacagcaacgacgccgcugaacaaaccaaacuauaccaaaaucccaccacauacaucagcgucggaaccucaacccucaaccaacgccucguacccaaaaucgcaacccgaagcaaagucaacggccaaagcggaagaauggauuucuucuggaccauccucaaaccaaacgacgcaaucaacuucgaauccaacggcaacuucaucgccccggaauacgccuacaaaaucgucaagaaaggcgacagcgccaucguaaaaucagaagucgaauacggcaacugcaacacuaagugccaaacccccauaggcgccaucaacucaucaaugcccuuccacaacauccacccacugaccauuggagaaugccccaaguacgucaagagcaacaaacuuguccucgccacagggcuucgcaacucuccccuccgcgaacgaagaagaaagcgcggacucuucggugccauugccggcuucaucgaaggaggcuggcaaggcauggucgacggcugguacgguuaccaccacuccaacgaacaaggcuccggcuacgccgccgacaaagaaucaacccaaaaagccaucgacggcgucacgaacaaagucaacucuauaaucgacaaaaugaacacccaauucgaagccguaggcagagaguucaacaaccucgaacgccgaaucgaaaaccucaacaagaaaauggaagacggauuccucgacgucuggaccuacaacgcugaacuacucguucuaauggaaaacgaacgcacacuagacuuucaugacucuaacgucaaaaaccuauacgacaaaguacgccuacaacugcgcgacaacgcaaaagaacucggcaacggaugcuucgaguucuaccacaaaugcgacaacgaaugcauggaaagcguacggaacggcaccuacgacuacccccaguacuccgaagaagcacgacucaaacgcgaggaaaucagcggagucaaacucgaaucaaucggaaccuaccaaauacucagcaucuacucaacagucgcaagcucacucgcccucgcaauaaugguagcaggccuaucccucuggaugugcuccaacggaucccuacaaugccgcaucugcauc

SEQ ID NO: 58944 - RNA, 1683 nt, Artificial Sequence
  derived and/or modified sequence opt11 from anti-influenza_Chain
gacaaaauaugccucggccaccacgccgugagcaauggaacaaaagucaacacacuaacagaaaggggagucgaggucguuaacgccacggaaacaguagaacgcaccaacguacccagaauaugcagcaaagguaaacgaacggucgaucucggccaaugcggccuacucggcaccaucaccggcccaccccaaugcgaccaauuccuagaguucagcgccgaccucauaaucgaacgacgcgaaggcucagacguaugcuaccccggcaaauucguaaacgaagaagcccuacgacaaauacuacgcgaaagcgggggaauagacaaagaaacaaugggcuucacauacagcggcauccgaaccaacggcacaaccagcgccugccggcgaucagggagcagcuucuacgcagaaaugaaauggcuacuaagcaacacagacaacgcagcauucccccaaaugacaaaauccuacaaaaacacaagaaaggaccccgcacugauaaucuggggcauccaccacagcggcagcaccacagaacaaaccaaacucuauggaucgggaaacaaacucauaaccgucggaagcucaaauuaccaacaaucauuugucccaagccccggcgcacgaccgcaggucaacggacaaucaggccguaucgacuuccacuggcuaauacugaacccgaacgacaccguaaccuucagcuucaacggagcauucauagccccagaccgcgcgagcuuccuaaggggcaaaagcaugggaauccaaucagaaguccaagucgacgcaaacugugaaggcgacugcuaccacuccggcggcacaauaauaagcaaccuaccguuccaaaacauaaacucucgcgcaguaggaaaaugcccacgcuacguaaaacaagaaagccugcuacucgcgaccggcaugaaaaacgucccugaaauccccaaaagacgcagacgcggacucuucggcgcgauugccggauucaucgagaacgggugggaaggccugauagacggcugguacggauuccgacaccaaaacgcgcaaggagaaggaacagcggccgacuacaaaagcacacaauccgccaucgaccaaaucacaggcaaacuaaaccgacucauagagaaaaccaaccaacaauucgaacucaucgauaacgaguucacagaagucgaacgacaaauagggaacguaauaaacuggacccgcgacuccaugaccgaaguaugguccuacaacgcggaacuccuaguagcaauggaaaaucaacacaccauagaccuagcggacuccgaaaugaacaaacuauacgaacgagucaaacgccaacucagggaaaacgccgaagaagacggaacaggcugcuucgaaaucuuccacaaaugcgacgacgacugcauggccagcauucggaacaacaccuacgaccacuccaaauaccgcgaagaggcaauccaaaaccgcauacaaauagaucccguaaagcucuccagcggcuacaaggacucaggcaggcuagucccccggggcagcccaggcuccggauacauaccagaagcuccgcgcgacggccaagccuacguuaggaaagacggcgaauggguccuacucuccaccuuccugggaaaacccauccccaacccccuacuaggccucgacagcacaggc

SEQ ID NO: 58945 - RNA, 1701 nt, Artificial Sequence
  derived and/or modified sequence opt11 from anti-influenza_Chain
auggaaaagaucguccuccugcuggcaaucguaagccuaguaaaauccgaccaaauaugcauaggcuaucacgccaacaacucaaccgaacaaguggacaccauaauggaaaagaacguaaccgucacccacgcacaagacauccucgagaaaacccacaacggaaaacuuugcgaccuggacggcgucaaaccccucauacuucgagacugcuccgucgcaggcuggcuacugggcaaccccaugugcgacgaauuuaucaacguccccgaaugguccuacaucguugaaaaagccaaccccgccaacgaccuaugcuacccaggcaacuucaacgacuacgaagaacucaaacaucuucucucccgcaucaaucacuucgagaaaauacaaaucauccccaaauccuccuggagcgaccacgaagccuccuccggcgucagcagcgccugcccauaccaaggcaccccauccuucuuccgcaacgucgucuggcugaucaagaaaaacaacaccuaccccacgauaaaacgaucauacaacaacaccaaccaagaagacuuacucauccucuggggcauccaccacucaaacgacgccgccgaacagacgaaacuguaucaaaaccccacaaccuacauaagcguaggcacauccacacuaaaccaacggcucguccccaaaaucgccacccgauccaaaguaaacggccaaaacggacgaauggacuucuucuggaccauucucaaacccaacgacgccaucaacuucgaauccaauggaaacuucaucgcucccgaauacgccuacaaaaucgucaagaaaggcgacuccgccaucgucaaaucagaagucgaauacggaaacugcaacacgaaaugccaaacacccaucggcgccauaaacagcagcaugccauuccacaacauccacccucucaccaucggggaaugccccaaauacguaaaauccaacaaauuaguacucgcaaccgggcugcggaacucaccacuccgcgaaagaagacgcaaacgaggccucuucggcgccaucgccggcuucauagaaggcggauggcagggaauggucgacggaugguacggauaccaccacuccaacgaacaaggcagcggcuacgccgcagacaaagaauccacccaaaaagccaucgacggcgucaccaacaaagugaacuccaucauagacaaaaugaacacccaauucgaagccgucggaagagaauuuaauaaccucgaacgacgcaucgaaaaccuuaacaagaaaauggaagacggcuuccuagacgucuggaccuacaacgccgaacuccucguccuaauggaaaacgaacgcacccucgacuuccacgacucaaacgucaaaaaccuuuacgacaaaguacgacuucaacuccgcgacaacgccaaagaacucgguaacggaugcuucgaguucuaccacaaaugugacaacgaaugcauggaaagcguaagaaacggcaccuacgacuacccccaauacucagaagaggcacgccuaaaacgggaagagauaagcggcguaaaacucgaaucuaucggcaccuaccaaauccucucaauauacucaaccgucgccucaucccucgcccuagccauaaugguagccggccuaucacuauggaugugcucuaauggcucgcuccagugccgcaucugcauc

SEQ ID NO: 58946 - RNA, 1683 nt, Artificial Sequence
  derived and/or modified sequence opt11 from anti-influenza_Chain
gacaaaaucugccucggccaccacgccgucaguaacggaaccaaagugaauacgcucacagaacggggaguagaagucguaaacgcuacagaaaccguggaacgcaccaacguaccccgaauaugcucaaaaggcaaacgaacagucgaccuggggcaaugcgggcuccucggaaccaucaccggacccccgcaaugcgaccaauuccucgaguucagcgcagaccucaucaucgaaagacgcgaaggcagcgacgugugcuaccccggcaaauucgucaacgaagaagcccucagacaaauccuucgcgaaagcggaggaaucgacaaggaaacaaugggauucaccuacucaggaauaagaacaaacggaaccaccagcgcaugccggagaucaggcagcucauucuacgcugaaaugaaguggcuacucagcaacaccgacaacgcagcauucccacaaaugaccaaauccuacaaaaacacccgcaaagaccccgcacuaaucaucuggggaauccaccacagcggcucaacaacagaacaaaccaaauuauacggauccggaaacaaacuuaucacaguuggcagcagcaacuaccaacaguccuucgucccaaguccaggagcccguccccaggugaacgggcagagcggccgaaucgacuuccacugguuaauccucaaccccaacgacaccgucaccuucagcuucaacggcgccuucaucgcacccgaccgcgccucauuccucagaggaaaaagcaugggcauccaaucagaaguccaaguugacgccaacugcgaaggagacugcuaccacagcggcggcacaaucaucuccaacuuaccauuccagaacaucaacagccgagccgucggcaaaugcccacgauacgugaaacaagaaagccuccuacucgcaaccgggaugaaaaacguaccagaaaucccgaaacgacgaagacgagggcuauucggcgccauagcaggcuucaucgaaaacggcugggaaggccuaaucgacggcugguacggauuccgacaccagaaugcccaaggcgaaggaacagccgcagacuacaaaagcacccaauccgcaaucgaccaaaucacaggcaaacuaaaccgccucauagagaaaaccaaccaacaguucgaacugauagacaacgaguucaccgaagucgaacgccaaaucggcaacguuaucaacuggaccagagacuccaugaccgaagugugguccuacaacgcagaacuacucguagcaauggagaaccaacacacaauagaccucgcugacuccgagaugaacaaacucuacgaacgagucaagcgccaacuaagagaaaaugcagaagaagacggaaccggaugcuucgaaauauuccacaaaugcgacgacgacugcauggccucuauaagaaacaacaccuacgaccacagcaaauacagggaagaagccauccaaaaccguauccaaaucgaccccguaaaacucuccagcggauacaaagacagcggccgccucguaccacgaggcagccccggauccggcuacauaccagaagcaccacgcgacggccaagccuacguacgaaaagacggcgaauggguccuccucuccacauuccuaggcaaaccaauccccaacccacuccucggccuagauuccaccgga

SEQ ID NO: 58947 - RNA, 1683 nt, Artificial Sequence
  derived and/or modified sequence opt11 from anti-influenza_Chain
auggaaaagauuguccuacuauucgccaucguaucccuggugaaauccgaccaaaucugcaucggcuaccacgcaaacaacucaaccgaacaaguagacaccaucauggagaaaaacgugaccgucacacacgcccaagauauccucgaaaagacacacaacggaaaacucugcgaccuagacggcguaaaaccacucauacuccgggacugcucaguagcaggcugguuacucggcaaccccaugugcgacgaguucaucaacguacccgaauggagcuacauagucgaaaaagccaacccagucaacgacuugugcuaccccggagacuucaacgacuacgaagaacuuaaacaccuccuaucccgcauuaaccacuucgagaaaauacaaaucaucccaaaguccuccugguccucacacgaagcaucccucgguguauccuccgccugccccuaccagggaaaaagcucauucuucaggaacguagucuggcuaaucaagaaaaacagcaccuaucccaccauaaaacgcuccuacaacaacaccaaucaagaagaccuccucguccuauggggcauacaccacccgaacgacgccgccgaacaaacaaaacucuaccaaaaccccaccaccuacaucucaguaggcacaucaacacucaaucaacggcucgucccaagaaucgccacacgcucgaaaguaaacggccaauccggccgcauggaguucuucuggacaauccuuaaaccaaacgacgccauaaacuucgaaucgaacggcaacuucaucgccccagaauacgcauacaaaaucgucaagaaaggagacucaaccauaaugaaaagcgaacuagaauaugguaacugcaacaccaaaugccaaaccccuaugggagccaucaacucaagcaugcccuuccacaacauccacccccuaaccauaggagaauguccaaaauacguaaaauccaaccgccuaguccucgccacaggccucagaaacuccccacaacgagaacgccgccgaaagaaacgaggucuguucggagccaucgcaggauucaucgaagggggcuggcaaggcauggucgacggcugguacggcuaccaccacagcaacgaacaaggaucaggcuacgccgcagacaaagaaagcacccaaaaagcaauagacggcguuacaaacaaagucaacuccaucauagacaaaaugaacacccaguucgaagcagucggaagagaguucaacaaccucgaacgaagaauagaaaaccucaacaagaaaauggaagacggcuuccuugacgucuggaccuacaacgccgaacugcuaguccucauggaaaacgaacgcacccuagacuuccacgacucaaacgucaaaaaccuauacgacaaaguccgccuucaacuccgcgacaacgccaaagaacugggcaacggcugcuucgaguucuaccacaaaugcgacaacgaaugcauggaaucaguccgaaacggcaccuacgacuacccacaauacuccgaggaggcacgccuaaaacgcgaagaaauaucaggcguaaaacucgaauccaucggcaucuaccaaauucaacacagcggcggaagauccucccucgaaggaccccgcuucgagcaaaaacucaucagcgaagaagaccucaacaugcacacaggc

SEQ ID NO: 58948 - RNA, 1683 nt, Artificial Sequence
  derived and/or modified sequence opt11 from anti-influenza_Chain
auggagaaaaucguacuccuccuagcaauagucucccuaguaaaaagugaccaaaucugcauaggguaccacgccaacaacuccaccgaacaagucgacaccauaauggagaaaaacguaacgguaacacacgcccaagacauacucgagaaaacccacaacggcaaacuaugcgaccucgacggcgucaaaccucucauccuacgcgacugcagcgucgccggguggcuccucgguaaccccaugugcgacgaguucaucaacguaccugaauggagcuacaucguagaaaaagccaaccccgccaacgaccucugcuacccaggcaacuucaacgacuaugaagaacucaaacaccuccucucccgaaucaaccacuucgagaaaauccaaaucauaccaaaaaguucaugguccgaccacgaagccuccucagggguaucaucagccugccccuaccaaggcaaauccuccuucuuccgcaacgugguguggcucauaaagaaaaacucgucauauccaaccaucaaacgcuccuacaacaauaccaaccaagaagaccuacuuguacucuggggcauccaccacccaaacgacgccgcagaacaaacgcgccucuaccaaaaccccaccaccuacauuagcgucggcaccagcacccuaaaccaacgacucguaccuaaaaucgcaacccgcagcaaaguaaacggacaaucagggcggauggaguucuucuggaccauccucaaacccaacgacgccaucaacuucgaaagcaacggcaacuucauagcaccggaauacgcauacaaaaucgucaagaaaggagacuccgccaucaugaaauccgaacucgaauacggcaauugcaacacaaaaugccaaacacccaugggagccauaaacagcuccaugccauuccacaacauccacccccucaccaucggagaaugcccaaaauacguaaaaagcaaccgccugguacucgcuacaggccucagaaacuccccacaacgcgaacgccgacgcaagaaacguggccucuucggcgccaucgccggcuucaucgaaggcggcuggcaaggcauggucgacggcugguacggauaccaccacaguaacgaacaaggaucaggcuacgccgccgacaaagaaucaacccaaaaagcaaucgacggcgucacuaauaaggucaacagcauaaucgauaagaugaacacacaauucgaagcuguaggaagagaauuuaacaaccucgaacgccguaucgaaaaccucaacaagaaaauggaagacggauuccucgacguauggaccuacaacgccgaacuccuaguccuaauggaaaacgaacgaacacucgauuuccacgacuccaaugucaaaaaucuauacgauaaaguccgacuccaacugagagacaacgcaaaagaacucggcaacggcugcuucgaguucuaucacaaaugcgacaacgaaugcauggaaagcguccguaacgguacauacgauuacccacaauacagcgaagaagccagacucaaaagagaggaaaucuccggagucaaacucgaaucuauaggaauauaccaaauccaacauagcggcgggagauccucccucgaagggccccgcuucgaacaaaaacuaaucagcgaggaagaccucaacaugcacaccggc

SEQ ID NO: 58949 - RNA, 1701 nt, Artificial Sequence
  derived and/or modified sequence opt11 from anti-influenza_Chain
auggaaaagaucguccuacuccucgccauagucucccucgucaaauccgaccaaauaugcaucggauaccacgccaacaacuccacagaacaaguagacaccaucauggagaaaaacguaaccguaacccacgcccaagacauccuggagaaaacacacaacggaaaacuaugcgaccucgacggcgucaaaccacuaauccuccgcgacugcuccgucgccggauggcuacuagguaacccaaugugcgacgaguucaucaacgucccagaauggucauacaucgucgaaaaagcuaacccggccaacgaccuaugcuacccaggcaacuucaaugacuacgaagaacucaaacaucuacucagcagaaucaaccacuucgagaaaauccaaauaaucccaaaauccuccugguccgaccacgaagccagcagcggcguauccucagcgugccccuaccaaggaacccccagcuuuuuccgcaacgucguauggcucaucaaaaagaacaacaccuaccccaccauaaaacgaucuuacaacaacacgaaccaagaagacuuacucauacuauggggaauccaccacuccaacgacgccgcagaacaaaccaaacuauaccaaaaccccacaaccuacauauccgucggcaccagcacccucaaccaacgccucguccccaaaaucgccacacgcucaaaaguaaacggccaaaacggacgaauggacuucuucuggaccauccucaagccaaacgacgccauaaacuucgaauccaacggcaacuucauagcacccgaauacgcauacaaaaucgucaagaaaggcgacucggcaaucguaaaauccgaaguagaauacggcaacugcaacaccaaaugccaaaccccaaucggagccaucaacucaucaaugcccuuccacaacauccacccccuaaccaucggcgaaugccccaaauaugucaaaagcaacaaacuuguccuagcaaccggccuacgaaacuccccacuaagggaacggcgcagaaaacgcggucucuucggagccaucgccggcuuuaucgaaggaggcuggcagggcaugguagacggcugguacggcuaccaccacucaaacgaacaaggauccggcuacgcugcagacaaagaaagcacacaaaaagcgauugauggagucacgaacaaagucaacuccaucaucgacaagaugaacacacaauuugaagccgucggccgcgaguucaacaaccucgaaagacgcaucgaaaaccucaacaagaaaauggaagacggauuccucgaugucuggaccuacaacgcagaacugcuagugcucauggaaaacgaacgcacccuggacuuccaugacagcaaugucaaaaaccucuacgacaaaguccgccuccaacuccgcgacaacgcuaaagaacucggcaacggaugcuucgaguucuaccacaaaugcgacaacgaaugcauggaaucaguccgcaacggcacguacgacuacccacaauacucugaagaagcgcgacucaaacgggaagaaaucucaggaguaaaacuggaaucaaucggcaccuaccaaauccuaagcaucuacagcacuguugccuccucacucgcucucgcaaucaugguggcaggacuuagccuguggaugugcuccaacggaucccuacaaugccgcaucugcauc

SEQ ID NO: 58950 - RNA, 1701 nt, Artificial Sequence
  derived and/or modified sequence opt11 from anti-influenza_Chain
auggagaaaauaguccuccuacucgcaauagucagccucgucaaaucugaccagauaugcaucggguaccacgccaacaacuccaccgaacaaguagacacuaucauggaaaagaacgugaccgucacccacgcccaagacauccuagagaaaacccacaacggcaaacucugcgaccucgacggcgucaaaccgcuaauacuccgagacugcagcguagccggauggcuacuaggcaacccaaugugcgacgaguucaucaacguucccgaaugguccuacauuguagaaaaagcaaaccccgccaacgaccuaugcuacccgggcaauuucaacgacuacgaagaacucaaacaccuccucucccgcaucaaccacuucgagaaaauccaaaucaucucaaaauccagcugguccgaccacgaagccuccagcggcgucucauccgcaugccccuaccaaggcacaccaucauucuuccgcaacgucguguggcucauaaagaaaaacaacaccuacccaaccaucaaacgaucauacaacaacaccaaccaagaagaccuccuaauacuuuggggaauccaccacagcaacaacgcagcagaacagacaaaacucuaccaaaacccgaccaccuacaucagcgugggaacaagcacccucaaccuccgguuaguccccaaaauagccacacgcagcaaaguaaacggccaaagcggcagaauggacuucuucuggaccauacucaaacccaacgacgccauaaacuucgaaagcaacggcaacuucaucgccccggaauacgccuauaaaauaguaaagaaaggcgacucggccauaaugaaauccgaagucgaauacggcaacugcaacacaaaaugccaaacacccaucggcgccaucaacagcuccaugccuuuccacaacauacacccccucacaaucggcgaaugcccaaaauacguaaaauccaauaagcuaguccuagcaacaggacuccgcaacuccccgcuacgagaacgacgucgcaagcgaggacucuucggggcaauagcgggcuucaucgaaggcggauggcaagggaugguagacgguugguacggcuaucaccacagcaacgaacaaggguccggcuacgcagcagacaaagaaagcacccaaaaagcaauugacggcgucacaaacaaaguaaacagcauuauagacaaaaugaacacccaauucgaagcagucggacgagaguucaacaacuuagaaagacgcaucgaaaaccucaacaagaaaauggaggacggcuuccuagacguguggacguacaacgccgagcuccucguccugauggaaaacgaacgcacccucgacuuccacgacucaaacgugaaaaaucucuacgacaaaguccgccuccaacuccgcgacaacgcuaaagaacuaggcaacggcugcuucgaguucuaccacaaaugcgacaacgaaugcauggaaagcguccggaacggcacauacgacuacccccaauacuccgaagaagccagauuaaagcgcgaagaaaucuccgggguaaaacucgaaagcaucggcacuuaccaaauccuauccaucuacuccaccguagccucaucccuagcacucgcaaucaugguugcaggccucucacucuggaugugcucaaacggcucacuccaaugccgaaucugcauc

SEQ ID NO: 58951 - RNA, 1701 nt, Artificial Sequence
  derived and/or modified sequence opt11 from anti-influenza_Chain
auggagaaaaucguccugcuacuggcaauagucucccuagucaaauccgaccaaauaugcaucggcuaccacgcuaacaacuccaccgaacaaguagacaccaucauggaaaagaacguaaccgucacccacgcccaagacauccucgaaaagacacacaacggcaaacucugcgaccuagacggcgucaaaccccucauacuccgggacugcucagucgcaggcuggcuccucggcaacccaaugugcgacgaguucaucaacguaccggaauggucauacauagucgaaaaagcaaacccagccaacgaccucuguuacccaggaaauuucaacgacuacgaagaguuaaaacaccuccuaucacgcaucaaccacuucgagaaaauccaaaucauaccaaaaucaagcuggagcgaccacgaagcauccuccggcgucagcagcgccugcccuuaccaaggcacucccuccuucuuccgaaacguaguauggcugaucaagaaaaacaacacauacccaaccauaaaaagauccuacaacaacacaaaccaagaagaccucuuaauacucuggggcauccaccacuccaacgacgccgcagaacaaacgaaacucuaccagaacccaaccaccuacaucaguguaggcaccuccacccuaaaccaacgccuagucccaaaaaucgccacaagauccaaagucaacggccaauccggacguauggacuucuucuggaccauccucaaacccaacgacgcuauaaacuucgaaagcaacgguaacuucaucgcacccgaauacgccuacaaaaucgucaagaaaggcgacuccgccaucgucaaaagcgaaguagaguacggaaacugcaacacaaaaugccaaacccccaucggugccaucaacagcuccaugcccuuccacaacauccauccacucaccaucggugaaugccccaaauaugucaaauccaacaaacucguccucgcaacaggacuacgcaauucaccucucagagaacgacgccggaaacgcggacucuucggagcaauagccggauucauagaagggggauggcaaggcauggucgacggcugguacggauaccaccacucaaacgaacaaggaucuggcuacgccgcagacaaagaaucaacucaaaaagcgaucgacggcguaacgaacaaagucaacucaauaaucgacaaaaugaacacccaauucgaagccgucggacgcgaguucaacaaccucgaacgccgcaucgaaaaucucaacaagaaaauggaagacggauuccucgacgucuggacauacaacgccgagcuacucguccuuauggaaaacgaacgcacccuagauuuccacgacuccaacgugaaaaaccuauacgacaaaguacgccuccaacuacgcgacaacgcaaaagaacucggcaacggcugcuucgaguucuaccacaaaugcgacaacgaaugcauggaaagcguccgcaacggcacguacgacuacccccaauacuccgaagaagcccgccugaaacgcgaagaaaucucaggcguaaaacuagaauccaucggaacuuaccagauccucaguauauacuccaccgucgccuccucccucgcccucgccaucaugguggccgggcucucccuauggaugugcagcaacgguucacuccaaugccgaaucugcauu

SEQ ID NO: 58952 - RNA, 1704 nt, Artificial Sequence
  derived and/or modified sequence opt11 from anti-influenza_Chain
auggaaaagauaguccuucuccucgcaauagucagccuaguaaaaucagaccaaaucugcaucggcuaccacgccaacaacagcacagaacaagucgacaccaucauggaaaagaacgucacugucacccacgcacaggacauacuagaaaagacccacaacggcaaacucugugaccucgacggagucaaaccccugauccuccgcgacugcuccgucgccgguuggcuacuaggaaacccaaugugcgacgaguuccuaaacguacccgaaugguccuacaucguggaaaagaucaaccccgcaaacgaccucugcuaccccggggauuucaacgacuacgaagaacucaaacaccuacucucacgcauaaaucacuucgagaaaauccaaauuauccccaaauccuccuggagcgacuacgaagccagcuccggaguaagcagcgccugcccuuaccaaggccgcucuagcuucuuccgaaacgucguguggcucaucaagaaaaacaacgccuaccccacaauaaaacgcuccuacaacaacacgaaccaagaagaccuccuugugcucuggggcauucaccacccaaacgacgccgccgaacaaauacgccucuaccaaaacccaaccacauacaucucgauaggaacaaguacccuaaaccaacgacuggugccaaaaaucgcaacccgcagcaaagucaauggacaguccggccgcauggaguucuucuggaccauacuuaaauccaacgacgcaaucaacuucgaauccaacggaaacuucauagcccccgaauacgcauauaaaaucgugaagaaaggcgacuccaccauaaugaaauccgaacuugaauacggcaacugcaacaccaaaugccagacacccauaggagcgaucaacagcucaaugcccuuccacaacauacacccccucacgaucggcgaaugccccaaauacgucaaauccaaccgccuaguccuagccacaggacuccguaacagcccccaaggagaacgacgccgccgcaaacgcggacuauucggggccauagccggcuucaucgaaggaggauggcaggggauggucgacggcugguaugguuaccaccacagcaacgaacagggcucaggauaugccgccgacaaagaauccacacaaaaagccauagacggugucaccaacaaaguuaacuccauaauaaacaaaaugaacacacaauucgaagcaguuggccgcgaguucaacaaccucgaacgccgcauagaaaaccucaacaagaaaauggaagacggauuccuugacgucuggaccuacaacgcagaacuccuaguccuaauggaaaacgaacgcacacuggacuuucacgacucaaacgucaaaaaccuauacgacaaaguccgccuccaacugcgagacaacgccaaagaacuaggcaacggcugcuucgaguucuaccaccgaugcgacaacgaaugcauggaaucagugcgcaacggaacuuacgacuacccacaauacagcgaagaagcaagacucaaacgugaagaaauauccggcgucaaacuagaauccaugggcaucuaccagauccuauccaucuacuccaccgucgcauccucccucgcccuagccaucaugguggcaggccuauuccuguggaugugcuccaacggcagccuccaaugucggaucugcauc

SEQ ID NO: 58953 - RNA, 1704 nt, Artificial Sequence
  derived and/or modified sequence opt11 from anti-influenza_Chain
auggaaaagauaguccuccuacuagcaaucguaagccucguaaaauccgaccaaaucugcaucgguuaccacgccaacaacagcacagaacaaguagacaccaucauggaaaaaaaugucaccguaacucacgcccaggacauccucgaaaaaacccacaauggcaaacucugcgaccucgacggcgucaaaccucucauccugcgggacuguucaguugccggguggcuccuaggcaaccccaugugcgacgaauuuaucaacgucccagaauggucuuacaucgucgaaaaagccaaccccaccaacgaucucugcuaccccggcuccuucaacgacuacgaagagcuuaaacaccuccuaucccgcaucaaccacuucgaaaaaauccaaaucauccccaaaucuuccugguccgaccacgaagccuccucgggagucucauccgccugccccuaccuaggcucuccaagcuucuucagaaaugucgucuggcuaauaaaaaaaaauuccacauaccccaccaucaagaaauccuacaacaacacaaaccaagaagaccuccuaguacucuggggcauccaccaccccaacgacgcagccgaacaaacccgccucuaccaaaaccccaccacauacauaucgauuggaaccuccacuuuaaaucaaagacucgucccaaaaaucgccacacgcucaaaagucaacggccaaagcggccguauggaauucuucuggaccauccucaaacccaacgacgccaucaacuuugaaagcaacggcaacuucaucgcccccgaauacgcauacaaaaucgucaaaaaaggcgacuccgccaucaugaaaucugaacucgaauacggcaacugcaacaccaaaugucaaacacccaugggcgccaucaacucauccaugccauuccacaacauccacccccucacaaucggcgaaugccccaaauacgucaaaagcaaccgccuaguacuagcaacaggacuccgcaacagcccccaacgugaaucccgacgcaagaaacgaggccuguuuggcgccauugccggcuucauagaagggggcuggcaagguauggucgacggcugguacggauaccaccacagcaacgaacaaggcuccggcuacgccgccgacaaagaauccacccaaaaggccauagacggagucacaaauaaagugaauuccaucauagacaaaaugaacacccaauuugaagcagucggacgcgaauucaacaaccuggaacgccgcauagaaaaucucaacaaaaaaauggaggacggcuuccuugacgucuggacuuacaacgccgaacuacucguccuaauggaaaacgaaagaacccuggacuuucaugacucaaacgucaaaaaccuauacgacaaaguccgacuccagcuccgcgacaacgcaaaagagcuaggcaacggaugcuucgaauucuaccauaaaugcgacaacgagugcauggaauccauccgcaacggcaccuacaacuacccacaguacagcgaagaggcccgacuuaaacgagaagagaucucaggcgucaaacucgaaucaaucggaaccuaccaaauacucuccauauacuccaccgucgccuccucccuagcccuagccaucaugauggccggccucagccuauggaugugcucaaacggcucacuccaaugccgcaucugcauu

SEQ ID NO: 58954 - RNA, 1704 nt, Artificial Sequence
  derived and/or modified sequence opt11 from anti-influenza_Chain
auggagaaaauaguacuccucuucgccauaguaagccuggugaaauccgaccagauaugcaucggauaccacgccaacaacucgaccgaacaaguggacacaaucauggagaaaaacgucacagucacccacgcccaagacauccuugagaaaacccacaacggaaaacucugcgaccucgacggagucaaaccccucauccuccgcgacugcagcgucgccgguuggcuacuaggaaacccuaugugcgacgaauuuaucaacguccccgaauggucuuacaucguagaaaaagccaacccagucaacgaccugugcuaccccggcgacuucaacgacuacgaagaacucaagcaccuacucucaagaauaaaccacuucgagaaaauccaaauaaucccgaaaagcagcuggucaucccacgaagccagccugggcgucuccucggcaugucccuaccaaggcaaauccuccuucuucagaaacgucguuuggcucauaaagaagaacuccacauaccccaccaucaaaagauccuacaacaacaccaaccaagaggaccuccuugugcucuggggcauacaccaccccaacgacgcagccgaacaaacaaaacuauaccaaaacccuaccaccuacauuagcguaggcaccucgacgcugaaucaacgacucgucccacgaaucgcaacccgcuccaaagucaacggccaauccggccgaauggaauuuuucuggaccauccucaaaccaaacgacgcuauaaacuucgaaucaaacggaaacuucaucgccccugaguaugccuacaaaaucguaaagaagggcgacuccacgaucaugaaauccgaacucgaauauggaaacugcaacaccaaaugccagacaccaaugggcgccaucaacagcuccaugcccuuccacaacauccacccccuaacgaucggagaaugcccaaaauacgucaaguccaaccgccucguccucgcaaccggccuccgaaacagcccacaaagagaacgccgccgcaagaaacgcggucucuucggcgcaauagcuggauucaucgaaggcggauggcaaggaaugguagacggaugguacggcuaccaccacucaaacgaacaaggcuccggcuaugcagccgacaaagaaucgacacaaaaagcaauagacggagucacaaacaaagucaacuccaucauagacaaaaugaacacccaauucgaagcaguaggccgcgaguucaacaaccucgaacgacgcaucgaaaaccuaaacaagaaaauggaagacggcuuccucgacgucuggacuuacaacgcggaacuacucguacucauggaaaacgagcgaacacuagacuuccacgacuccaacgucaaaaaccuuuacgacaaagugcgccuccagcuccgagacaacgccaaagaacucggaaacggcugcuucgaguucuaccacaaaugcgacaacgaaugcauggaauccguccgaaacggcacauacgacuacccacaauacagcgaagaagcccgccucaaacgcgaagaaauaagcggagucaaacucgaaucaauaggcauauaccaaauacucuccaucuacuccacaguggccuccagccuagcacuggcaaucauggucgcaggccuaagccuuuggaugugcagcaacggcucccuccaaugccggauaugcauc

SEQ ID NO: 58955 - RNA, 1704 nt, Artificial Sequence
  derived and/or modified sequence opt11 from anti-influenza_Chain
auggagaaaaucguccugcuacucgcaaucgugagccucgucaaauccgaccagaucugcauaggcuaccacgccaacaacagcacggaacagguagacacaaucauggaaaagaacgucacagucacgcacgcccaagacauccuagagaaaacacacaacggcaagcuaugcgaccuagacggcgucaaaccacucauccuccgagacugcaguguagccggcuggcuacucggcaacccaaugugcgacgaguuccucaacgucccagaauggagcuacaucguagaaaagauaaacccagccaacgaccucugcuacccaggcgacuuuaacgacuacgaagaacucaaacaccuccuaagccgcaucaaccacuucgagaaaauccaaaucaucccuaaauccuccuggagcgacuacgaagccuccucuggaguauccuccgccugcccauaccaaggcagaagcagcuucuucagaaacguagucuggcugaucaaaaagaacaacgccuaccccaccauaaaacgcucauauaacaacacuaaccaagaagaccuacugguccucuggggcauucaccaccccaacgacgccgcggaacaaauccgccuuuaccaaaaccccaccaccuacaucucaaucggaaccuccacgcucaaccaacgucuggucccaaagauagccacacgcagcaaagucaacggacaaagcggacgaauggaguucuucuggaccauacuaaaauccaacgacgcaaucaacuucgaaagcaacggaaacuucaucgcccccgaauacgccuacaaaauagucaagaaaggagacuccacaauuaugaaauccgaacucgaauacggcaacugcaauacaaaaugccaaaccccaaucggagccaucaacucauccaugcccuuccauaacauccacccccuuacgaucggagaaugcccgaaguacguaaaaucgaaccgccuaguccuagcaacaggccucagaaacuccccacaaggagaacgccgccgccgcaaacgcggccuauucggcgccaucgccggcuucauagaaggaggauggcaaggcauggucgacggcugguacggguaccaucacagcaacgaacaaggcuccggcuacgccgcugacaaagaaagcacacaaaaggccauugacggcguaaccaacaaaguaaacagcauaaucaacaaaaugaacacgcaauucgaggccguaggccgagaguucaacaaccuagaacgccgaauagaaaaccucaacaagaaaauggaagacggauuccucgacgucuggacauacaacgccgaacuacucguccucauggaaaacgaacgcacccucgacuuccacgacucaaacgugaaaaaccuauaugacaaaguccgccuccaacuccgcgacaacgcaaaagaacucgguaacggcugcuucgaguucuaccacagaugcgacaacgaaugcauggaguccguaagaaacggcaccuacgacuacccacaauacucagaggaagcacgccuaaaacgcgaggaaauaucaggcgugaaacucgaaagcaugggcaucuaccagauccuauccaucuacucgaccgucgcuuccucccucgcccuagcaaucaugguggccggacuauuccucuggaugugcagcaacggcagccuacaaugccgcauaugcauc

SEQ ID NO: 58956 - RNA, 1704 nt, Artificial Sequence
  derived and/or modified sequence opt11 from anti-influenza_Chain
auggagaaaaucguacugcuccuugcaaucguaagccucgucaaauccgaucaaauaugcauaggcuaccacgccaacaacuccaccgaacaagucgacaccaucauggagaaaaacgucaccgucacccacgcccaagacauccucgagaaaacccacaacggcaaacuaugcgaucuagacggcgucaaaccacucauacugcgcgacugcuccgucgccggauggcuccucggcaaccccaugugcgaugaauuuaucaacguccccgaaugguccuauaucguggaaaaggcaaaccccacgaacgaucucugcuaccccggguccuucaacgacuacgaggaacucaaacaccuacuaucgagaaucaaccacuucgagaaaauucaaaucauccccaaaagcuccuggagugaccacgaagccuccagcggagucagcagcgcaugccccuaccucggaucccccuccuucuuccgcaacgucgucugguuaauaaagaagaacuccaccuacccaaccaucaaaaagagcuacaacaacaccaaccaagaagaccugcuaguacucuggggcauacaccaccccaacgacgcagccgaacaaacccgccuauaccaaaauccaacaaccuacauaagcauaggaacgagcacccucaaccaacgacugguccccaaaauagccacaagaagcaaggucaacggacagucaggcagaauggaguucuucuggaccauacuaaagcccaacgacgccaucaauuucgaaagcaacggaaacuucaucgcaccagaauacgcauacaaaaucgucaagaaaggcgacuccgccauuaugaaaagcgaacuagaauacggaaacugcaacaccaagugccaaacccccaugggcgccaucaacuccucaaugcccuuccacaacauacacccccuaacgaucggcgaaugccccaaauacguaaaauccaaccgccuaguacucgccaccggacuccgaaauucgccccaacgcgagucacgccgcaagaaaagaggccucuucggagccaucgcugguuucaucgaaggcggcuggcaaggcaugguggacgggugguacggcuaccaucacagcaaugaacaaggcucaggauacgcagccgacaaagaauccacucaaaaggcaauagacggcgucaccaacaaaguuaacucaauaaucgacaaaaugaacacccaauucgaagcagucggccgcgaguucaauaaccucgaacgcagaaucgaaaaccuaaacaaaaagauggaagacggcuuccucgacgucuggaccuacaacgcagaacuccucguccucauggaaaacgaacgaacgcucgacuuccacgacucgaacgucaaaaaccucuacgacaaaguacgccuccaacugagagacaacgccaaagaacucgguaacggcugcuucgaguucuaccauaaaugcgacaacgaaugcauggaaagcauccgcaacggcacauacaacuacccgcaauacuccgaagaagcccgcuuaaaacgcgaagaaaucuccggcguaaaacucgaaucaauaggaacauaccagauacucagcaucuacucgaccguagccuccucccucgcccucgcaauaaugauggcgggccucucccucuggaugugcuccaacggaucacuucaaugccgcauaugcauc

SEQ ID NO: 58957 - RNA, 1704 nt, Artificial Sequence
  derived and/or modified sequence opt11 from anti-influenza_Chain
auggaaaagaucguccuacucuucgccaucgugucacucgucaaaucagaccaaauaugcaucggguaccacgccaacaacuccaccgaacaagucgacacaauaauggaaaagaacgucacaguaacccacgcccaagacauacuggaaaagacccacaauggcaaacucugugaccucgacggaguaaaaccgcucauacuacgcgacugcagcgucgccggauggcuacucggaaacccgaugugcgacgaguucauaaacguccccgaauggucauacaucguggaaaaagccaacccagucaacgaccucugcuacccgggcgacuucaaugacuacgaagaacucaagcaccuccucucccgcaucaaccacuucgaaaagauccaaaucauccccaaauccagcuggagcagccacgaagcaagccuaggcgucaguagcgcaugccccuaccaagggaaauccagcuucuuccgcaacguagucuggcucaucaagaaaaacucaaccuaccccacaaucaaaagaagcuacaauaacacaaaccaagaagaccuccuaguccuauggggcauccaccauccaaacgacgcagccgaacaaacgaaacucuaccagaaccccacaaccuacaucucaguagggaccucaacccucaaccagcgacucguaccccgaauagcgacaagaagcaaagucaacggacaaagcggccgcauggaguucuucuggacuauccucaaaccaaacgacgccaucaacuucgaaucaaacggcaacuucaucgccccagaauacgccuacaaaaucgucaagaaaggcgauuccaccauaaugaaaucagaacucgaauacggaaacugcaacacgaaaugccaaacaccaaugggcgcaaucaacagcuccaugccauuccacaacauacacccgcucaccaucggcgaaugucccaaauacguaaaaagcaaccgccuaguauuagccacaggacucagaaacuccccacaaagagaaagaagacgaaagaaaaggggacuguucggcgcgaucgccggguuuauagaaggcggcuggcaaggaauggucgacggcugguacggauaucaccauucaaacgaacaaggauccggauacgcggccgacaaagaauccacccaaaaagccauagauggcgucaccaacaaagucaacagcauaaucgacaaaaugaacacccaauuugaagccguaggccgagaauuuaacaaccuagaaagaagaauagaaaaccucaacaagaagauggaagacggcuuccuagacgucuggaccuacaacgccgaacuccucgugcucauggaaaacgaacgaacacuagacuuccacgacagcaacgugaaaaaccucuacgacaaagugcggcuccaacuaagagacaacgccaaagaacucggcaacggaugcuucgaguucuaccacaaaugcgacaacgaaugcauggaaagcguccgaaacggcaccuacgacuacccccaauacagcgaagaagcccgacucaagcgcgaagaaaucuccggcguaaaacuugaaucaaucggaauauaccaaauccucuccauauacuccaccgucgccagcagccuugcccucgccauuauggucgccggccuaucacucuggaugugcucaaacggaucccuccaaugccgcauaugcauc

SEQ ID NO: 58958 - RNA, 1707 nt, Artificial Sequence
  derived and/or modified sequence opt11 from anti-influenza_Chain
ucgaaaagccgaggauacaaaaugaacacccaaauacucguauucgcacuuguagcaucaaucccaacaaacgcugacaaaaucugccucggacaccacgcaguaagcaacggcaccaaagucaacacccucaccgaacgcggcguagaaguggucaacgccaccgaaaccguagagcgcacaaacguaccccgaaucugcuccaaaggcaaacgcaccguagaccuaggccagugcggccuccucggcaccaucaccggcccaccccaaugcgaccaauuucuagaguucuccgccgaccucauaaucgaacgccgagaaggcagcgacgugugcuaccccggaaaauucguuaacgaagaagcacuacgccaaauacuacgagaauccggcggaaucgacaaagaaaccaugggauucaccuacaguggcauccgcacuaacggcacaacaagcgcaugccgacgauccggaucauccuucuacgcagaaaugaaauggcuccugagcaacacagacaacgccgcuuucccccaaaugacaaagucauacaaaaacacccgcaaagacccugcccuaauaauauggggcauccaccacagcggaagcacaacagaacaaaccaaacucuacggcuccgguaacaaacuaauaacgguagggagcucaaacuaucaacagagcuucguacccagccccggcgcccgcccccaagucaacggacaauccggacgcauagacuuccacuggcuaauccugaaccccaacgacacaguaaccuucagcuucaacggagccuucauagcacccgaccgagccuccuuccuucgcgguaaaagcaugggaauacaaucagaagugcaagucgacgcaaacugcgaaggagauugcuaccacagcggcggcacaaucauaagcaaccucccauuccaaaacaucaacucaagagccgucggaaaaugcccaagauacgucaagcaagaaucccuacuucuagccacaggcaugaaaaacgucccagaaauacccaaaagacgccgacguggccucuuuggcgccaucgcuggguucaucgagaacggcugggaaggccuaauagacggaugguacggauuccgacaccagaacgcccaaggcgagggcaccgcugcagacuacaaaagcacgcaauccgcaaucgaccaaaucaccggcaaacucaaucgccuaaucgagaaaacgaaccagcaauucgaacuaaucgacaacgaguucacagaaguggagcgccaaaucggaaacguaaucaauuggacacgcgacuccaugaccgaaguauggucauacaacgccgagcuccuaguugcaauggaaaaccaacacaccauagaccucgcagacuccgaaaugaacaaacuauacgaacgaguaaaacgacaacuccgagaaaacgcagaagaagacggcaccggauguuucgaaaucuuccacaaaugcgacgacgacugcauggcaucaauacgcaacaacacauacgaccacagcaaauaccgagaagaggccauacaaaaccgcauccaaauagaccccgugaagcucuccagcggauacaaagacguaauucucugguucuccuucggugccuccugcuucauccugcucgcaauagccaugggccucgucuucaucugcgucaaaaacggcaacaugcgcugcaccauaugcaua

SEQ ID NO: 58959 - RNA, 1707 nt, Artificial Sequence
  derived and/or modified sequence opt11 from anti-influenza_Chain
aguaaaucccgcggcuacaagaugaacacccaaauccuagucuucgcccucguggcgaguauacccaccaacgcugacaaaaucugccuaggccaccacgccguaucaaauggaaccaaaguaaacacacucacggagcgcggcgucgaagucgucaacgccaccgaaaccguagaacgaacgaacguuccccgcauuugcagcaaaggcaaacgcaccguggaccucggacaaugcggccuacuagggaccaucacaggcccaccccaaugcgaccaauuccuagaguucucagcagaccuaaucaucgaaaggcgggaaggcagcgacgucugcuaccccgguaaauucgucaacgaagaagcacuacgccaaauccugcgagaguccggagggaucgacaaagaaaccaugggguucaccuacucgggaauccgcacaaacgguaccacaagcgccugccgccgcuccggcuccagcuucuacgccgaaaugaaauggcuacucagcaacacagacaacgccgcauucccccagaugacaaaaucguacaaaaacacccgcaaagaccccgcccucauuaucuggggaauacaccacuccggcucgaccacagaacaaacuaaacucuacggcagcggcaacaagcucaucaccgucggauccagcaacuaccagcaauccuucguaccaucccccggcgcacguccgcaagucaacggccaauccggccgcaucgauuuccacuggcugauccucaacccaaacgacaccguaacuuucagcuucaacggcgcauucauagcacccgacagggccagcuuccuccgaggaaaaagcaugggaauacaauccgaaguacaagucgacgcaaauugcgaaggagacuguuaccacucagggggcaccauaauaagcaaccucccauuccaaaacauaaacucccgagcaguggggaaaugcccacgauacguaaaacaagaaucacuacuacucgcaaccgggaugaaaaacgucccggaaauccccaaacgccgccgacgaggccucuucggcgcaauagccggcuucauagagaacggcugggaaggacucaucgacggaugguacggcuuccgccaccaaaacgcccaaggcgaaggaacggccgcagacuacaaaucaacgcaaucagccaucgaccagaucacaggcaaacucaaccgacucauagaaaagaccaaccagcaauucgaacuaaucgacaacgaguucacggaagucgagcgccaaauaggcaacgucauaaacuggacccgcgacucaaugaccgaaguauggagcuacaacgccgaacuacucguagcgauggagaaccaacacacaaucgaccucgcagacucagaaaugaacaaacuguacgaaagagucaaacggcaacuacgcgaaaacgccgaagaagacggaaccggcugcuucgaaauauuccacaaaugugacgacgacugcauggccuccauacggaacaacaccuacgaccacuccaaauaccgagaagaagccauccaaaaccgaauccaaaucgaccccgucaaacuuagcuccggcuacaaagacgucauacuaugguucuccuuuggagccuccugcuucauacuacuagcaauagcaaugggucucgucuucaucugcgucaaaaacggcaacaugcggugcacaaucugcaua

SEQ ID NO: 58960 - RNA, 1692 nt, Artificial Sequence
  derived and/or modified sequence opt11 from anti-influenza_Chain
gaccaaauaugcaucggcuaccacgccaacaacuccaccgaaaaaguggacaccaaccuagaaagaaacguaacagugacacacgccaaagacauacucgagaagacccacaacggcaaacuaugcaaacuaaacggcaucccaccccuagaacugggagacugcucaaucgccggauggcuacuaggaaacccagaaugugaccgacuacugucaguacccgaauggucguacaucauggaaaaagaaaacccccgagacggccucugcuaccccggcuccuucaacgacuacgaggagcuaaaacaccuacucuccuccguaaaacacuucgaaaaagucaagauccucccaaaagaucgcuggacacaacacaccaccacaggaggcucccgugcaugcgccgucagcggaaaccccagcuucuuccgcaauaugguauggcuaaccaaagaaggcucagacuacccaguagccaaaggaagcuacaacaacaccucaggugaacaaaugcucaucaucuggggcguucaucacccaaucgacgaaacagaacaacguacccucuaccaaaacgucggcacauacgucucaguagggacuagcacccuaaacaaaagaagcacccccgaaaucgccacacgaccaaaagucaacgggcaaggaggcagaauggaauuuuccuggacccuccucgacaugugggacacaaucaacuucgaauccaccggcaaccugauagccccggaauacggcuucaaaaucuccaaacgaggcagcagcggaauaaugaaaacagagggcacacuggaaaacugcgagaccaaaugccaaaccccacucggggccauaaacaccaccuugcccuuccacaacguacacccauugaccauaggcgaaugcccaaaauacgucaaaucugagaagcuaguccuagccaccggccuccgaaacgucccccaaauagaaucccguggacucuucggcgccauagccggcuucauagagggcggguggcaggggauggucgacggcugguacggcuaucaccacucaaacgaccaaggcucaggauacgcggccgacaaagaaagcacccaaaaggccuucgacggaauaaccaacaaagugaacagcgucaucgagaaaaugaacacucaauucgaagcaguaggaaaggaguucggaaaccucgaaagacgccuagaaaacuuaaauaagcgaauggaagacggcuuccuagacguuuggaccuacaacgcagaacuacucguacuaauggaaaacgagcgaacgcucgauuuccacgacucaaacgucaaaaaccuauacgacaagguacgaaugcagcuccgagacaacgucaaagaacuaggaaacggcugcuucgaguucuaccacaaaugcgacgacgaaugcaugaacuccgucaaaaacgggaccuacgacuaccccaaauacgaagaagaaaguaaacucaaccgaaacgaaaucaaaggcgucaaacucuccuccaugggaguauaccagucgggccgccuggucccacguggcagcccaggcuccggauacauccccgaagcccccagagacggacaagcguacgucagaaaagacggcgaauggguccugcucuccaccuuccugggcaaaccaaucccuaacccccuacugggccuggacucuaccggg

SEQ ID NO: 58961 - RNA, 1692 nt, Artificial Sequence
  derived and/or modified sequence opt11 from anti-influenza_Chain
caaaaacucccgggcaaugacaacagcaccgccacacucugccuaggccaccacgccgugcccaacgguacaaucguaaaaacaaucaccaacgaccaaaucgaagugaccaacgccacagagcuaguccaaaguuccagcacaggaggcauaugcgacucaccacaccagauacucgacggcgaaaacugcacccuaaucgacgcccuccuaggcgacccacaaugcgacggcuuccagaacaagaaaugggaccuauucgucgaacgcagcaaagccuacuccaacugcuacccauacgacguaccagacuaugcgagccuacgcucgcucgucgcaagcucaggcacacuagaguucaacgacgagagcuucaacuggaccggcgucacccaaaacgggaccucuucauccugcaaacgacgcagcaacaacucauucuucagcaggcucaacuggcugacccaacuaaaauucaaguaccccgcccuaaacguaacaaugccuaacaacgaaaaauucgacaaacuauacaucuggggaguacaccacccagucacagacaacgaccaaaucuuccuauacgcccaagcaagcggccgcauaaccgugagcacaaaacgaucucagcaaaccgucauccccaacauagguagucgaccucgaauccgaaacauacccucaagaaucucaaucuacuggacaaucguaaagcccggcgacauccuccucaucaacuccaccggaaaccucauagcaccccgcggcuacuucaaaauccgaagcggaaaguccuccaucaugcgaucggacgcaccaauuggcaagugcaacagcgaaugcauaaccccaaacgggucaauccccaacgacaagccuuuccaaaacgucaacagaaucaccuauggcgccugcccacgcuacgucaaacaaaacacacuaaaacucgccacaggaaugcgcaacguucccgaaaaacaaacgagagguaucuucggcgccauagcagguuucaucgaaaacgggugggaaggcauggucgacgguugguacggcuucagacaccaaaacuccgaaggaauaggacaggcagccgaccuaaaaucaacacaagccgccauaaaccaaaucaacggaaaacuaaaccgauugaucggcaaaaccaacgaaaaauuccaccaaauagaaaaagaguucagcgaagucgaaggacguauccaagaccucgaaaaauacgucgaagacacgaaaaucgaccuauggucauacaacgccgaacuccuaguggcccuugaaaaccaacacacaaucgaccucacagacuccgaaaugaacaaacuauucgaacgcacaaagaaacaacuccgcgaaaacgccgaagacaugggaaacggcugcuucaaaaucuaccacaaaugcgacaacgcaugcaucggcucaauacgaaacggaaccuacgaccacgacguguacagagacgaagcacucaacaaccgauuccaaaucaagggcgucgaacucaaauccggaagcgggcgccucgucccacgcggaucccccggcuccggauacaucccagaagcgccccgagacgggcaagccuacguccgaaaagacggggaauggguucuacucuccaccuuccuagggaaacccauacccaacccccuacucgggcuagacucaaccggc

SEQ ID NO: 58962 - RNA, 1692 nt, Artificial Sequence
  derived and/or modified sequence opt11 from anti-influenza_Chain
gaccagaucugcauaggauaccacgccaacaacagcaccgaaaaaguagacacaaaccuagaaagaaacgucacaguuacccacgcaaaagacauccucgagaaaacccacaacggaaaacuaugcaaacuaaacggcaucccaccccuagaacucggagacugcagcaucgcaggcuggcuacucggaaaccccgaaugcgacagacuacuaucaguccccgaauggucauacauuauggaaaaagaaaacccccgagacggacuaugcuaccccgggagcuuuaacgacuacgaagaacucaaacaccuacucuccagcgucaaacacuucgaaaaagucaaaauccuuccaaaagaucgcuggacacagcacacaaccacaggaggaagcagagcaugcgccguauccggcaaccccagcuucuuccgcaacaugguauggcuaacgaaagaggggagcgacuaccccgucgccaaaggaaguuacaacaacaccagcggggagcaaaugcugauaaucuggggcguccaccacccaaucgacgaaaccgagcaacgcacccucuaccaaaacguaggaaccuacguaagcgucggaaccaguacacuaaacaaaagguccacacccgaaaucgcaacccggcccaaagucaacggacagggcggacggauggaguucuccuggaccuuacuagacaugugggacacgauaaacuucgaaucuacaggcaaccuaauagcacccgaauacggauucaaaauauccaaacggggcuccucaggcauaaugaaaacugaaggaacacucgagaacugcgaaaccaaaugccaaacaccccuaggcgccauaaacacgacccuacccuuccacaacguacacccccuaaccauaggagaaugccccaaauauguaaaauccgagaagcuagugcucgccacaggacucagaaacguaccacaaauagaaucacgaggccucuucggcgccaucgccggcuuuaucgaaggcggguggcaaggaaugguagacggaugguacggcuaccaccacucaaacgaccaaggaucaggcuacgccgcggacaaagaaagcacucaaaaagccuucgacggaaucacgaacaaagucaacagcguaaucgagaaaaugaacacccaguucgaagcgguaggcaaagaauuuggaaaccucgaaagaagacuagagaaccucaacaagcgcauggaagacggcuuccucgacguauggaccuacaacgcagaacuccucguacuaauggagaacgagagaacgcucgacuuccacgacuccaacgucaaaaaccuauacgacaaaguacgaaugcaacuacgagacaacguaaaagagcuaggaaacggcugcuucgaguucuaccacaaaugcgacgacgaaugcaugaacucagucaaaaacggaacguacgacuacccaaaguacgaagaagaaagcaaacucaacaggaaugaaaucaaaggaguaaaacucagcuccauggggguauaccaaagcggccgccuaguccccagaggcucccccggaagcggcuacaucccggaagccccgagagacggccaagccuacguaagaaaggacggcgaauggguacuccuaagcaccuuccuaggaaaacccaucccgaacccccuccuaggccucgacagcacgggc

SEQ ID NO: 58963 - RNA, 1692 nt, Artificial Sequence
  derived and/or modified sequence opt11 from anti-influenza_Chain
caaaaacugccaggaaacgacaacuccaccgccacccucugccuaggccaccacgccgugcccaacgguacaaucguaaaaaccaucaccaacgaccaaaucgaggucaccaacgccacugaacucguccaaagcucaagcaccggcggcaucugcgacucaccccaccaaauccuggacggcgaaaacugcacacucaucgacgcccuccuuggcgacccccaaugcgacggauuccaaaacaagaaaugggaccuauuugucgaaagauccaaagccuacuccaacugcuacccauacgacgucccagacuacgccucccuccgcagccuaguagcaucaagcggaacccuagaguucaacgacgaaucauucaacuggaccggagucacccaaaacggcacaagcagcuccugcaaacgacgcuccaauaacagcuucuucagccgacucaacuggcucacacaacucaaauucaaauacccggcacuaaacguaaccaugcccaauaacgaaaaauucgacaaacucuacaucuggggcguucaccaccccgucacagacaacgaccaaaucuuccucuacgcccaagcgucaggccgcauaaccgucagcacaaaacgaagccaacaaacagucauccccaacauaggcucccgaccccgcauucgaaacauccccucccguaucagcaucuacuggacaauagucaaaccaggcgacauacuccucaucaacagcaccggcaaccucauagccccacguggauauuucaaaauccgaucaggcaaauccuccaucaugcgcucagacgcccccauaggcaaauguaacagcgaaugcaucacccccaacggcagcauccccaacgacaaacccuuccaaaacguaaaccgaaucaccuacggcgcaugcccucgauacguaaaacaaaacacacuaaaacuagccaccggcaugcgcaacguacccgaaaagcagacccgaggcauauucggcgcaaucgcaggcuucaucgaaaacggcugggaaggcauggucgacggcugguacggauucagacaccagaacagcgaaggcauaggacaagcggcagaccucaagagcacccaagccgccaucaaccaaauaaacggaaagcucaacagacugaucggcaaaacaaacgaaaaguuccaccaaaucgaaaaagaguucuccgaagucgaaggccggauacaagaccuagagaaauauguggaagacaccaaaaucgaccucuggagcuacaacgccgaacugcucguagcccuagaaaaccaacacaccaucgaccuaaccgacuccgaaaugaacaaacuauucgaaaggacaaagaagcaacuacgcgaaaacgcagaagacaugggaaacggcugcuucaaaaucuaccacaaaugcgacaacgcaugcaucgggucaauccgcaacggaacauacgaccacgacgucuaccgagacgaggcucucaauaaccgcuuccaaaucaaaggcguagaacuaaaaucaggcuccggccgucuagucccacgagguucacccggaucaggauacauacccgaagcaccccgcgacggccaggccuacguccgcaaagacggcgaaugggugcuacucucaaccuucuuagguaaaccaaucccaaacccccuacucggccucgacagcaccggc

SEQ ID NO: 58964 - RNA, 1695 nt, Artificial Sequence
  derived and/or modified sequence opt11 from anti-influenza_Chain
gauacaauauguaucggauaccacgccaacaacuccacggacaccgucgacaccgugcuagagaaaaacgucacugucacgcacucagucaaccuccuagaagacagccacaacggaaaacucugccuacuaaaaggcauagccccgcugcaacuuggaaacugcagcguagcuggguggauacucgggaaccccgaaugcgaauuacucauaagcagagaauccuggucguacauuguugaaaaaccaaaccccgaaaacgggaccugcuacccaggacacuucgcagacuacgaagaacuacgcgaacaauugagcuccgucucaucauucgaacgcuucgaaaucuuccccaaagaaucgagcuggcccaaccacaccacaacaggagucagcgcaagcugcagccacaacggcgaaagcagcuucuacaaaaaccugcuauggcucacgggaaagaacgggcucuaccccaaccucuccaaauccuacgcaaacaacaaggaaaaagaaguccuaguccuguggggcguccaccacccgcccaacaucggcgaccagcgcgcacuauaccacaaggaaaacgccuacgucucaguuguaagcucccacuacagccgaaaauucacccccgaaauagcaaaacgcccaaaaguaagagaccaagaaggcagaaucaacuacuacuggacgcuauuagaaccaggcgacaccaucaucuucgaagcaaacggcaaccucauagcaccccgauacgcguucgcgcucucgcgaggauucggaagcggaauaauaaauagcaacgcacccauggacgaaugcgacgccaaaugccagacaccgcaaggggcaauaaacuccagccuccccuuccaaaacguccacccaguaaccauaggcgaaugccccaaauacguccggagcgcgaaacuacgcauggucacgggccuccgaaacauccccagcauccaaucacgcgggcuauucggggcaaucgcaggauucauagagggcggguggacaggcauggucgacggcugguacggcuaccaccaccaaaacgaacaaggguccggguacgcagccgaccaaaaauccacacaaaacgcaaucaacggaaucaccaacaagguuaauagcguaaucgagaaaaugaacacccaauucaccgcagucggcaaagaauuuaacaaacuagaacgcagaauggaaaaccucaacaaaaaggucgacgacggauucaucgauaucuggacauacaacgccgaacuccucguccugcucgaaaacgaacgcacacucgacuuccacgacagcaacgucaaaaaccucuacgaaaaaguaaaaagccaacucaaaaacaacgccaaagaaaucggcaacggcuguuucgaguucuaccacaaguguaacgacgaaugcauggaauccgucaaaaacggcaccuacgacuacccaaaauacucagaagaaagcaaacucaaccgagagaaaauagacggaguaaaacuagagucaaugggcguauaccagagcggacgccuaguaccacgcggaagccccggcuccggauacaucccggaagcgcccagagacgggcaagcguacguaagaaaagacggagaguggguccugcuauccaccuuccuaggaaaaccgauaccaaacccccuccuuggacuggacucaacgggc

SEQ ID NO: 58965 - RNA, 1695 nt, Artificial Sequence
  derived and/or modified sequence opt11 from anti-influenza_Chain
caaaacuacacgggcaaccccguaauaugccuaggacaucaugccgucucaaacggcaccauggucaaaacccuaaccgacgaccaaaucgaagucgucaccgcccaagaacucgucgaaagccagcaccuaccagaacucugccccaguccacuccgccucgucgacggccaaaccugcgacaucgucaacggcgccuuaggaagucccggcugcgaccaccuaaacggagcggaaugggacgucuucauagaacgaccaacggcagucgauaccugcuaccccuucgacgugcccgacuaccaaagccuccgauccauacuugccaacaacggcaaauucgaauuuauagcagaagaguuccaauggaacaccguaaaacagaacggaaaaucaggcgcaugcaaacgcgcaaacgucaacgacuucuucaaccggcucaacuggcucaccaagagcgacgguaacgccuacccccuccagaaccucacaaaagucaacaauggcgacuacgcccgccucuauaucuggggcguacaccacccaagcacagacacagaacaaaccaaccucuauaaaaacaaccccggccgcgucacaguaucaacccaaaccucccagaccuccgucgucccaaacaucggaucgcgccccuggguccgcggccuuagcucccggauauccuucuacuggacaaucgucgaacccggcgaccuuauagucuucaacaccauaggaaaccuaauugcaccacggggccacuacaaacuuaacagccaaaagaaauccaccauccucaacaccgccguccccauaggcucaugcguuucaaaaugccacacggacaaggggucaaucucaacuaccaaacccuuccaaaacaucucccgcauauccaucggagacugucccaaguacguaaaacaaggaagccugaaacuagcaaccggcaugcgauccauccucgaaaaagccacacgcgggcuguucggcgccaucgcgggcuucaucgaaaauggcuggcaaggccucaucgacgguugguacggcuuccgacaccaaaacgccgaaggaaccggaaccgccgcugaccucaaaagcacgcaagccgcaaucgaccaaauaaacggcaagcuaaaccgccucaucggcaaaccaaacgaaaaauaccaccaaaucgaaaaagaauuugaacaagucgaaggccgcauacaagaccuagaaaaauacgucgaagacacaaaaauagaccucuggagcuacaacgccgaacuacucgucgcccuagaaaaccaacacaccauagacguaaccgacucggaaaugaacaaacucuucgaacgaguacgacaccaacuccgugaaaacgccgaagacaaaggcaauggcugcuucgaaaucuuccaccaaugcgacaacuccugcauugaaagcauacgcaacggcacauacgaccacgauauauacagagacgaagcaauaaacaaccgcuuucaaauacaagggguaaaacuaauccaggguuacaaagacucaggccgccucguaccccgaggcagccccggcagcggcuacauccccgaagcaccccgagacggccaggcuuacguccgaaaagacggcgaauggguccuccuaagcaccuuucugggcaaaccaauacccaacccccuccugggacucgacucaaccgga

SEQ ID NO: 58966 - RNA, 1695 nt, Artificial Sequence
  derived and/or modified sequence opt11 from anti-influenza_Chain
gaccaaaucugcaucgguuaccacgcuaacaacagcaccgaacaagucgacaccaucauggaaaaaaacgucaccgucacccacgcccaagacauccuagagaaaacccacaacggcaaacucuguaaccucgacggagucaaaccccucauccucaaagacugcuccguagccggcuggcuucucggaaacccaaugugcgacgaauuucuaaacguauccgaaugguccuacauagucgaaaaagccuccccugccaacggccucugcuaccccggcgacuucaacgacuacgaagagcuaaaacaccuccuauccagaaucaaccaccucaaaaaaauaaaaaucauccccaaaagcuacuggucaaaccaugaagccagcucgggagucagcgcagccugcuccuaucucggcgaaccauccuucuucagaaacguaguauggcuuaucaaaaagaacaacaccuacccccccaucaaaguaaacuauacgaacaccaaucaagaagaccuccucguucucuggggaauacaccaccccaacgacgaaaaagaacagauccgcauauaccaaaaccccaacacguccauaagcgugggaaccagcacucugaaccaacgacuugucccgaaaaucgccaccagaccuaaaguaaacggacagagcggcagaauggaauucuucuggacaauccugaaaccaaacgacagcauuaacuucgacuccaacggcaacuucaucgcccccgaguacgccuacaaaaucgccaaaaagggggacagcguaauaaugaaaucagaacucgaauacggcaacugcaacacaaaaugccaaacacccaugggcgcaaucaacucaagcaugcccuuccacaacauccacccacucaccauaggcgagugccccaaauacgucaaaucgaaccgauuaguccuagccaccggccugcgaaacgccccccaaacggaaacccgaggccucuucggagccaucgcaggcuucaucgaagggggauggcaaggaauggucgacgguugguacggauaccaccacucaaacgaacaaggauccggcuacgcagcggacaaagaguccacccaaaaagccauagacggcaucaccaacaaaguaaacagcaucauagacaaaaugaauacccaauucgaaaucgucggacgcgaauucaacaaccucgaacgccgcaucgaaaaccucaacaaaaaaauggaagacggauuccuggacguauggacauacaacgccgaacuccucguacugauggaaaacgaacgaacacucgacuuccacgacuccaacgucaaaaaccuguacgaaaaaguaagacuacaacuccgcgacaacgccaaagaacucggcaacggcugcuuugaauucuaccacaaaugcgacaacgaaugcauggaauccguccgcaacggaaccuacgacuacccccaauacagcgaagaagcccgacuaucccgcgaagaaaucagcggaguaaaaauggaguccaugguaaccuaccaaagcggccgccucgucccccgcggcagccccggaagcggauacauacccgaggcaccccgagacggacaagccuacguucgaaaagauggggaauggguacuacuguccaccuuccucggcaaaccuauacccaacccacuacugggccucgacucaacaggc

SEQ ID NO: 58967 - RNA, 1695 nt, Artificial Sequence
  derived and/or modified sequence opt11 from anti-influenza_Chain
gacaccaucuguaucggauaccacgccaacaauucaacagacacagucgacaccgugcucgagaaaaacgucacagucacccacucaguaaaccuacuagaagacagccacaacggaaagcucugccuccuaaaagggauagccccucuacaacuaggcaacugcagcguagcaggauggauacucggaaacccggaaugcgaacuucuaauaucccgcgaaucaugguccuacaucguagagaaacccaacccagaaaacggaacgugcuaccccggacacuucgcugacuacgaggaacuacgagaacaacucucaucgguauccagcuucgaacgauucgaaauauuccccaaagaauccagcuggcccaaccacaccaccacaggcguauccgcgagcugcucacacaacggggaauccagcuucuacaaaaaccugcuguggcucaccgggaagaacggacuauacccaaacuugagcaaaucauacgccaacaauaaggaaaaagaaguacucgucuuauggggaguacaccacccacccaacauaggcgaccaaagagcacucuaccacaaagaaaacgcauacgucuccguagucuccucccacuacagccgaaaauucacaccggaaaucgcaaaacggccgaaaguucgcgaccaagaaggccgaaucaauuacuacuggacacuacuggaacccggcgacacaauaaucuuugaagcaaacggaaaccucauugcaccccgcuacgcguucgcacucuccagaggcuucggguccgggauaauaaacucaaacgcaccaauggacgaaugcgacgccaagugccaaacgccccaaggcgccauaaacucuagccuccccuuccaaaacguccaccccgucaccaucggcgaaugcccgaaauacguacggagcgcaaaacuacgaauggucaccggccuacgcaacaucccaaguauacaaucucgcggccucuucggggcaauagccggcuuuaucgagggcggcuggacaggcaugguagacggcugguacggauaccaccaccaaaacgaacaaggcuccggauacgccgccgaccaaaagagcacccaaaacgccauaaacggaaucacaaacaaaguaaacagcgucauagagaaaaugaacacgcaauucaccgccgucgggaaagaauuuaacaaacuagaacgcagaauggaaaaccucaauaaaaaggucgacgacggcuucaucgacaucuggacguacaacgccgaacuacugguacuucucgaaaacgaacgcacacucgacuuccacgacucaaacgucaaaaaccucuacgaaaaaguaaaaagucaacugaaaaacaacgccaaagaaauaggcaacggcugcuucgaguucuaccacaaaugcaacgacgaaugcauggaauccguaaagaacggcacuuacgacuacccaaaguacucggaagaguccaaacucaaccgcgagaaaaucgacggaguaaaacuagaaagcaugggcguguaccaaaguggacgccucgucccacgcggaaguccaggaucgggcuacaucccagaagcaccccgcgacgggcaagccuacguacgcaaagacggggaauggguccugcugucaaccuuccucggcaaacccaucccgaacccacuccuaggacuagacagcaccggc

SEQ ID NO: 58968 - RNA, 1695 nt, Artificial Sequence
  derived and/or modified sequence opt11 from anti-influenza_Chain
caaaacuacaccggcaaccccguaauaugccucggccaccacgccguaagcaacggcaccauggucaaaacccucaccgacgaucaaauagaagucgucacagcccaggagcuagucgaaucccaacaccuaccagaacucugccccucaccccuacgacugguagacggccaaaccugcgacaucgucaacggagcacucgggagccccggcugcgaccaucucaauggagcagaaugggacguauucaucgaaagacccaccgcagucgauaccugcuacccauucgacgucccagacuaccaaagccuacgauccauacucgccaacaacggcaaauuugaguucaucgcagaagaguuccaguggaacaccgucaaacaaaacggcaagucgggagcaugcaagcgcgcaaacguaaacgacuucuucaaccgcuuaaacuggcuuaccaagagugacggcaacgcauacccccuccaaaaucuaacaaaagucaacaacggagacuacgcgcgccuauacauauggggcguccaccacccuagcacagacacagaacaaaccaaucuauacaaaaacaacccaggcagagucaccgucagcacccaaaccucacaaacgagcgucguccccaacaucggcucacgcccauggguccgaggccucuccagcaggaucaguuucuacuggaccaucguagaaccaggggaccuaaucgucuucaacaccaucggcaaccuaaucgcaccccgcggccacuacaaacucaacucccagaagaaaucaacaauccucaacacggccguccccauaggcuccugcgucucaaaaugucacacagacaaaggcuccaucagcacgaccaaacccuuccaaaauauuucgcgaauuagcaucggcgacugcccgaaauacguaaaacaaggcagucuaaaacuagccaccgguaugcgauccauccucgaaaaagcaacccgcggacucuucggcgccaucgccggcuucaucgaaaacggguggcaaggucucaucgacggcugguacggauuccggcaccaaaacgccgaaggaaccgggaccgccgccgaccucaaaagcacacaagccgccaucgaccaaauaaacggcaaacuaaaccgccuaaucggcaagccaaacgaaaaauaccaccagaucgaaaaggaguucgaacaagucgaaggucgaauccaagaccucgaaaaauacgucgaagacaccaaaaucgaccucugguccuacaacgccgaacuccuagucgcgcuagaaaaccaacacaccaucgacguuaccgacagcgaaaugaacaaacucuucgaaagaguaagacaccaacuaagagaaaaugccgaagacaaaggaaacggcugcuuugagauauuccaccaaugcgacaacagcugcauagaaucaauccggaacggaaccuacgaccacgacauauacagagacgaagccaucaacaacagauuccaaauccaaggggucaaacuuauccaaggauacaaagacucaggccgccucguaccacgaggaucaccaggaagcggguacauccccgaagcaccccgcgacggacaggccuauguacgcaaagacggcgaguggguacuccucagcaccuuccuaggcaagcccauaccaaacccccuccuaggccucgacuccacaggu

SEQ ID NO: 58969 - RNA, 1695 nt, Artificial Sequence
  derived and/or modified sequence opt11 from anti-influenza_Chain
gaccaaaucugcaucggauaccacgccaacaacucaacagaacagguagacaccauaauggaaaaaaacgugaccgucacccacgcgcaagacauacuagaaaaaacacacaacggcaaacuaugcaaccucgacggggucaaaccccucauccuaaaagacugcuccgucgccggcuggcuccugggaaaccccaugugcgacgaauuccuuaacguaagcgaaugguccuacauagucgaaaaagccucgcccgcaaacggacuuugcuaccccggagacuucaaugacuacgaagaacuaaaacaccuacuaagccgaauaaaccaccucaaaaaaaucaaaaucaucccaaaauccuacugguccaaccacgaagcauccuccggcgucagcgccgcuugcagcuaccuaggagaaccaucauucuuccggaaugucgucuggcucauaaaaaaaaacaacaccuauccccccaucaaaguaaauuacaccaacacgaaccaagaagaccuccucguucuauggggcauccaccaccccaacgacgaaaaagaacagauccgcaucuaccagaaccccaacaccucaaucuccgugggaaccuccacccucaaccaacgacuaguccccaaaauagcaacccgccccaaagucaauggccaaagcggccgaauggaauucuucuggaccauacuaaaaccgaacgacucgauuaacuucgacagcaacggcaacuucauagcaccagaauacgccuacaaaaucgccaaaaaaggcgauucagucaucaugaaaagcgaacucgaauacggcaacugcaacaccaaaugccaaacacccaugggagcgaucaacuccucaaugccauuccacaacauccacccccucaccaucggggaaugcccaaaauacgucaaaagcaaccgucuaguccucgccaccggccuccgaaacgccccccaaacagaaacccgaggccucuucggugccauagccggauucauagaaggcggcuggcaaggaauggucgacggaugguacggcuaccaccacagcaacgaacaaggcucaggcuacgcagccgacaaagagagcacacaaaaggcaauagacggaauaaccaacaaaguaaacucaauuauagacaagaugaacacccaguuugaaaucgucggaagagaguucaacaaccucgaacgccgaaucgagaaccuaaacaaaaaaauggaagacggcuuccuagacgucuggaccuacaacgccgaacuucucguacucauggaaaacgaacgcacccucgacuuccacgacuccaacgucaagaaccuauacgaaaaaguucgccuccaacuccgcgacaacgcaaaagaacucggcaacggcugcuucgaguucuaccacaaaugcgacaacgagugcauggaaucaguccgcaacggcacauacgacuacccccaauacucagaagaagcccgacucucccgagaagaaauaagcggagugaaaauggaauccauggucacauaccagagcggacgccucgugccccgaggcagcccaggcagcggcuacauuccagaggccccucgcgacggccaagccuacguacgcaaagacggcgaauggguacuccucuccaccuuuuuaggaaaacccauacccaacccacugcuaggccucgacagcaccggc

SEQ ID NO: 58970 - RNA, 1698 nt, Artificial Sequence
  derived and/or modified sequence opt11 from anti-influenza_Chain
gacacacuauguauaggcuaccacgccaacaacaguacagacacaguagacaccguccucgagaaaaacgucacaguaacacacuccguaaaccuacucgaagacaaacacaacggcaaacucugcaaacuccgcggaguugcaccccugcaccugggaaaauguaacaucgccggcuggauccugggaaaccccgaaugcgaaucccuauccacggccucgagcuggagcuacauaguagaaacacccagcucagacaacggcacuugcuaccccggcgacuucauagacuacgaagaacuccgcgaacaacucucaagcguaucaucauucgaacgcuucgaaauauuccccaaaaccuccuccuggccgaaccacgacuccaacaaaggggucacagccgccugcccccacgccggggcaaaauccuucuacaaaaaccuaaucuggcuaguaaagaaaggcaacuccuacccuaaacucagcaaauccuacaucaacgacaaaggcaaagaaguccucguacuguggggaauacaccaccccagcaccagcgcagaccaacaaucacuguaccagaacgcggacaccuacgucuucgucggcagcucgcgauauaguaaaaaguucaaaccagaaaucgccauacggcccaaaguccgagaccaagaaggacgcaugaacuacuacuggacccuaguagaacccggcgacaaaaucaccuucgaagccacagggaaccucguggucccacgauacgccuucgccauggaacgcaacgcaggcagcggaaucaucaucucagacacacccgugcacgacugcaacaccacaugccaaacccccaaaggcgccaucaacaccagccuucccuuccaaaacauacaccccaucaccauaggcaaaugccccaaauacgucaaaucaaccaaacuacgccucgccacaggacuacgcaacauccccagcauacaaucacgaggacucuucggagcaaucgccgguuucaucgaaggcggcuggaccggcauggucgacggcugguacggauaccaccaccagaacgaacaaggcagcggcuacgccgccgaccucaaaagcacccaaaacgccauagacgaaaucacaaacaaaguaaacuccgucaucgaaaagaugaauacccaauuuaccgccguugggaaagaguucaaccaccuagaaaaacgcauagaaaaccucaacaagaaagucgacgacggcuuccucgacauauggacauacaacgcugaauuauuaguacuacucgaaaacgaaagaacccucgacuaccacgacuccaacgucaaaaacuuauacgaaaaaguacgaagucaacucaaaaacaacgccaaagagauaggaaacggaugcuucgaguucuaccacaaaugcgacaauaccugcauggaaucagucaaaaacggcaccuacgacuacccaaaauacuccgaagaagcaaaacuaaaccgcgaagaaauagacggaguuaaacucgaauccacacgaaucuaccaauccggacgccucguaccacgcggcucucccggauccggcuacaucccagaagcaccccgagauggccaggccuacguccgaaaagacggcgaauggguccuccucuccaccuuccucggcaaacccauaccgaacccccuccucggccucgacucgacaggc

SEQ ID NO: 58971 - RNA, 1698 nt, Artificial Sequence
  derived and/or modified sequence opt11 from anti-influenza_Chain
gaccguaucugcaucggcuaccaaagcaacaacagcaccgacacgguaaacacacucaucgaacaaaaaguccccgucacacaaaccauggaauugguugaaacagaaaaacaccccgcauacugcaacaccgaccucggagcaccacucgaacucagagacugcaaaaucgaagcagucauauacggaaaccccaagugcgacauacaccuaaaagaccaaggauggagcuacaucgucgagcgccccagcgcacccgaaggaaugugcuacccaggaagcgucgaaaaccuggaagaacuccgauucguauucuccucggccgcaucauacaaacgcaucagacuauucgacuacagccgauggaacguaaccucaagcggcaccagcaaggccugcaacgcaucgacaggcggccagagcuucuaccgaagcauaaacuggcucaccaaaaagaaacccgacacauacgacuucaacgaagggacguacgucaacaacgaagacggcgacaucauauuccuuuggggaauccaccacccucccgacaccaaagaacaaaccacacuauacaaaaacgcaaacacccucagcagcgucacaaccaacaccauaaaccgcagcuuucaacccaacaucggcccccgcccccuaguccgaggacaacaaggccgaauggacuacuacuggggcauccuaaaacgcggcgaaacacucaaaauaagaaccaauggcaaccucaucgcucccgaguucggcuaccuccuaaaaggcgaaucccacgggcgaaccauacaaaacgaagauauccccauaggcaauugcuacaccaaaugccaaaccuacgccggagcaaucaacuccagcaaacccuuccaaaacgccuccagacacuacaugggcgagugcccaaaauacguaaagaaagcauccuuaagacucgccgucggacuacgcaacacccccucagucgaaccacgcggacucuucggcgccaucgcgggauucauagaaggcggcugguccggcaugaucgacggcugguacggcuuccaccacucaaacuccgaaggaacaggaauggcggccgaucaaaaauccacccaagaagcgauagacaaaauaaccaacaaagucaacaacaucguagacaaaaugaaccgagaguucgaagucguaaaccacgaguucuccgaagucgaaaagagaauaaacaugauaaacgacaaaaucgacgaccaaauagaagaccucugggccuauaacgccgaacuacucguacuccuagaaaaccaaaagacacucgacgaacacgacucaaacgucaaaaaccuguucgacgaagugaaacgccgacucucagccaaugccauagacgccggcaacgggugcuucgacauccuccacaagugcgacaacgaaugcauggaaaccauaaagaacgguaccuacgaccacaaagaauaugaagaagaagcgaaacuagagcgauccaaaauaaacggcgucaaacucgaagaaaacacaacguacaaaagcggacggcuaguaccacgcggcucccccggcagugguuacauccccgaagcccccagagacggacaagcguacguccgcaaagacggcgaauggguccuccucuccaccuuucugggaaaacccauaccaaacccccuccuaggccuagacucaaccggc

SEQ ID NO: 58972 - RNA, 1698 nt, Artificial Sequence
  derived and/or modified sequence opt11 from anti-influenza_Chain
gacaccuuaugcaucggauaccacgccaauaacagcacagacaccgucgacaccguacuugaaaagaacgucacagucacccacuccguaaaccugcucgaagacaaacacaacggcaaacucuguaaacuccgaggcgucgcaccgcuacaccugggcaagugcaacauagcaggcuggauccuaggaaaccccgaaugcgaaagccuauccacggccucauccugguccuacaucguggaaacccccagcagcgacaacgguaccugcuaccccggcgacuucaucgacuacgaagaacuacgagaacaacucucauccgucucauccuucgaacgauucgaaaucuuccccaaaacauccucauggcccaaccaugacuccaacaaaggcgugaccgccgccugcccccacgccggcgcaaaauccuucuacaaaaaccuaauauggcucgucaagaaaggcaacagcuaccccaaacucuccaaauccuacauuaacgacaaaggaaaagaaguccucguccucuggggaauccaccaccccagcaccagcgccgaccaacaaucgcucuaccaaaacgcagacaccuacgucuucgucggcuccagccgauacuccaagaaauucaaacccgaaaucgccauacgacccaaaguacgcgaccaagagggccgcaugaacuacuacuggacccucguggagccgggcgacaaaaucaccuucgaagcaaccggaaaccuggucguuccccgcuacgccuuugccauggaacguaacgccgggagcgggauaaucaucucagacacaccaguacacgacugcaacacaaccugccagaccccaaaaggcgcaauaaauaccagccuacccuuccaaaacauccacccaaucaccauaggcaaaugcccaaaauacguaaaauccacaaaacuccgccuagcaacaggccugcgaaacaucccauccauccaaucccgaggccuauucggcgcaaucgccggcuucaucgaaggcggauggaccggcaugguagacggcugguacggcuaccaccaccaaaacgaacagggcagcggauacgcagccgaccuuaaaagcacccaaaacgcaauagacgaaaucacgaacaaagucaacaguguaaucgagaaaaugaacacacaauucacagcaguugggaaagaguucaaucaccucgaaaaacgaauagaaaaccuaaacaaaaagguagacgacggguuccucgacauauggaccuauaacgccgaacucuuaguccuauuagaaaacgaaagaacucuagacuaccacgauucaaacgucaaaaaccuauacgaaaaaguccgaagccaacucaagaacaacgccaaagaaauuggcaacggcuguuucgaguucuaccacaaaugugacaacacaugcauggaaagcgucaagaacgggacauaugacuacccaaaguacuccgaagaagccaaacuuaacagagaagaaauagacggagucaaacuugaaagcaccagaauauaccaguccggucgucuagucccacgcggaagcccgggcucaggcuacaucccggaagcuccccgggacggacaagcguacguccgaaaagacggagaauggguccuccucucaaccuucuuaggaaaaccaauaccaaacccccuccuaggccuagacuccacaggg

SEQ ID NO: 58973 - RNA, 1698 nt, Artificial Sequence
  derived and/or modified sequence opt11 from anti-influenza_Chain
gaucgaauaugcaucggauaccaauccaacaauucaacagacaccguaaacacccucaucgaacaaaagguaccagucacccaaaccauggaacucguagaaacagagaaacacccagcauacugcaacacagaccugggagccccacuagaacugcgcgauugcaagaucgaggccgucauauacggcaacccaaaaugcgacauccaccucaaagaccaaggcuggagcuacaucguagaacgaccaucagcucccgaaggaauguguuaccccggaucagucgaaaaccuugaagaacuccgcuucgucuucucauccgccgccuccuacaaaagaauacgccucuucgacuacucccgcuggaacguaaccuccuccggcaccucaaaagccugcaacgcuagcaccggaggacaaucauucuaccgcuccauaaacuggcucacuaaaaagaaaccagacacauacgacuucaacgaagguacauacgucaacaaugaagacggagacaucauauuccucuggggcauccaccacccaccggacaccaaagaacaaacaacccuauacaaaaacgccaacacccucuccuccgugacaacaaacaccaucaaccgcucauuccaacccaacauaggcccccgcccccuagucagaggacaacaaggccgcauggacuacuacuggggcauccuuaaacggggugaaacccuaaaaauccgaacaaacggcaaccuaaucgcccccgaguucggcuaccuacuaaaaggagaaucccacggacgcaccauccagaacgaagacauccccauaggcaacuguuacaccaaaugccaaaccuacgccggcgcgauaaauuccagcaaacccuuccaaaacgccagccgacacuacaugggcgaaugccccaaauacgucaagaaagcaagccucagacucgccguaggacuuagaaacacccccagcguagaaccccgcgggcuauucggcgcaaucgccggcuucaucgaaggagguuggagcggcaugaucgacggaugguacggguuucaccacuccaacucagaagggaccggcauggcugcagaccaaaaauccacccaggaagcaaucgacaaaaucaccaacaaaguaaacaacaucguagacaaaaugaaccgagaguucgaagucgucaaccacgaguucuccgaagucgaaaaacgcaucaacaugaucaacgacaagaucgacgaccagaucgaagaccucugggcauacaacgccgaacuacucguccugcucgaaaaccagaaaacccucgacgaacacgacagcaacgucaaaaaccucuucgacgaaguaaaacgcagacucucggcuaaugccaucgaugcgggcaacggaugcuuugacauacuccacaagugcgacaacgaauguauggaaacgaucaaaaacggcaccuacgaccacaaagaauaugaagaagaagcaaaacucgaacgcagcaaaaucaacggaguaaaacuagaagaaaacaccacauacaaguccggcagacucgucccacgaggcagccccggcucgggauacaucccagaagcccccagagacggacaagccuacguccguaaagacggcgaauggguccuccugucaaccuuccuaggcaaaccgauaccaaacccccuccucggacuagacucaaccgga

SEQ ID NO: 58974 - RNA, 1701 nt, Artificial Sequence
  derived and/or modified sequence opt11 from anti-influenza_Chain
gacaaaaucugcaucgguuaccacgccaacaacucaaccacccaaguagacaccauccucgagaaaaacgucaccgucacacacucugucgagcuacuggaaaaccaaaaagaagaacgcuucugcaaaauacucaacaaagccccacucgaccuacgcggcugcacaauugagggauggauccucgggaacccccaaugcgaccuacuccuaggcgaccaaucauggucuuacaucgucgaacgcccgaccgcccaaaacggaauaugcuaccccggcgcccucaacgaagucgaagaacuaaaagcccucaucggcucgggagaacgcgucgaacgcuucgaaauguucccaaaauccacauggaccggcguagacaccagcaguggaguaaccaaagccugucccuauaacuccggaagcucauucuaccgaaaccugcuuuggaucauaaaaaccaaaucagcagccuaccccgucauaaaaggcaccuacaacaacacaggcagccagccaauccucuacuucuggggaguccaccacccaccagacaccaacgaacaaaacacccucuacggaagcggugacagauacguacgaaugggcacagaaucuaugaacuucgcaaaauccccagaaaucgcggccagaccagcggucaacggacaacgcggacgaaucgacuacuacuggagcguacucaaaccaggagaaacgcucaacgucgagagcaacggcaaccuuauagcccccugguacgccuacaaauucgugucaaccaacaacaaaggcgcaaucuucaaauccaacuuaccaauagagaacugcgacgcaaccugccaaaccaucgccggcguucuccguaccaacaaaaccuuccaaaacgucucgccccuguggaucggagaaugcccaaaauacgucaaaagugagucccuacgccuggccacgggacucagaaacguaccacaaaucgaaacccgcggccucuucggcgccaucgcaggauucauugaaggaggauggaccggaaugauagacggcugguacggauaucaccacgagaacucucaagggagcggauacgcugcagacaaagaaagcacccaaaaagcaaucgacggaaucaccaacaagguaaacagcauaauagacaaaaugaacacccaauucgaagcaguagaccacgaguucuccaaucuagaacgacgcaucgauaaccugaacaagcgcauggaagacggcuuccucgacguguggaccuacaacgcagaacuccucguccuucucgagaacgagcgcacacucgaccuacacgacgcaaacgugaaaaaucucuacgaaaaagucaaaucacaacuccgcgacaaugccaacgaccucggcaauggcugcuucgaguucuggcacaaaugcgacaacgaaugcaucgaaucggucaaaaacgggacauacgacuacccaaaauaccaagacgaaagcaagcucaaccgucaagaaauagaaagcguaaaacucgacaaccucggcguauaccaaagcgggcgccucgucccacgcggaagccccggcucaggcuacauccccgaagcaccacgcgacggacaagcauacguccgaaaagacggcgaauggguacuccuaagcaccuuccuaggcaaacccauaccaaacccccuauuaggccucgacucaaccgga

SEQ ID NO: 58975 - RNA, 1701 nt, Artificial Sequence
  derived and/or modified sequence opt11 from anti-influenza_Chain
gauaaaaucugcaucggauaccacgcaaacaacuccaccacccaagucgacacaauucucgagaaaaacguaacaguaacccauuccgucgaacuccucgaaaaccaaaaagaagaacgcuucugcaaaauccuuaacaaagcaccccuggaccuccgcggcugcaccaucgaaggcuggauccucggcaacccccaaugcgaccuccuccucggcgaccaaagcuggaguuacaucgucgaacgucccaccgcccaaaacggaaucugcuaccccggcgcccucaacgaaguagaagaguuaaaagcccuaaucgguucaggcgaacgagucgaacgauucgaaauguuccccaaauccaccuggacaggcgucgacacauccagcggcguaaccaaagcaugucccuacaacagcggguccucauucuacagaaaccuccuguggaucaucaaaaccaagucagccgccuacccagucaucaaaggcaccuacaacaacacgggcagccaacccauccucuacuucuggggaguacaccacccaccggacaccaacgaacaaaacacacuuuacggguccggcgaccgguacguccgcaugggaacagaauccaugaacuucgcaaaauccccagagaucgcagcccgaccugccgucaacggccagcgcggccgcaucgacuacuacuggucgguccuaaaacccggugaaacacuaaacgucgaauccaacggaaaccuaauagcccccugguaugcauacaaguucguaucaacaaacaacaaaggcgccaucuucaaaagcaaucucccgaucgaaaacugcgaugcaaccugccaaacaauagccggcguccuccgaaccaacaaaaccuuccaaaacgucucaccccucuggauaggcgaaugcccaaaauacgucaaguccgaaucccuccgacucgccacaggucuacgcaacgucccacaaaucgaaacacgcggccuauuuggcgcaauagccgguuucaucgaaggaggcuggacagggaugaucgacggaugguacggcuaccaccacgaaaacucccaagguuccggcuacgccgcagacaaagaauccacacaaaaagccauagacggcauaaccaacaagguaaacagcauaaucgacaaaaugaacacccaauucgaagccgucgaccacgaguucagcaaccuagaacgccgcaucgacaaccucaacaaacgcauggaagacggguuccucgacguauggacguacaacgcagaacuccucguccuacuggaaaacgaacguacacuagaccuacacgacgccaacgucaagaaccucuacgaaaaagucaaaucacaacuccgugacaaugcaaacgaccuaggcaacggaugcuucgaguucuggcacaagugcgacaacgaaugcauagaauccgucaaaaacggcaccuaugauuaccccaaauaccaagacgaaucuaaacucaaccgccaagaaauagaauccguaaaacucgacaacuuaggcguauaccaaucaggacgccuagucccccgaggaagccccggauccggcuacauccccgaagcaccccgagacggccaagccuacguccgaaaagacggcgaaugggucuuacucuccacauuccuaggcaaaccgauacccaacccccuccucggacucgacucaacaggc

SEQ ID NO: 58976 - RNA, 1704 nt, Artificial Sequence
  derived and/or modified sequence opt11 from anti-influenza_Chain
gaccacaucugcaucggcuaccaugccaacaacuccaccgagcaagucgacacaaucauggagaaaaacgucaccgucacacacgcccaggacauacucgagaaaacccacaacggcaaacuaugcgaccuaaacgguguaaaaccccuaauacuaaaagacugcucuguggcaggauggcugcucggcaacccaaugugugaugaauuuaucaacguccccgaauggucauauauagucgaaaaagcuaacccagcaaacgaccucugcuaccccggcaacuucaaugacuacgaagaacucaaacaccuacuaagccgaauaaaccauuucgagaaaauccaaaucaucccaaaagacuccuggagcgaccacgaagcaucgcucggaguauccuccgcgugccccuaccaaggcaauuccucauucuuccgaaacgucgucuggcucaucaagaaaggaaacgcauacccaacaauaaagaaaagcuacaacaacaccaaccaagaagaccuucuagucuuauggggcauacaccacccuaacgacgaagcagaacaaacccgccuauaccagaacccaacaaccuacaucuccaucggcacgagcacgcuaaaucaacgccucguacccaaaaucgccacccgaagcaaagucaacggccaauccggccgcauagacuucuucuggaccauacuuaaacccaacgacgccaucaacuucgaaagcaacggcaacuucaucgcaccggaauacgccuacaaaaucgucaagaaaggagacucaacaauaaugaaaagcgaaguugaauacgggaacugcaacacacgcugucagacgcccaugggcgccauaaacaguuccaugccuuuccacaacauccacccccucacaaucggcgaaugucccaaauacgugaaaucaaacaaacucguccuagcaaccggccuacgaaacucaccccaacgcgaacgcagacgaaaacgcgggcuauucggagcgaucgcgggauucaucgaaggaggcuggcaaggcauggucgacggcugguacggcuaccaccacuccaacgaacaaggaagcggauacgcggcagacaaagaaagcacccaaaaagccaucgacggagucacaaacaaagucaacagcauaaucgacaaaaugaacacccaauucgaagccgucgggcgcgaguucaacaaccucgaacgacgaauagaaaacuuaaacaagaaaauggaagacggcuuccuagacgucuggacauacaacgccgaacuacucguacuaauggaaaacgaacgcacgcucgacuuccacgacucaaacgucaaaaacuuauaugacaaaguacgccuacaacuccgagacaacgcaaaagaacugggcaacgguugcuucgaguucuaccacaaaugcgacaacgaaugcauggaaucaguccggaacggcaccuaugacuacccacaauacuccgaagaagcacgccucaaacgagaagaaaucagcggagucaaacucgaguccaucggcacauaccagagcggacgacucgucccacgcgggucacccggcucaggcuacaucccagaagcgccccgagacggccaagccuacguacguaaagacggcgaauggguacuacucagcaccuuccuaggaaaacccaucccaaacccgcuccugggacucgacucaacaggg

SEQ ID NO: 58977 - RNA, 1704 nt, Artificial Sequence
  derived and/or modified sequence opt11 from anti-influenza_Chain
gaccagaucugcaucggguaccacgcaaacaacucgaccgaacaagucgacaccaucauggagaaaaaugucacaguaacccaugcccaagacauccuagagaaaacgcauaacggaaaacuuugcgaccuagacggcgucaaaccccucauccuccgcgacugcuccgucgcaggauggcuccucggcaaccccaugugcgacgaguucaucaacguccccgaauggucauacauaguagaaaaagccaacccagcgaacgaccucugcuacccaggaaacuucaacgacuacgaagaacucaaacaccuccucucccgcauaaaccacuucgagaaaauccaaaucauccccaaaucaagcuggagcgaccacgaagcauccagcggcguaucgucagccugcccguaccaaggcacaccaucauucuuccgcaacgucgucuggcucauaaagaaaaacaacaccuaccccaccauaaaacgcuccuacaacaacaccaaccaagaagaccuccugauccucuggggcauccaccacuccaacgacgccgcagaacaaacaaaacucuaccaaaacccuacuaccuacauaagcgucggcaccagcacccucaaccaacggcucgucccaaaaauagcaacacggucaaaaguaaacggccaauccggccgaauggacuucuucuggaccaucuuaaaaccaaacgacgcgauaaacuucgaauccaacggaaacuucauagccccggaauacgcauacaaaaucgucaagaaaggagacuccgcaaucguaaagagcgaaguagaauacggcaacugcaacaccaagugccagacccccaucggcgcaauaaacagcucaaugcccuuccacaacauccacccacuaaccaucggagaaugcccaaaauacgucaaaucaaacaagcuaguccucgcaaccggccucagaaacuccccacuaagagaacgacgacgcaaaagaggccuguucggagcuauagcaggcuucauagaaggcggauggcaaggcauggucgacggcugguacggguaccaccacucaaacgaacagggcagcggguacgccgccgacaaagaauccacacagaaagccaucgauggagucaccaacaaaguaaacagcaucaucgacaaaaugaacacacaauucgaagccgucggacgagaguucaacaaccucgaacgacgaauagaaaaccucaauaagaaaauggaagacggauuccucgacgucuggaccuacaacgcagaacugcucguccuaauggaaaacgaacgaacccucgacuuccacgacuccaacgucaaaaaccuauacgacaaaguccgacuccaacucagagauaacgcaaaagaacugggcaacggcuguuucgaguucuaccacaaaugcgacaacgaaugcauggaaagcguacgaaacggcacauaugacuacccccaauacucagaagaagcccgacuaaaacgagaagaaauaagcggagugaaacucgaauccaucggcaccuaccaauccggccgccuagucccacgagggucgccaggcuccggauacauccccgaagcaccacgcgacggccaagccuacguccgcaaagacggcgaauggguacuacucuccaccuuccucggaaaaccaauacccaacccucuacucggccuugauuccaccgga

SEQ ID NO: 58978 - RNA, 1704 nt, Artificial Sequence
  derived and/or modified sequence opt11 from anti-influenza_Chain
gaccacauaugcaucggcuaccacgcaaacaacagcacagaacaagucgacacaaucauggaaaagaaugucaccgugacccacgcgcaagacauccuagagaaaacacacaacggcaaauuaugcgaccucaacggaguaaaaccccucauccuaaaagacugcagcguagcaggcuggcuccucggcaaccccaugugcgacgaguucaucaacguacccgaauggucauacaucgucgaaaaggccaacccugcaaacgaccucugcuaucccggcaacuucaacgacuacgaagaacucaaacaccuccuaagccgaaucaaucacuucgagaaaauccagaucauccccaaagacuccuggagcgaccacgaagcaagccucggagucuccucagcaugcccguaccaaggcaacuccucauucuuccgaaacgucgucuggcuuauaaagaaagguaacgccuaccccaccaucaagaaaucauacaacaacaccaaccaagaagaccugcucgugcucuggggaauccaccaccccaacgacgaagcagagcaaacccgacuauaccagaaccccaccacauacaucuccaucggaacguccacgcucaaccaacgacucguccccaaaaucgcaacccguuccaaagucaacggccaguccggcaggaucgauuucuucuggaccauccuaaaacccaacgacgcaaucaacuucgaaucaaacggcaacuucaucgcccccgaauacgcauacaaaauagucaagaaaggagacuccaccaucaugaaauccgaggucgaauacgguaacuguaacacccggugccaaacacccaugggcgcaauaaacagcuccaugccauuccacaacauccacccccuaacaauuggggaaugcccaaaauacgucaaauccaacaaacugguccucgcgaccggccuccgaaacucaccccaacgagaacgccgccgaaaacgcggccuuuucggcgcaauagcaggcuucaucgaaggcggcuggcaaggcauggucgacggaugguacggauaccaccacuccaacgaacaaggcuccggauacgccgccgauaaagaguccacccaaaaagccaucgacggaguaacaaacaaagucaacucaaucaucgacaaaaugaacacacaauucgaagcagucggccgcgaauuuaacaaccuggaaaggcgcauagaaaaccucaacaagaaaauggaagacggguuccucgacgucuggaccuacaacgccgaacuccucguccucauggaaaacgaacgaacacuagacuuccacgacagcaacgucaaaaaccucuacgacaaaguacgacuacaacuaagagacaacgccaaagaacucggaaacggcugcuucgaguucuaccacaaaugcgacaacgaaugcauggaauccguacggaacggcaccuacgacuacccucaauacuccgaggaagcccgacucaaacgcgaagaaaucagcggagucaaauuagaaagcaucggcaccuaccagucuggacgccucguccccagaggaucacccggcagcggauacauccccgaagcaccccgagacggccaggccuacguuaggaaagacggagaauggguacuacuguccacauuccuaggaaaaccaauaccaaacccccuacuaggacucgacagcacuggc

SEQ ID NO: 58979 - RNA, 1704 nt, Artificial Sequence
  derived and/or modified sequence opt11 from anti-influenza_Chain
gaccaaaucugcauaggcuaccacgcaaacaacucuaccgaacaagucgacaccauaauggaaaagaacgucaccgucacccacgcccaggacauacuagagaaaacacacaacggcaaacucugugaccuagacggagucaaaccucugauccuccgcgacugcagcgucgcaggauggcuccucggaaaccccaugugcgaugaguucauaaacgucccagaauggucauacauagucgaaaaagccaaccccgccaacgaccuaugcuaccccggcaauuucaacgacuacgaagaacucaaacaccuccucagccgcauaaaccacuucgagaaaauccaaaucauccccaaauccucaugguccgaccacgaagccucaaguggaguaagcagcgccugccccuaccaaggaacacccuccuucuuccgcaacgucgucuggcugauaaagaaaaacaacacauaccccacaaucaaaagaagcuacaacaacaccaaccaggaagaccuccugauucucuggggcauacaccacucuaacgacgcagccgaacagaccaaacucuaccaaaaccccaccacauacaucagcgugggcacaucgacgcucaaccagcgccucgugcccaaaaucgccacccgcagcaaaguaaauggccaaagcgggcgaauggauuucuucuggaccauacucaaacccaacgacgcaaucaacuucgaaucaaacggcaacuucauagcccccgaauaugccuacaaaauaguaaagaaaggcgacuccgccaucgucaaaagcgaagucgaauacggcaacugcaacacaaaaugccaaacacccauaggcgcgaucaacagcuccaugcccuuccacaacauccacccauuaacaauaggggaaugcccaaaauauguaaaaucaaacaaacuuguacucgccaccggccuacgcaacucaccacuccgagaacgccgacgcaaacgaggccucuucggagccauagccgguuucauagaaggcggauggcagggcaugguagacggcugguacggcuaccaccauagcaacgaacagggcucaggauacgccgccgacaaagaaucaacacaaaaagcaauagacggcguaacgaacaaagucaacagcauaaucgacaaaaugaacacacaauucgaagccguaggcagagaguucaauaaucucgaacgccgcaucgaaaaccucaacaagaaaauggaagacggcuuccucgacguauggaccuacaacgccgagcuucucguccugauggaaaacgagcguacccucgacuuccacgacuccaacgucaaaaaccuauacgacaaaguucgccuccagcuccgcgacaacgcaaaagaacuuggcaacggcuguuucgaguucuaccacaaaugcgacaacgaaugcauggaauccguccgcaacggcacauacgacuacccacaguacuccgaagaagcccgacucaagagagaagaaauaucuggagucaaacucgagagcauuggcacauaccagucuggccgccucguaccccgcggauccccaggcagcggcuauauccccgaagcccccagagacgggcaagccuauguacgaaaagacggcgaauggguccuccucucaaccuuccucggcaaaccaauacccaacccacuacucggcuuggauucaaccgga

SEQ ID NO: 58980 - RNA, 1707 nt, Artificial Sequence
  derived and/or modified sequence opt11 from anti-influenza_Chain
gaccaaaucugcaucggcuaccacgcgaacaacuccacggaacaaguagacacaauaauggagaaaaacgucaccgucacccacgcccaagacauccucgaaaagaaacacaacgguaaacuaugcgaccuggacggagucaaaccccuaauacuacgcgacugcuccgucgccggcuggcuacucggaaaccccaugugcgacgaguucaucaacguacccgaauggagcuacaucgucgaaaaggccaaccccguuaacgaccucugcuaccccggagacuucaacgacuacgaagaacuuaaacaccuacucucccgcaucaaccacuucgaaaagauacaaauuauaccgaaauccucauggaguucacacgaagccucccucggagucagcagcgccugccccuaccaaggcaaaagcucauucuuccgcaacguugucuggcucaucaagaaaaacagcacuuaccccacaaucaaacgcucauacaacaacaccaaccaagaagaccuucucguccuuuggggaauccaccaucccaaugacgcagccgagcaaaccaaacucuaccagaacccaaccaccuacauuuccguaggcacuuccacacuaaaccaacggcuagucccacgaaucgccacccgaagcaaagucaauggccaguccggccgaauggaguucuucuggacuauccucaaacccaacgacgccaucaacuucgaauccaacggaaacuucauagcuccagaauacgccuacaaaauagucaagaaaggcgacuccacaauaaugaaaagcgaauuagaauacggcaacugcaacaccaaaugccaaacaccaaugggcgccauuaacagcucaaugccauuccacaacauacacccacucaccauaggcgaaugcccaaaguacguaaaauccaaccgccucguacucgccaccggccuccgaaacagcccccaaagagaacgcagacggaaaaagcgcggccuauucggagccauagccggguucaucgaaggcggcuggcaaggcaugguagacggcugguacggcuaccaccacuccaacgaacaaggcuccggauacgccgccgacaaagaaucaacccaaaaagcaaucgacggagucaccaacaaaguaaacuccauuaucgacaaaaugaacacacaguuugaggccguuggccgagaguucaacaaccucgaacgccgcaucgaaaacuugaauaagaaaauggaagacggcuuccuugacguauggaccuacaacgccgaacuccucguccucauggaaaacgaacgcacgcuagacuuccacgacagcaaugucaaaaaccuguacgacaaaguacgccuccaacuacgcgacaacgccaaagaacucggaaacggaugcuucgaguucuaucacaaaugcgauaacgaaugcauggaaagcguacgcaauggaacauacgacuacccccaguacuccgaagaagcccgccucaaacgagaagaaaucagcggaguaaaacucgaaagcaucggcaucuaccaaucaggccgucucguaccccggggaucccccgguuccggcuacauaccggaagccccgagagacggccaggcuuacguuagaaaagacggcgaauggguccuacucuccaccuuccugggaaagccaauacccaacccacuacucggacuagacuccaccggc

SEQ ID NO: 58981 - RNA, 1707 nt, Artificial Sequence
  derived and/or modified sequence opt11 from anti-influenza_Chain
gaccaaaucugcauagguuaccacgccaacaacuccaccgaacaagucgacaccaucauggagaaaaacguaaccgucacccacgcacaagacauucuagaaaagacccacaacgggaaacuaugcgaccuugacggagucaagccccuaauacuccgcgacugcucaguugcaggguggcuccuaggcaaccccaugugcgacgaauucauaaauguccccgaaugguccuacaucgucgaaaaagccaacccaacaaacgaccucugcuaccccggcucauucaaugacuacgaagaacucaaacaccugcucucccggauaaaccauuucgaaaaaauccagauuauccccaaaagcuccuggucggaccacgaggcaagcuccggcguaucaucagccugcccauaccucggcucucccuccuucuuccgcaacgucguguggcuaaucaaaaaaaacagcaccuauccaaccaucaaaaaauccuacaauaacacaaaccaggaggaccuacucguccucugggggauccaccaccccaacgacgccgccgagcagacccgacuauaucaaaaccccacaacguacaucuccaucggaacauccacccucaaccaacgccuaguaccaaaaauagccacccgcuccaaagucaacggucaaucaggccgcauggaauucuucuggaccauccucaaacccaacgacgccaucaacuucgaaucaaacggcaacuucaucgcccccgaauacgccuacaaaauugugaaaaaaggcgacuccgcaauuaugaaaucagaacucgaauauggcaacugcaacacaaaaugccaaacgccaaugggcgcaauaaacagcucgaugccauuccacaacauacacccccucaccaucggggaaugccccaaauacguaaaaucgaaccgacuaguacuagccacaggccuacgcaacuccccccaacgcgaaagccgccguaaaaaacgcggccucuucggcgcaauugccggguuuaucgaaggcggcuggcaaggaauggucgacggaugguacggauaccaccacucaaacgaacaaggauccggauacgccgcggacaaagaauccacccagaaagccaucgacggcgucacaaacaaaguaaacucgaucauagacaaaaugaacacccaauucgaagccguaggccgcgaguucaacaacuuggaacgccgaaucgaaaaccucaacaagaaaauggaggacggauuccucgacgucuggaccuacaacgccgaacuccuaguucuaauggaaaacgagcgaacucuagacuuccacgacuccaacgucaaaaaccucuacgacaaaguaagacuucaacuccgcgacaaugcuaaagaacucggcaacggcugcuuugaauucuaccacaaaugugacaacgaaugcauggaguccauccgcaacggaaccuacaauuacccacaauacagcgaggaagcacgacucaaacgagaagaaaucucaggagucaaacuggaauccauaggaaccuaccagucaggccggcuuguaccccgcggcaguccaggcuccggauacauccccgaagcaccgcgagacggccaagcauacgucagaaaagacggagaauggguacugcuaagcacauuccuaggcaagcccauccccaacccacuacucggacuagacuccaccggc

SEQ ID NO: 58982 - RNA, 1707 nt, Artificial Sequence
  derived and/or modified sequence opt11 from anti-influenza_Chain
gaccaaauaugcauaggcuaccacgccaacaacuccaccgagcaagucgacaccaucauggagaaaaacgucaccgucacacacgcccaagacauccucgagaaaacccacaacggcaaacuaugcgaccucgacggcgucaaaccgcucauccuacgagacugcagcgucgcuggguggcuacuaggaaaccccaugugcgacgaguuccugaacgucagcgaaugguccuacaucgucgagaaaauaaacccagccaacgaccucugcuacccaggaaacuucaauaacuacgaagaacucaaacaccuacucucccguaucaaccgauucgagaaaauccaaaucauuccaaaauccagcuggcccgaccacgaagcaagccucggcguauccagugccugccccuaccaaggcggcccauccuucuaccgcaacguagucuggcuaauaaagaaaaacaacaccuacccaaccaucaagaaaucauaucacaacaccaaccaggaagaccugcuaguacucuggggaauccaccacccaaacgacgaagcggaacaaacacgaaucuacaaaaaccccaccaccuacaucuccguaggcaccucaacccucaaccagcggcuggucccaaaaaucgcgacccgcuccaaagugaacggacaaagcggcagaguagaguucuucuggacgauccugaaaucaaaugacaccauaaacuucgaaucaaacggcaacuucaucgcacccgaaaacgccuauaaaaucguaaagaaaggcgacagcacuaucaugaaauccgaacuagaauacggcaacuguaacacaaaaugccaaacaccgaucggcgcaauuaacagcucaaugccauuccacaacauccauccacucaccaucggcgaaugcccgaaauacgucaaaucaaacaggcuggucuuggccacaggccuucgcaacagcccccaaggcgaaaggcgacgaaagaaacgcggccucuucggcgcaaucgccggauucaucgaaggaggcuggcaaggcauggucgacggcugguacggcuaucaccacucuaacgaacaaggauccggguacgccgccgacaaagaaucaacccagaaagccauagacggagucacaaacaaagugaacucuaucauagacaaaaugaacacccaauucgaagccgucggacgcgaguucaacaaccuagaaagacgcauagaaaaccuaaacaagaaaauggaagacggcuuccuagacgucuggaccuacaacgcagaacuccuaguccuuauggaaaacgaacgcacacucgacuuccacgacagcaaugucaaaaaccuauacgacaaaguaaggcuccaacuaagagauaacgccaaagaacucggcaauggcugcuucgaguucuaccaccggugcgacaacgaaugcauggaaagcguacgaaacggcacauacgacuacccccaauacucagaagaagcucgacucaaacgggaagaaaucagcggcgugaaacucgaaucgauaggcaccuaccaauccggacgacucgucccccgaggaucacccggaaguggcuacauccccgaagcaccccgcgacggccaagcauacguccgaaaagacggcgaauggguccuccugucuacuuuccuaggaaaacccaucccaaacccacuccucggacucgacagcaccggc

SEQ ID NO: 58983 - RNA, 1707 nt, Artificial Sequence
  derived and/or modified sequence opt11 from anti-influenza_Chain
gaccaaauaugcaucggcuaccacgccaauaacagcaccgagcaagucgauaccaucauggagaaaaacguaacagugacccacgcccaagacauacuggaaaagaaacacaacggcaaacugugcgaccucgacggagucaaaccccucauccuacgagauugcuccguagcaggauggcuccuagggaaccccaugugcgacgaauuuaucaacgucccugaauggagcuacaucguagaaaaagccaacccaguaaacgaccuaugcuauccaggcgacuucaacgacuacgaagaacucaaacaccuacuaucccgaaucaaccacuucgagaaaauccaaaucauccccaaaagcagcuggagcucacacgaagcaucgcucgggguauccucagcaugccccuaccaagggaaauccuccuucuuccgcaacguagucuggcuaauaaagaaaaacagcaccuacccaacaaucaaacgaagcuacaacaacaccaaccaagaagaccugcugguacucuggggaauacaccaccccaacgacgcagcagaacaaacuaaacuuuaccaaaacccaaccacguacauaagcgucggcaccaguacccucaaucaacgacuugucccacgcaucgcgacaagauccaaaguaaacggccaaucuggcagaauggaguucuucuggaccauacucaaacccaacgacgcgauaaacuucgaauccaacggaaacuucaucgcccccgaauacgccuauaaaauaguaaagaaaggagacuccacaaucaugaaauccgaacuagaauacggcaacugcaacaccaaaugccaaacacccaugggagcaaucaacuccagcaugcccuuccacaacauacacccccucacuauaggagaaugcccaaaauacgucaaauccaaccgacugguacuugcaacaggccucagaaauagcccccaaagagagcgcagaagaaagaaacgaggacucuucggcgccaucgccggcuucaucgaagguggauggcaaggcauggucgacggcugguacggguaccaccacuccaaugaacaaggauccggcuacgccgcagacaaagaaagcacacaaaaagccaucgacggcguaaccaauaaaguuaacuccaucauagacaaaaugaacacccaauucgaagcagugggacgcgaguucaauaaccucgaacgccgcaucgaaaaccucaacaagaaaauggaagacggauuccuagacguauggacauacaacgcagaacuccuaguacucauggaaaacgaacgaacgcucgacuuccacgacagcaacgucaaaaaccucuacgacaaaguacgcuuacaacuacgcgacaacgcuaaagaacucggcaacgguugcuucgaguucuaccacaaaugcgauaacgaaugcauggaaagcguacgaaacggcaccuacgacuacccccaguacagcgaagaagcccgccucaaacgcgaagaaaucuccggaguaaaacuugaauccaucggaaucuaucaaagcggcagacucgucccacguggcucacccggcagcggcuacaucccagaagcaccccgggacggacaagccuauguuagaaaagacggcgaauggguccuccuuaguaccuuccuaggcaaacccauaccuaacccccuccuaggacucgacucaacagga

SEQ ID NO: 58984 - RNA, 1707 nt, Artificial Sequence
  derived and/or modified sequence opt11 from anti-influenza_Chain
gaccaaauauguaucggcuaccacgccaacaacagcaccgaacagguugacaccaucauggaaaagaaugugaccguaacccacgcacaagacauccuagaaaaaacccacaacggaaaacuuugcgaccucgacggcgugaaaccacucauccuacgggacugcuccguagccggcuggcuccugggcaaccccaugugcgacgaauucaucaacgugcccgaaugguccuauaucgucgaaaaagccaacccgacaaacgaccucugcuacccaggaucuuucaacgacuacgaggagcuaaaacaccuccucucaaggauaaaccacuucgaaaaaauacaaaucauccccaaaucaagcugguccgaccaugaagcguccuccggcguauccuccgccugccccuaccuaggcucaccaagcuucuucagaaacguagucuggcuaaucaaaaaaaacuccaccuacccaacuauaaaaaaauccuacaacaacacuaaccaagaagaccuccucguacucuggggcauccaccacccaaacgacgcagcggaacaaacccgccucuaccagaaccccacaacauacaucucaaucggaacaagcacccuaaaccaacgguuagucccaaaaaucgcaacgagauccaaagugaacggacaauccggucguauggaauucuucuggaccauccuaaaaccgaacgacgccauaaacuucgaaucgaacggaaacuucaucgcccccgaauacgccuacaaaaucgucaaaaaaggagacagcgcaaucaugaaauccgaacuagaauacggcaacugcaacaccaaaugccaaacucccaugggcgccauuaacaguagcaugccauuccacaacauccacccacuaaccaucggcgaaugcccaaaauacgucaaauccaaccgacucguccucgccaccggccuccgaaacagcccacaacgcgaaucccgacgcaaaaaacgcggacuuuucggagcaauagcaggcuucaucgaagguggcuggcaaggaauggucgacggcugguacggcuaccaccacagcaacgaacaaggaagcggcuacgccgcugacaaagaauccacccaaaaagccaucgacggagucacaaacaaagucaauuccauaauugacaagaugaacacccaauucgaagccgugggccgcgaauuuaacaaccuagaacgccgaaucgaaaaccucaacaaaaagauggaagacggcuuccuagacguguggacauauaacgcagaacugcugguccuaauggagaacgaaagaacacuagacuuccacgacagcaacguaaaaaaucucuacgacaaaguccgccuacagcuccgagacaacgcuaaggaacuaggaaacggcuguuucgaauucuaccacaagugcgacaacgaauguauggaaucgauccgcaacggcacauacaauuacccgcaauacucggaagaagcgaggcucaaacgagaagaaaucagcggaguaaaacucgaaagcaucggcaccuaccaauccggacgacucguaccucgaggcagccccgggucaggcuacauccccgaagcccccagagacggacaggccuacguccgcaaagacggagaauggguccuacucagcacuuuccucggaaagcccaucccaaacccccuccuaggccucgacucgaccggc

SEQ ID NO: 58985 - RNA, 1707 nt, Artificial Sequence
  derived and/or modified sequence opt11 from anti-influenza_Chain
gaccaaauaugcauaggcuaccacgcaaacaacuccaccgaacaaguugauaccaucauggaaaagaacgugaccgucacucacgcucaagacauccuagaaaaaacacacaauggaaaacuaugcgaccucgacggcgucaaaccccuaauccuccgagacugcuccgucgcaggcuggcuccuaggcaaccccaugugcgacgaauuccucaacgucuccgagugguccuacauagucgaaaaaaucaacccugccaacgaccucugcuaccccggcaacuucaacaacuacgaagagcuaaaacaccuccucagccgaauaaacagauucgaaaaaauacaaauaaucccaaaauccagcuggccggaccacgaagccucccugggcguaucguccgccugcccauaccagggcggccccuccuucuaccgcaacgucgucuggcucaucaaaaaaaacaacacauacccgaccaucaaaaaauccuaccacaacacgaaccaagaagaccuacucguccucuggggaauccaccacccaaacgacgaggcagaacagacccgaaucuacaaaaaccccaccacauacauauccguaggcaccuccacccuaaaccaacgccucguccccaagaucgccacacgaucaaaagucaacggccaaagcggcagagucgaauucuucuggaccauccuaaaaagcaacgacacaaucaacuucgaauccaacggcaacuucaucgcacccgagaacgccuacaagaucguaaaaaaaggcgacuccacaauaaugaaaagugaacucgaauacggcaacuguaacacaaaaugccaaacccccauaggcgcuaucaacuccucaaugccauuccacaacauucacccacucaccauaggcgaaugccccaaauacgucaaaucaaaccgacuaguccuagccacgggccugcgaaacucaccacaaggagaacgccgccgaaaaaaacgaggccucuucggggccauagccggcuucaucgaaggcggcuggcaaggaauggucgacggcugguacggcuaucaccauagcaacgaacaaggcucuggcuacgccgcagacaaagaaucaacccagaaagcaauagacggcgucaccaacaaaguaaauuccauaauagacaaaaugaacacacaauucgaagccgucggcagagaauucaacaaccucgaacgccgaauagaaaaccuaaauaaaaaaauggaagacggcuuccucgacgucuggacauacaacgcagagcuacuaguccuuauggaaaacgaaagaacacuggacuuccacgacucaaacgucaaaaaccuauacgacaaaguccgccuacaacuccgagacaacgccaaagaacucgguaacggcugcuucgaguucuaucaccgcugcgauaacgaaugcauggaguccguccgcaacggcaccuacgacuacccacaauacagcgaggaagcacgccucaaacgcgaagaaaucucuggaguaaagcuagaguccaucggaacauaccaaagcggcagacucguaccacgcggcucaccaggcucaggcuacauccccgaagcccccagagacggccaagccuacguccgaaaagacggcgaaugggugcuuuuauccaccuuccucggcaaacccauccccaacccccuccucggacuugacagcaccggc

SEQ ID NO: 58986 - RNA, 1728 nt, Artificial Sequence
  derived and/or modified sequence opt11 from anti-influenza_Chain
auaugcaucggcuaccacgccaacaacucuaccgaacaagucgauaccauuauggaaaagaacguaaccgucacccacgcacaggacauccucgagaaaacccacaacggaaaacuaugcgaccucgacggcgucaaaccacucauauuacgcgacugcucuguagcaggcuggcucuuagggaacccaaugugcgacgaguucaucaacguucccgaaugguccuacaucguagaaaaagccaaccccgccaacgaccugugcuaccccggaaacuucaaugacuaugaagaacucaaacaccuccuaucccgaaucaaccacuucgagaaaauccaaaucauccccaaaucuuccugguccgaccacgaagccucaucuggcguauccucagccugcccauaccaaggaacaccauccuuuuuccgcaacguaguauggcuaaucaaaaagaacaacaccuaccccaccaucaaacguucguacaacaacacuaaccaagaagaccuacuaauccuauggggcauccaccacuccaacgacgccgccgaacaaaccaaacucuaccagaaccccaccacauacaucagcgucggcaccuccacuuuaaaccaacgccuaguaccaaaaaucgccacccgcagcaaagucaauggacagaauggacgcauggacuucuucuggaccauacuuaaaccaaacgacgccaucaacuucgaaucuaacggcaacuucaucgccccagaauacgccuacaaaaucgucaaaaagggcgauucugccauaguaaaaucagaagucgaauacggcaacugcaacacaaaaugccaaacccccaucggcgccaucaacucuagcaugccauuccacaacauccacccgcuaaccaucggcgaaugccccaaguacgugaaauccaacaagcucguacucgcaaccggguuacgaaacucaccccucggauacauccccgaagcaccccgagacggccaggccuacguucgcaaagacggagaauggguacuacucuccaccuuccuacgcuccgacaaaacacacacgugcccacccugccccgcucccgaacuauuaggcggccccuccguauuccucuucccacccaaaccuaaagacacccucaugauuuccagaacucccgaagucacaugcguaguaguugacguaucccacgaagaccccgaaguuaaauucaacugguacguagacggcguagaaguccacaacgccaaaaccaaaccccgagaagaacaauacaacuccaccuaccgcgucgucuccguccucacaguccuccaccaagacuggcucaacggcaaagaauacaagugcaaagucucaaacaaagcccuccccgccccaaucgagaaaaccauauccaaagcaaaaggacaaccaagagaaccccaagucuacacgcuacccccuucacgcgaagaaaugacuaaaaaccaggugucccucacaugccucgucaaggguuucuauccauccgacaucgcagucgaaugggaauccaacggccaacccgaaaacaacuacaaaaccacacccccaguacucgacuccgacggcucauucuuccuuuauagcaaacucaccgucgacaaaucacguuggcaacaagguaacgucuucuccugcuccguaaugcacgaagcccuucacaaccacuacacccaaaaaucacucucucuaucacccggcaaa

SEQ ID NO: 58987 - RNA, 1728 nt, Artificial Sequence
  derived and/or modified sequence opt11 from anti-influenza_Chain
auggucgucaccucaaacgcagaccgcaucuguacaggaauaacaagcucgaacucaccccacgucgucaaaacggccacacaaggggaagugaacguaaccggggucauaccucuaaccaccacacccaccaaaucccacuucgcaaaccuaaaagggaccgaaaccaggggcaaacucugucccaaaugccucaacugcaccgaccucgacguagcgcuaggacgccccaaaugcacaggaaacauaccuuccgcucgggugucaauacuacacgagguacgccccgugaccucgggaugcuucccaaucaugcacgaccgcacgaaaauacgacaacucccgaaccuucuacgcggcuacgaacacauaaggcucucgacccacaaugugaucaacgccgaaaacgcgccaggaggcccauacaaaaucgguaccucgggcucaugcccaaacgugaccaacggcaacggauucuucgcgaccauggccugggccguccccaagaacgauaacaacaaaacagccaccaacucacucacgauagagguccccuacaucugcacugaaggagaagaccaaauaaccgucuggggcuuccacagcgacaacgaaacacaaauggcgaaacuauacggcgacucaaaaccacaaaaauucacgagcuccgcaaacggaguaaccacgcacuacgucucacaaaucggcggcuucccgaaccaaaccgaagacgggggacuaccccaaagcggacgaauagucguagacuacaugguacaaaagagcggcaaaacuggcaccaucacuuaccagcgaggcauucuacucccacaaaaagucuggugcgcgagcggaaaauccaaaguaaucaaagguucgcucccccuaauaggcgaagccgacugccuucaugaaaaauacggcggacucaacaaaucaaaaccguacuacaccggcgaacacgcaaaagccaucggcaacugcccaaucuggguaaaaaccccacucaaacuagcaaacggcaccaaguacaggccgcccgccaaacuccucaaagaacgcggcuucuucggcgcgaucgcaggcuuccuagagggcggaugggaaggcaugaucgcaggcuggcacggguauacaagccauggugcccacgggguagccgucgcagccgaccucaaaagcacacaagaagcaauaaacaagauaacgaaaaaccucaacucccugagcgaacuugaggucaaaaaccuacaaagacucucaggagcaauggaugaacuacacaacgaaauccucgaacucgacgaaaaagucgacgaccuacgagcagacacgaucuccagccagaucgaacucgcgguccuacuaucaaaugaagguaucaucaauuccgaagacgaacaccuucuggcccucgaacgcaagcucaagaaaaugcuaggaccaucagcgguagagaucggcaauggaugcuuugagacaaaacacaaaugcaaccaaacaugccuagacaggaucgcggccggcaccuucgacgcaggagaguucucgcucccaaccuucgacucccucaacauaaccgccgcgagccuaaacgacgacggccuugacaaccacacaauacucuuauacuacagcacggccgcaagcucacucgccgucacccuaaugauagcaaucuucgucguuuacaugguaucccgcgacaacgucagcugcuuccacagc

SEQ ID NO: 58988 - RNA, 1728 nt, Artificial Sequence
  derived and/or modified sequence opt11 from anti-influenza_Chain
auggucgucacaucaaacgcagaucggaucugcaccgguauaacgagcucaaacucgccacacgucguaaaaacggccacccaaggggaagucaacguaacaggaguaaucccccugaccacgacaccaaccaaaagccacuucgcgaacuuaaaagggacagaaacacgcggcaaacucugccccaaaugccuaaacugcaccgaccucgacguagcacucggaagacccaaaugcaccggaaacauacccucggccagagucucaauccugcacgaaguccgaccaguaaccucaggauguuucccaauaaugcacgaucgaacaaaaauacgccaacucccgaaccuacuucgaggcuacgaacacaucagacuaucaacacacaacgugaucaacgccgaaaacgcaccaggcggcccguacaaaaucggcaccucaggcucaugcccaaacgugaccaacggcaacgguuucuucgcaacaauggcaugggccguacccaaaaacgacaacaacaaaaccgccacaaacucgcucacaaucgaagucccauacauaugcacggaaggcgaagaccaaauaaccguuuggggcuuccacagcgauaacgagacccagauggccaaacuuuacggggacucaaaaccacaaaaguucacaagcucggcaaacggcgucaccacacacuacgucucacaaauaggcggcuucccuaaucaaaccgaagacggcggacuaccccaauccgggcgcauagucgucgacuauauggugcaaaaauccggcaaaacaggcacgaucacauaccaacguggaauacuacucccgcaaaaaguauggugcgcgagcggaaaaucaaaagucaucaagggcagccuacccuuaauaggcgaagccgacugccugcacgaaaaauacggcgggcucaacaaaucgaaaccauacuacaccggcgaacaugcgaaggccaucggcaacugcccgaucuggguaaagacaccccuaaaacucgcaaacggcaccaaauacaggccaccggccaaacuacuaaaagaacgcggauucuucggagccaucgcaggguuccucgagggcggcugggaaggaaugaucgcaggcuggcacggauacacaagccacggcgcgcacgggguagcagucgcggcagaucucaaaagcacccaagaagccauaaacaaaaucacgaaaaaucucaacagccuaagcgagcuagaagucaaaaaccugcaacggcucucaggcgcgauggacgaacuccacaaugaaauacucgaacuagaugaaaaggucgacgacuuaagagccgacaccaucucaagccaaaucgagcucgcaguacuccucucgaacgagggcauaauaaacuccgaagacgaacaccuacucgcgcucgagcgcaaacuuaagaaaaugcucgggcccucagccguagaaauagguaacggcugcuucgagaccaaacacaaaugcaaucaaaccugccuagaccgaaucgccgccgggaccuucgacgcuggagaguucucccucccgaccuucgacagccucaacaucacugccgcgagccuaaacgacgacggccucgacaaccacaccauacuacucuacuacucuacagccgcaucaucccuagcagucacgcuaaugauagcaaucuucguaguauacauggucucccgagacaacgucucaugcuuccacagc

SEQ ID NO: 58989 - RNA, 1728 nt, Artificial Sequence
  derived and/or modified sequence opt11 from anti-influenza_Chain
aucugcauaggauaccacgccaacaacuccacagaacaaguagacacaauaauggaaaagaacgucaccgucacccacgcccaagacauucuugaaaagacccacaacggaaaacucugcgaccucgacggagucaaaccacucauacucagagacugcucaguagccggauggcuccugggaaaucccaugugcgaugaguucauaaacgucccggaaugguccuacauaguagaaaaagccaaucccgcaaacgaccugugcuauccagggaacuucaacgacuacgaagaacuuaaacaccuccuaagccgcauaaaccacuucgaaaagauccagauaauacccaaauccuccugguccgaccacgaagccuccagcggcgucucaagcgcaugccccuaccaagguaccccuuccuucuuccgaaaugucgucuggcuaauaaagaaaaacaacaccuacccaaccauaaaacgaucauacaacaacacgaaccaagaagaccuccuaauccucuggggcauucaccacuccaacgacgccgcagaacaaaccaaacucuaccaaaacccaaccacauacaucucagucggaaccucuacucucaaccaacgacucgugccaaaaauagccacacgcuccaaaguaaacggccaaaacggacgaauggacuucuucuggacaauccucaaaccaaacgacgccaucaacuucgaauccaacggcaauuucauagcccccgaauacgcauacaaaaucgucaagaaaggcgacucagcgaucgucaaauccgaagucgaauacggaaacugcaacacgaaaugucaaaccccgaucggagcaauaaacucaucaaugccauuccacaacauccacccucucaccaucggagaaugccccaaauacguuaaauccaacaaacucguccuagcaaccggacucagaaacucuccccuaggauacaucccagaagcgccucgagacggccaggcauacguccgcaaagacggugaauggguccugcucagcacauuccuacgcuccgacaaaacccauaccugcccaccuugccccgcccccgaacuccuaggaggcccaagcgucuuccucuuucccccaaaaccuaaagacacacuaaugaucucgcgcacccccgaagugaccugcgucgucgucgacgucucacacgaagaccccgaaguaaaauucaacugguacgucgacggcguagaaguccacaacgccaaaaccaaaccccgcgaagaacaauacaacuccacauaccguguagucagcguacucacaguccuccaccaagacuggcuaaacggaaaagaauacaaaugcaaagucucaaauaaagcacuucccgccccaaucgagaaaacuaucuccaaggccaaaggccaaccuagagaaccccaagucuacacccuaccaccaucacgagaagaaaugaccaagaaccaagucucacuuacgugccuagucaaaggcuucuacccguccgacaucgccguagaaugggaaucaaacggucaaccagaaaacaacuacaagaccaccccucccguccucgacuccgacggaucauucuuccuauacucaaaacucaccgucgacaaaagucgcuggcaacaaggcaacgucuucagcugcuccguaaugcacgaagcccuccacaaccacuacacccagaaaagccucucacucagccccggcaaa

SEQ ID NO: 58990 - RNA, 1731 nt, Artificial Sequence
  derived and/or modified sequence opt11 from anti-influenza_Chain
gccaaagccggaguccaaucagucaaaauggagaaaaucguccuacuguucgccaucgucagccuagucaaaucggaccaaauaugcaucggauaccacgcaaacaacucaacagaacaagucgacaccaucauggagaaaaacgucaccguaacacacgcacaagacauacuggagaaaacgcacaacggcaaacuaugcgaccuagacggcgucaaaccacucauucuccgagauugcagcgucgcgggcuggcuauuagggaaccccaugugcgacgaauuuaucaacguucccgaaugguccuacaucgucgaaaaagcaaaccccguaaacgaccucugcuaccccggcgacuucaacgacuaugaagaacucaaacaccuccuaucccgaaucaaccacuucgagaaaauccaaauaaucccgaaauccuccuggucgucccacgaggcuucacuaggcguaagcuccgccugcccauaccaaggaaaaucuagcuucuuccgcaacgucgucuggcucauaaagaaaaacuccacauaccccaccauaaaacgcuccuacaacaacaccaaccaggaagaccuccuuguccucuggggaauccaccacccaaacgacgcagcagaacaaacaaaacuguaccaaaacccaaccacauacaucuccgugggcaccuccacccucaaucaaaggcuaguuccgcgaaucgcaacccgaucaaaagucaacggccaauccggccgaauggaguucuuuuggacgauccucaaacccaacgacgccaucaacuucgaaucaaacggcaacuucaucgcccccgaauacgcauacaaaaucgucaagaaaggagacuccacaaucaugaaaagcgaacuagaauacggcaacugcaacaccaaaugccaaacccccaugggggcaaucaacuccagcaugccauuccacaacauacacccacugacaaucggagaaugccccaaauacgucaaaagcaaccgccucguccuagcuaccggucuccgaaacagcccgcagcgcgaacgccgccguaagaaacgcggacucuucggcgccauagcaggcuucauagaaggcggcuggcaaggcauggucgacggcugguauggcuaccaccacuccaacgaacaaggauccggauacgccgccgacaaagaaucaacacaaaaagcaaucgacggcguaaccaacaaagucaacagcaucaucgacaaaaugaacacccaguucgaagcagucggacgagaguucaacaaccuagaacgccgcaucgaaaaccucaacaagaaaauggaagacggcuuccuagacguauggaccuacaacgccgaacuauuaguacuaauggaaaacgaaagaacccuagacuuccacgacagcaacguuaaaaaccucuacgacaaaguccgacuccaacuccgcgacaacgccaaagaacugggaaacggcugcuucgaguucuaccacaaaugcgauaacgaauguauggaauccguaagaaacggaaccuacgacuacccacaguacucagaagaagcacgccucaaacgcgaagaaaucuccggcgucaaacucgaaucaauagguauauaccaaauccuguccaucuacuccacaguagccagcucacucgcccuagcgcucauggucgcaggacucagccucuggaugugcucaaauggcucacuccaaugccgcaucugcauc

SEQ ID NO: 58991 - RNA, 1731 nt, Artificial Sequence
  derived and/or modified sequence opt11 from anti-influenza_Chain
gccaaagcaggcguacaauccguaaagauggaaaaaaucguacuccuauucgcuaucgugucccucguuaaaagcgaccaaauaugcaucggcuaccacgcaaacaacagcaccgaacaagucgacacgauuauggaaaaaaacgucaccgucacacacgcacaagacauccucgaaaaaacccacaacggcaaacuaugcgaccucgacggcguaaaaccccuaauccuccgagacugcucggucgcaggguggcuacucggcaaccccaugugcgacgaauucaucaacguaccagaaugguccuauauaguugaaaaagccaacccugucaacgaccucugcuaccccggcgacuucaacgacuacgaagaacucaaacaccuccucucucgcaucaaccacuucgaaaaaauccaaauaaucccaaaaagcucaugguccucccacgaagccagccucggagucuccuccgccugccccuaccaaggcaaaucaucauucuuccggaacgugguauggcuaaucaaaaaaaacagcaccuaccccacaauaaaaagaucauacaacaacaccaaccaagaagaccuccucguacuguggggcauccaccacccaaacgacgcggccgaacagaccaaacuauaccaaaaccccaccacauacaucuccgucggcacguccacacuaaaccagcgccuagucccccgcaucgccacccgauccaagguaaacggccaaagcggccgcauggaguucuucuggaccauccucaagcccaaugacgccauaaacuucgaaucaaacgggaauuucaucgcccccgaguacgccuacaaaauaguaaaaaagggcgacuccaccaucaugaaaucagaacucgaauauggcaacugcaacaccaaaugccaaacaccaaugggugcaauaaacagcucuaugccguuccacaacauccacccccucacgauaggagagugccccaaauacgucaaaucaaaccgccuaguccuggccaccggccuccggaacagcccacaacgagagagaagacgcaaaaaacgaggccuauucggagcuauagcaggauucaucgaaggaggcuggcaaggcauggucgacggcugguacggguaccaucacucaaacgaacaagggaguggcuacgccgcagacaaagaaucgacccaaaaagccauagacggcguaacaaacaaagugaacuccaucauagacaaaaugaacacacaauucgaagcgguaggacgagaauucaauaaccucgaacgacgcaucgaaaaucucaacaaaaaaauggaagacggcuuccuagacgucuggaccuacaaugccgaacuacucguccuuauggaaaacgaacggacacuggacuuccacgacagcaacgucaaaaaccucuacgacaaaguccgccuacaacuacgugacaacgcaaaagaacuaggcaacggaugcuucgaauucuaccacaaaugcgacaacgaaugcauggagagcguccgcaacgguacauacgacuacccccaauacagcgaagaagcccggcuuaaacgcgaagaaaucuccggcguaaaacuugagagcaucgggaucuaccaaauacucagcauauacaguaccguagcaucaagccucgcccuugcccucauggucgccggucuaucccuguggaugugcagcaauggcagccuccaaugccgaauaugcaua

SEQ ID NO: 58992 - RNA, 1737 nt, Artificial Sequence
  derived and/or modified sequence opt11 from anti-influenza_Chain
auggucgucaccagcaacgccgaccgcaucugcacaggaaucaccuccagcaacagcccacacguagucaaaaccgcaacccaaggcgaagucaacgucacaggagucaucccccucacaacaacacccaccaaaucccacuucgcaaaccucaaaggaacccagacccguggaaagcuaugcccaaauugucucaacugcacggaccuagacgucgcacucgggaggcccaaaugcaugggaacgaucccaagcgcgaaagcauccauacuucacgaaguaaaacccguaacaagcggaugcuucccaauaaugcaugaccgcaccaaaaucagacaacucccaaaccuccugcgaggguacgagaacauacgacucucagcacgcaacgucauaaacgcagaaaccgcacccggaggaccauacauaguagguacaagcggcagcugcccgaacguaacaaacggcaaaggauucuuugccaccauggccugggcgguccccaaaaacaaaaacaaaaccgcuaccaacccacuaacgguagaagucccguacauuugcacaaagggcgaagaccaaaucaccguauggggauuccacagcgacaacgaagcccagauggucacccucuacggcgacuccaaaccacaaaaauucacuagcuccgcaaauggagucaccacacacuacgucucgcaaaucggcggcuucccaaaucaaaccgaagacgaaggccugcaacaaagcggccgaaucguaguagauuacaugguccaaaagcccggaaaaaccggaacgaucguauaccaacgcggcguacuccucccccaaaaaguauggugcgcauccggacguucaaaagucaucaaagguucgcuaccacucauaggcgaagcggacugccugcacgagaaauacggcggacucaacaaaucaaaaccuuacuacacaggagaacacgccaaagcaaucggcaauugcccgaucuggguaaagacaccacucaaacuagcgaacggaaccaaauaccgaccaccagccaaacuacugaaagaacgaggauucuucggcgcaaucgcaggauuucucgagggagggugggagggcaugaucgccggauggcacggauacaccagccacggcgcgcacggagucgcgguagcagcagaccucaaauccacacaagaagcaauaaacaagaucaccaaaaaccucaacagccuauccgagcucgaagucaaaaaccuacaaagacucagcggcgcgauggacgaacuacacaacgaaauacuggagcucgaugaaaaaguagacgaccuucgcgcagacacaaucucaucacagaucgaacucgcaguacuacucuccaacgaaggcauaauaaacagcgaagacgaacaccuacucgcccuagagcguaaacuaaagaaaaugcuaggacccagcgccguagauauaggcaacggcugcuucgagacaaaacacaaaugcaaucaaacgugccuagaccgcauagcggcaggcacauucaacgccggcgaguucucgcuccccaccuucgacucccuaaauaucacggccgcaucccucaaugacgacggacuagacaaccacaccauacuccuguacuacagcacagccgcaagcucccucgcgguaacgcucaugaucgcaaucuucaucgucuacaugguaucacgcgauaacguguuccuacuccaucucuccaucaggaaa

SEQ ID NO: 58993 - RNA, 1737 nt, Artificial Sequence
  derived and/or modified sequence opt11 from anti-influenza_Chain
auggucgucaccagcaacgccgaccgaaucugcaccggcauaacaucguccaacagcccacacgucguaaaaaccgcaacccaaggcgaagucaacgucaccggcguaaucccccucacgaccacccccacaaaaucccacuucgcaaaccuaaagggcacgcaaacccgcggaaaacucugcccaaacugccucaacugcacagaccucgacguugcccuaggccgacccaaaugcaugggaaccauccccagcgcaaaagcaagcauacuccacgaaguaaaacccgucacaucaggaugcuucccaaucaugcaugaccgcaccaaaauccggcaacucccaaaccuacuccgaggcuacgaaaacauccgccugagcgcccguaaugucaucaacgcggaaacagccccaggcggcccauacaucgugggcaccagcggcucuugccccaacgucacaaaugggaaaggguucuucgccacaauggccugggcaguccccaaaaauaaaaacaaaacagcaaccaacccucucacagucgaagucccguacauaugcaccaagggugaagaccaaaucaccguguggggguuccacucagacaacgaagcccagaugguaacccuauacggcgacucaaaaccacaaaaauucaccagcucggccaacggcgucacaacccacuacguaucccaaauaggcggauuccccaaccaaaccgaagacgaaggacuccaacaaucaggccgcauaguuguagacuacaugguccaaaaacccggaaaaacuggcaccauaguauaccaacgcggcgucuuauuaccccagaagguauggugcgcuuccggccguuccaaaguaauaaagggcucgcuaccgcucauaggagaagccgacugccuacacgaaaaauacggcggccuuaauaaaucgaagcccuauuacaccggagaacacgccaaggccauaggaaacugcccaaucugggucaaaaccccacucaaacuugcuaacggaacuaaauacagaccacccgccaaacuccuaaaagaaagaggcuucuucggcgcaaucgcaggcuuccucgaaggaggaugggagggcaugauagccggcuggcacggcuacaccagccacggagcacacggcgucgcagucgccgcugaccucaaauccacccaagaagccauaaacaaaaucaccaaaaaccuaaacucucuuuccgaacucgaagucaaaaaccuacaacgccugucaggagccauggacgaacugcacaacgaaauccuagagcucgacgaaaagguagacgaccuacgcgccgacacaauaucaucacaaaucgaauuagcaguccuucuaucaaacgaaggaaucaucaacagcgaggacgaacaccuccucgcccucgaacgcaaacuaaagaaaaugcugggacccucagcaguagacaucggaaacggaugcuucgaaaccaaacacaaaugcaaccaaaccugccuagacaggaucgcagcaggaaccuucaacgcaggcgaguucucccuccccaccuucgacucgcuaaacaucaccgcagcgagccucaacgacgacgggcucgacaaucacaccauccuccuauacuacuccacagccgcauccucgcuagccguaacacucaugaucgccaucuucaucguuuacauggucucgcgcgauaacguguuccuacuccaucucuccauccgaaaa

SEQ ID NO: 58994 - RNA, 1731 nt, Artificial Sequence
  derived and/or modified sequence opt11 from anti-influenza_Chain
auggaaacaauuucccucauaaccauccuccuagucguaacagcuagcaacgccgacaaaauaugcaucggccaccaaucgacaaauagcacagaaaccguagacacacugaccgaaacaaacgucccaguaacacacgccaaagaacuccugcacaccgaacacaacggaaugcucugcgcgaccucccucgggcacccucucauacucgauaccugcaccaucgaaggacuggucuacggaaacccuucaugcgaccuccuccuaggaggccgagaguggucauacauagucgaacguucaucagcagucaacggaacaugcuaccccggcaacgucgaaaaccuugaagaacuacgcacccucuucagcucagccucaagcuaccaacgcauacaaaucuucccagacacaacguggaacguaacauacacaggcaccuccagggccugcagcgggagcuuuuacagguccaugcgcuggcuaacacaaaaauccggauucuaucccguacaagacgcacaauacacaaacaaccgcggcaaauccauccuauucguguggggaauacaccacccucccacguacaccgaacaaaccaaccucuacaucagaaacgacaccacaaccuccguaacaaccgaagaccuuaacagaaccuucaaacccguaaucggcccucgaccccucgucaauggccuccaaggacgcaucgacuacuacuggucaguacuaaaacccggccaaacccuccgcguccgcucaaacggaaaccugaucgcaccaugguacgggcacgugcucuccggcggcagccacggccgcauacucaagaccgaccuaaaaggcggcaacugcguaguacaaugccaaacagagaaaggcggccuaaacuccacccuccccuuccacaauaucucaaaauacgccuucggcacgugcccaaaauacguccgcgucaacagccucaaacucgcagugggccugcggaacguuccagcacggagcucccgcggccucuucggagccauagcaggcuucaucgagggaggauggcccggccuaguagccggcugguacggcuuccagcacuccaacgaccaaggcgucggaauggcggccgacagagacagcacccaaaaagccaucgacaagaucaccuccaaagucaacaacaucgucgacaaaaugaacaagcaauacgaaaucaucgaccacgaguucagcgaaguagaaacccgacucaacaugauaaacaauaagaucgacgaccaaauccaggacguaugggccuacaacgccgaacuccuagugcuccucgaaaaccagaaaacccucgacgaacacgacgccaacgugaacaaucuauacaacaaagucaaacgcgcccucggcagcaacgccauggaagacggcaaaggcugcuucgagcucuaccacaaaugcgacgaccaaugcauggaaacuauccgaaacggaacauacaaccgacgcaaauaccgagaagaaagccgccuagaacgacagaaaaucgaaggagucaagcuggaauccgaaggcacauacaagagcgggcgacugguacccagaggaagccccggaucaggcuacauacccgaagcgccccgcgacggccaagcauacgugagaaaagacggggaauggguacuacucucaacauuccucggaaaaccuauccccaacccacuccucggacuggacucaacaggg

SEQ ID NO: 58995 - RNA, 1731 nt, Artificial Sequence
  derived and/or modified sequence opt11 from anti-influenza_Chain
auggagacgaucagccucaucaccauccuacugguagucaccgcuuccaacgcagacaaaauaugcaucggacaccaauccaccaacagcaccgaaaccgucgacacacucacagaaacaaacguaccagucacccacgcaaaagaacuccuccauacagaacacaacggcaugcucugcgccacaagccuaggccacccccucauacucgauaccugcaccaucgaaggccucguauacggcaaccccaguugcgaccuccuccucggaggccgcgagugguccuacaucgucgaacgaucaagcgccgucaacggaacaugcuaccccggcaacguagaaaaccuagaagaacuacgcacccucuucucgucggccuccagcuaccaaagaauacaaauauuccccgacacaaccuggaacgucaccuacaccggcaccucacgagcgugcagcggcagcuucuacagaagcaugcgcuggcuaacccagaaaagcggcuucuacccaguccaagacgcccaauacacaaacaaccgcggcaaaucuauacuauucguauggggcauccaccacccgccaaccuacacagaacaaacaaaccucuacauccgcaacgacacaaccaccucagucaccaccgaagaccuaaaccgcaccuuuaagccaguaauaggcccgcgcccccuagucaacggccuacaagggcgcaucgacuacuacuggucuguccucaaaccgggccaaacacuccgaguacguuccaacggcaaccuaaucgcaccuugguacggccauguacucagcgguggaucccacggcagaauccucaagaccgaccucaaaggcggcaacugcgucguacaaugccaaaccgaaaagggaggacuaaacuccacccuccccuuucacaacaucucaaaauaugccuucggcacaugccccaaguacguccgagucaauagccucaaacuagccgugggccuaagaaacguccccgcccgcagcucccgcggacuauucggcgcaauagcaggcuucaucgagggaggauggccaggccuaguagccggaugguacggauuccaacacucaaacgaccaaggagucggcauggccgccgaccgcgacuccacccaaaaagccaucgacaaaaucaccuccaaagucaacaacaucgucgacaaaaugaacaaacaauacgaaauaaucgaccacgaguucucagaagucgaaacacgccucaacaugauaaauaacaaaaucgacgaccaaauacaggacguaugggcguacaacgccgaacuacucguccuacucgaaaaccagaaaacccuagacgaacacgacgccaacguaaacaaccuauacaacaaaguaaaacgcgcccuaggaucaaacgccauggaagacggcaagggaugcuucgaacucuaccacaaaugcgacgaccaaugcauggaaaccauccgaaacggaaccuacaaccgccggaaauacagagaagaaucccggcuagagcgucagaaaauagaaggcguaaaacuugaaagcgaaggaacauacaaaagcggacgucuugucccacgcggcucccccggauccggcuacauaccugaagcaccgagagacggccaagcauacguccgcaaggacggagaauggguccuacucucaacguuccuggggaaaccaaucccaaacccccuccucggauuagacagcacagga

SEQ ID NO: 58996 - RNA, 1752 nt, Artificial Sequence
  derived and/or modified sequence opt11 from anti-influenza_Chain
augaaagcaauaaucguccuccuaaugguggucaccuccaacgcagaccgcauuugcacgggcauaaccuccagcaacagcccgcacgucguaaaaacagcgacucaaggcgaagucaacguaaccggcgugaucccacucacuaccacgcccaccaaaucacauuuugccaaucucaaaggcacccaaacaagaggcaaauuaugcccaaacugcuucaacugcaccgaccuagacguagcccugggucgaccaaaaugcaugggcaacaccccaagcgcaaaagugaguauccuccacgaagugaaacccgcaaccuccggcugcuuccccaucaugcacgacaggaccaaaaucagacaacuccccaaccuccuacgaggcuacgaaaacauccgccuaagcacgagcaauguaauaaacaccgagacagcgcccggcggaccauauaaagugggaacuuccgguagcugccccaacguagcaaacggcaacggauuuuucaacaccauggcauggguaaucccgaaagacaacaacaaaacagccaucaacccagucacaguggagguccccuacauaugcagcgaaggagaagaccaaauuacuguguggggguuccacagcgacgacaaaacucaaauggaacgcuuauacggggacucgaacccgcaaaaguucaccuccucggccaauggcgugacuacccacuacgucucccaaaucggaggauuccccaaccaaaccgaagacgaaggccucaaacaaagcgggagaauagucguagacuacauggugcaaaagcccggaaaaacaggcacgaucguauaccaacgcggaauccuacucccccaaaaagucuggugcgcauccggccgcucaaaaguaaucaaaggcucccucccacucauaggcgaagccgauugccuccaugagaaauacggcggacucaacaagucaaaaccauacuacaccggagaacaugccaaggcaauaggcaacugccccaucugggucaagaccccgcucaaacucgcaaacggaaccaaauacagacccccagccaaacuccuaaaagaacguggauucuucggagcaauagcaggcuuucucgaaggcggcugggaaggcaugauagcgggcuggcacggguacaccagccacggcgcccacggcgucgcagucgcggccgaccucaaaagcacacaagaagccaucaacaaaaucacuaaaaaucuaaacuaccucucagagcuugaagucaaaaaccuccagagacucucaggcgccaugaacgaacuacacgacgaaauacuugagcuagacgaaaaaguagacgaccuacgcgccgacaccaucucaagccaaaucgaacucgcaguacugcuauccaacgaaggaauaaucaacagugaagacgagcaccuccuagcacucgagcgaaagcuaaagaaaaugcuaggacccucugcagucgaaaucggcaacggcugcuucgagaccaaacacaaaugcaaccaaacaugcuuagaccgaaucgccgcuggaaccuucaacgcuggcgacuucucacuaccaaccuucgacucccuaaacaucaccgcagccagccucaacgacgauggccucgacaaccacaccauccuccuauacuacagcacagccgccucaucgcucgcggucacacucaugauagcaaucuuuauagucuacaugguaucaagagauaacguguccugcuccauaugucuc

SEQ ID NO: 58997 - RNA, 1752 nt, Artificial Sequence
  derived and/or modified sequence opt11 from anti-influenza_Chain
augaaagccaucaucgugcuccucauggucgucaccagcaacgccgaccguauaugcacaggcauaaccucaagcaacucaccgcacgucgucaaaaccgccacucagggagaagucaacguaacaggcguaauaccccucacaaccacccccacaaaaucauacuucgccaaccuaaaaggaaccaaaacuagaggaaaauuaugcccugacugccucaacugcacagaccucgauguagcucugggcagacccaugugcgugggaacaaccccaagcgcaaaagccagcauacuacaugaaguccgaccaguaaccagcggaugcuuccccauaaugcaugaccgaacaaaaauaagacaacuagcaaaccuacuccgcggauacgaaaacaucagacucagcacacaaaacgucaucgacgccgaaaaggcccccggaggacccuaccgccuaggcacgagcggcuccugccccaacgccacguccaaaagcggauucuuugccacaauggcaugggcaguuccgaaagacaacaacaaaaacgccacaaacccacucacagucgaaguacccuacaucugcacggaaggggaagaccaaauaaccguauggggauuccacuccgacgacaagacccaaaugaaaaaccuauacggagacucaaacccacaaaaauucaccagcuccgccaauggcguaaccacacacuaugucagccaaaucggaggauuccccgaccagaccgaggauggcggccugccccaaagcggacgcauagucguggacuacaugaugcaaaaaccuggaaaaacgggcacaaucguauaccaacgcgggguccugcuaccgcaaaaagucuggugcgcaucagggcguuccaaagugaucaaaggcucacucccgcucaucggcgaggcagacugccuacacgagaaauacggcgggcucaacaaauccaaaccguacuauacaggagaacacgcaaaagccauaggcaacugcccgaucuggguaaagacaccgcucaagcuggcgaaugguaccaaguacaggcccccagccaagcuacucaaagaacgcggauucuucggcgcgaucgccggcuuccucgaaggugggugggaaggaaugaucgccggcuggcacggcuacacaucccacggcgcccacggcguagccgucgccgccgaccucaaaaguacacaagaagccaucaauaaaaucaccaaaaaccuuaacucccugagcgaacucgaagucaaaaaccuacaacgcuuaucaggcgccauggacgaacuccacaacgaaauccucgaacuagacgaaaagguagacgaccuacgcgcagacaccaucucgagccaaauagaacucgcuguacuccuaucgaacgaaggaauaaucaacuccgaagacgaacaccuacucgcacuagaacgcaagcucaagaaaaugcuaggccccucagccguugacaucggcaacggcugcuucgaaaccaaacacaaaugcaaccaaacgugccuggacaggaucgcagccggcaccuucaacgcaggcgaguucucgcucccgacauucgacucacucaacaucaccgccgcaagccugaacgaugauggccuagauaaccacaccauucuccucuacuacucuacggcagccagcucacucgccguaacgcuaaugcucgccaucuucauagucuacauggucucgcgagacaacguauccugcuccauaugccug

SEQ ID NO: 58998 - RNA, 1752 nt, Artificial Sequence
  derived and/or modified sequence opt11 from anti-influenza_Chain
augaaagcaauaaucguccuccucauggucgucaccucaaacgccgacagaauuugcacggggauaacuucguccaacaguccccacgucguaaaaacagccacccaaggcgaagucaacguaaccggugucauuccccucacaaccacccccaccaaaucuuacuucgccaaccuuaaaggcacacgcacccgaggcaaacugugcccggacugccucaacugcacggacuuagacgucgcucucggaaggcccaugugcgucggcacgacacccagcgccaaagcuagcauccuucacgaagucaaaccaguaacaagcggaugcuuccccaucaugcacgaccggacgaagauccgccaacuucccaaccuccuccgcggguacgaaaacauccgccucuccacacaaaacgucaucgacgccgaaaaggccccgggaggacccuaccgccuuggcaccucaggcucaugucccaacgcuacauccaaaagcggauucuucgccaccauggcaugggccguccccaaagacaacaacaagaacgccacaaacccccuaaccguugaagucccauacauaugcacagaaggagaagaccaaauaacagucuggggauuccacagcgacgacaagacacaaaugaaaaaccucuacggagacuccaacccccaaaaguucaccuccucagccaacggcguaacaacacacuacguaucacaaaucggaucauuccccgaccaaaccgaagacggcggccuaccccaaagcggccgcaucgucgucgacuacaugaugcaaaagcccggaaaaacgggcacaaucgucuaccaacgcggcguacuccucccccaaaaggucuggugcgccuccggccgcuccaaagucaucaaaggcucgcugccacuaauaggugaagccgacugccuacacgaaaaauauggcggccucaacaaauccaaaccauacuacacaggcgaacacgcaaaagccaucggcaacugcccaaucuggguaaaaacaccacuaaaacucgccaacggcacaaaauaccgaccgcccgcaaagcuacuaaaagaacgcggguucuucggcgcgaucgccggcuuccucgaaggcgggugggaaggcaugaucgccggcuggcacggcuacaccagccacggugcacacggcguagcggucgcagccgaccucaagucaacccaagaagcaaucaauaaaaucaccaaaaaccugaauagccucagcgaacucgaagucaaaaaccuacaacgucucuccggcgccauggacgaacuacacaacgaaauccuagaacucgaugagaaaguagacgaucuacgagccgacacaauaucaucccaaaucgagcuagcaguacuccucucgaacgaaggcauaaucaacagcgaagaugaacaccuccuagcacucgagcgcaaacucaagaaaaugcucggccccucugcagucgagaucggaaacggcugcuucgagaccaaacacaaauguaaccaaaccugccuagaccgcauagccgccggcaccuucaacgcgggcgaguucucacuacccacauucgacucucuaaacaucaccgcagccucccucaacgacgacggccucgacaaccacaccauacuccucuacuacuccaccgccgccuccagccuagccgucacacuuaugcuagcgaucuucaucgucuacauggucucaagagacaauguaucaugcuccaucugccuc

SEQ ID NO: 58999 - RNA, 1752 nt, Artificial Sequence
  derived and/or modified sequence opt11 from anti-influenza_Chain
augaaagcuaucaucgugcuacucaugguggucaccagcaacgcagaucggauaugcacaggcauaacaagcagcaacucgccccacguagucaaaacagcaacccaaggagaagucaacgucacaggcgucaucccacucacgaccacgcccacaaaaucccacuucgccaaucuaaaaggcacccaaacgcgaggaaaacucugcccaaacuguuucaacugcacagaccuggacguagcccuuggccgccccaaaugcaugggaaacaccccaagcgcaaaaguaagcauacuccacgaaguaaaacccgcaacaagcgggugcuucccaauaaugcacgacaggaccaaaauaaggcaacuacccaaucuccuacgcggcuacgaaaacauacgccuauccaccuccaacgucauaaacacagaaacagccccaggcggacccuacaaagucggcacgagcgggagcugcccaaacgucgccaacgggaacggauucuuuaacacaauggcgugggugaucccgaaagacaacaacaaaacagccauaaacccggucaccguagaaguccccuacaucugcucagaaggagaagaucaaaucacaguguggggcuuccacagcgacgacaaaacccagauggaacgacuauacggcgacucgaacccccaaaaauucaccagcagcgcaaacggcguaaccacgcacuacgugucgcaaauaggcggauucccaaaucaaaccgaagacgagggccucaaacagagcggccgcauagucguagauuacaugguacaaaaacccggcaaaacaggcacaaucgucuaccaacgcgggauucuccucccccaaaaagucuggugcgcaucaggacgaucgaaaguaaucaaaggcucacucccccucauaggcgaggccgacugccuacacgaaaaauacggaggacuuaacaaauccaaaccguacuacaccggggaacacgccaaagcaaucggcaacugccccauaugggucaaaacaccgcucaaacuugcaaauggcaccaaauaccgcccaccggccaaacuucugaaagaacgaggcuuuuucggcgcaaucgcaggcuuccucgaagguggcugggagggaaugaucgcgggcuggcacggauacacgucccauggcgcacauggaguagcagucgcggccgaccucaagagcacacaagaagccauaaacaaaaucaccaaaaaccuuaacuaccucagcgaacucgaagucaaaaaccuccaaaggcucucaggagcgaugaacgaacugcacgacgaaauacucgaacucgacgaaaaaguugacgaccuaagagccgacacaauaucaagccaaaucgagcucgcugucuuacuauccaacgaaggcauaaucaacucagaagacgagcaucugcuagcgcucgaacgcaagcucaagaaaaugcucggaccauccgcaguagaaauaggcaacggaugcuucgaaacaaaacacaaaugcaaucaaaccugccuugacaggaucgcagccggaaccuucaacgccggagacuucucacuacccaccuucgacucacuuaacauaaccgccgccagccucaacgacgacgggcucgacaaccacacuauucuccuauacuacucaacagccgcuagcucacucgcggucacacugaugaucgccaucuucaucgucuacauggucucuagagacaacgugagcuguagcaucugccuc

SEQ ID NO: 59000 - RNA, 1752 nt, Artificial Sequence
  derived and/or modified sequence opt11 from anti-influenza_Chain
augaaggcaauaaucguguuacugaugguagucacaagcaaugcagaccgcauaugcaccggcauaacauccucaaauagcccgcacgucguaaaaaccgcaacacaaggcgaaguaaacguaaccggcgucaucccccuaacgaccaccccaaccaaaucauacuucgccaaccucaaaggcacaaaaacacgcggcaagcuaugccccgacugccucaacugcacagaccucgacguagcccugggccggccaaugugcgugggcacaaccccaagcgcgaaggcuuccauacuccacgaaguacgaccagucacauccgggugcuuccccauaaugcacgaccgcaccaaaauaagacaacucgccaaucucuuacgcggcuacgaaaacauacgacuuagcacucaaaacgucaucgacgcggaaaaggcacccggcggacccuaucgguuaggcaccagcggcucaugccccaaugcaaccagcaaguccgguuucuucgccacaauggcaugggccguacccaaagacaacaacaaaaacgccacgaacccacucaccguagaaguccccuacauaugcacagaaggggaagaccaaauaacaguauggggauuccauagcgacgacaaaacacagaugaagaaccuguacggagacucaaacccccaaaaguucacaagcucagccaacggcgugaccacccacuacgucucacagauaggaggauucccagaccaaaccgaagacgggggccucccacaauccggacgcaucguaguagacuacaugaugcaaaaaccaggaaaaacaggcacaaucgucuaccagcgcggaguccugcucccacaaaaaguauggugcgccagcggccgaucgaaagucaucaaaggcucgcuaccacuaauaggagaagcagacugccuacacgaaaaauacggcggucucaacaaauccaaaccauacuacaccggagaacacgccaaagccauaggcaacugcccgauaugggucaaaacaccacucaaacucgccaacggaaccaaauacagacccccagcaaaacuacuaaaagaacgcggguucuucggagcgaucgccggcuuccuugagggcggaugggaaggcaugauugcaggcuggcacggguacaccucccacggcgcccauggcgucgcagucgcagcugaccuaaaauccacgcaagaggccaucaacaaaauuaccaaaaaccuuaacucccuaucagaacuagaagucaaaaaccuccaaagacucagcggcgcgauggacgaacuacacaacgaaauccucgagcucgaugaaaagguagacgaccuacgugcggacacaaucucaucccagauagagcucgccguacuacuauccaacgaaggcaucauuaauagcgaagacgaacaucugcucgcccucgaacgaaaacucaagaaaaugcucggacccuccgccguggacaucggcaacggcugcuucgaaacaaagcacaaauguaaccaaacaugccuagaccgcaucgccgccggaaccuucaaugccggugaguucucacucccgacauucgacucacucaacauaaccgcagccucacuaaacgacgacggccucgauaaccacaccauccuacuguacuauagcacagccgcaucaucccucgcagucacgcuuaugcucgcaaucuuuauaguauacauggucucacgcgacaacguaagcugcaguaucugccua

SEQ ID NO: 59001 - RNA, 1752 nt, Artificial Sequence
  derived and/or modified sequence opt11 from anti-influenza_Chain
augaaggccaucauuguccuccucaugguagucacauccaacgcagaccgcauaugcacaggcaucaccucuuccaacuccccacacguggucaaaaccgcaacccaaggagaagucaacgucacaggcguaaucccccucacgaccacacccacgaaauccuacuucgccaaccucaaagguacacgcacacgcggaaagcucugcccagacugccuaaacugcacggaccucgacguggcccucgguagacccaugugcgugggaaccacacccuccgccaaagccagcauacuccacgaagucaaacccguaacauccggcugcuuccccauaaugcacgaccgaaccaaaauaagacaacugcccaaccuacucagaggauacgaaaacauccgccuaagcacacaaaauguaauagaugccgaaaaagcccccggcggccccuaccgccugggaacuagcggaucuugucccaacgccacaagcaaaagcggguucuucgccacaauggcaugggcaguccccaaagacaacaacaaaaacgcaacgaacccacuaacaguagaggucccauacaucugcacagaaggggaagaccaaaucaccguauggggcuuccacucagacgacaagacucaaaugaagaaccuguacggagacucaaacccacaaaaauucacauccuccgccaacggaguaaccacccacuacguaucccaaauaggaucauucccggaccagaccgaagacggaggucucccccaaucaggcagaauagucguagacuacaugaugcaaaagcccggaaaaaccgguacaaucguauaccagcguggaguccuauuaccacaaaaagucuggugcgccagcggaagauccaagguaaucaaaggcucacucccgcugauaggcgaagccgacugccuacacgagaaauacggcggccucaauaaaucaaaacccuacuacacaggagaacacgcaaaggccauaggcaacugccccaucugggucaaaacuccucuaaaacucgccaacggcacaaaauacaggcccccagccaaacuacuaaaagaacgcggauucuucggcgcaaucgcaggcuuccucgaaggaggcugggagggaaugaucgccggguggcacggcuauacaagccauggagcccacggagucgccgucgccgccgaccuaaaauccacacaagaagccauaaacaaaaucaccaaaaaccucaacucacuaagcgagcuggaggucaaaaaccuacaacgacucuccggagcaauggacgaacuacacaaugaaauccuugaacucgacgaaaaagucgacgaccuucgagccgacaccaucuccucacaaaucgaacuagcaguauuacucuccaacgagggcaucaucaacagcgaagacgaacaccuucucgcacucgaacgcaaacuaaagaaaaugcucggaccaucagcaguagaaaucggcaacggcugcuucgaaaccaagcacaaaugcaaucaaaccugccuagaccgcaucgcggccgggacauucaacgcaggcgaauuuucgcucccaacauucgacucgcucaacauaacagccgcuucuuuaaacgacgacggucucgacaaccacaccauacuacuguacuacagcacggccgccagcucccucgccgucacgcucaugcucgcgaucuucaucgucuacauggucucccgcgacaacguaagcugcagcauaugccua

SEQ ID NO: 59002 - RNA, 1758 nt, Artificial Sequence
  derived and/or modified sequence opt11 from anti-influenza_Chain
augaaagcaauaaucguacuacucauggucguaacaucaaaugcagaccgcauaauaugcaccggaaucacaagcucgaacaguccccacgucguaaaaacagccacccaaggcgaagucaacguaacagggguaaucccgcucacaaccacaccaacaaaaagccacuucgcaaaccuaaaaggaaccgaaacccguggaaaacuauguccaaaaugcuuaaacugcaccgaccucgaugucgcacucggccgcccaaaaugcacaggcaacaucccauccgcacgcgucagcauccuccacgaaguccggcccgucaccucaggcugcuuucccaucaugcacgaccguaccaaaauccgccaacuccccaaccuacuacgcggauaugaacacauucgccuuucaacucacaacgucaucaacgcagaaaacgcccccggaggaccauacaaaauaggcaccuccgggucgugcccaaacgucacaaacggaaacggauucuucgccaccauggcgugggccgugcccaaaaacgacaacaacaaaacagccaccaacucccucaccauagaaguacccuacaucugcacagaaggcgaagaccaaauaacagucuggggcuuccacagcgacaaugaaacacagauggcaaagcucuacggcgacuccaaaccccaaaaguucaccagcucagccaacggcgucacaacccacuacguaucccaaaucggcggcuucccaaaccaaaccgaagacggcggucugccacaauccggccggauaguaguagauuauaugguacaaaaauccggcaaaacaggcacaaucaccuaccaacgaggcauccuccuaccccaaaaagucuggugcgccucagggagaagcaaagucaucaaaggcucacucccucuaauaggcgaggccgacugccuccacgaaaaauacggcggacucaacaaaagcaaaccauacuacaccggcgaacacgccaaagcaauaggcaacuguccaaucugggucaaaacaccccucaaacucgcaaacgggaccaaauaccgacccccagcuaaacuccuaaaagaacguggauuuuucggcgccauagccggcuuccucgaaggcggaugggaaggcaugaucgcgggcuggcacggguacacaucccauggagcgcacggugucgcggucgccgcagaccucaaaagcacccaagaagcaaucaacaaaaucaccaaaaaccucaacucccuauccgaacucgaagucaaaaaccuccagagacucagcggcgcgauggacgaacuacauaacgaaauacucgaacuugacgagaaaguagacgaccuacgcgccgacacaaucucaucccaaaucgaacucgccguccuccuaucuaacgaaggcaucaucaacucugaagacgaacaccuccuagcccucgaacgcaaacuaaagaaaaugcucggccccagcgccgucgaaaucggcaauggcugcuucgaaaccaaacacaaaugcaaucaaaccugccucgaccgaauagcagccgggaccuucgacgccggcgaguucucccuaccaacauucgacucacucaacauaaccgccgccucacuaaacgacgacggacuugacaaccacaccauccuccucuacuauucaacugcagccuccucacuagccgucacccuaaugaucgccaucuuuguaguauacauggucucacgcgacaacgugagcugcagcauaugcuua

SEQ ID NO: 59003 - RNA, 1758 nt, Artificial Sequence
  derived and/or modified sequence opt11 from anti-influenza_Chain
augaaagcaauaaucguccuccuaaugguagucacaagcaacgcggacagaaucauaugcacaggcaucacaagcuccaacuccccacacgucguaaaaaccgcaacccaaggcgaagucaacgucaccggagucaucccccuaaccacgaccccaaccaaaucccacuucgccaacuugaaaggcaccgagacccgcggcaaacucugccccaaaugccucaacugcaccgaccucgauguagcccucggacgcccgaaaugcacuggaaacauacccucagcccgaguaucgauauuacacgaagucagacccgucacauccggcugcuucccaauaaugcacgaccguacaaagauccgccaacuucccaaccuacuuagaggauacgaacacauacgacuuucaacucacaacguaaucaacgcagagaacgcacccggcggcccguacaaaaucggcaccucgggaucaugccccaaugucaccaacggcaacggcuucuuugcaacaauggccugggccguaccuaaaaacgacaacaacaaaaccgccaccaacucgcucacaauugagguccccuacauaugcacagaaggcgaggaccaaaucaccgucuggggcuuccacucagacaacgaaacccaaauggcgaaacucuacggagacucaaaaccccaaaaauucacaagcucggcaaacggcguaaccacccacuacguaucccaaauaggcggauucccgaaccaaaccgaagacggaggacuaccacagagcggacgaaucguagucgacuauaugguacagaaaagcggcaagaccggaacaaucacauaccaacgaggcaucuuacucccccaaaaagucuggugcgcauccggccgcuccaaagucaucaagggcucacugccucucauaggcgaagcagauugccuacacgagaaauauggcggccucaacaaauccaaaccguacuacaccggggaacacgccaaagcaaucggcaacugccccaucuggguuaaaaccccgcuuaaguuagcaaacggaaccaaauacagacccccggccaaacuacugaaagaacgcggauucuucggagcaaucgccggcuuccucgagggcgguugggaaggcaugaucgccggcuggcacggauacacgagccacggcgcacacggcgucgcggucgcagcugaccucaagagcacccaagaagcaaucaacaagaucaccaaaaaccuuaacagccuuuccgagcuugaagucaaaaaccuccaacgcuuaucaggcgcaauggacgaacuacacaacgaaauucuagaacuagacgaaaaggucgacgaccuacgcgccgacaccauuucaucacaaaucgaacucgcaguacuccucuccaacgaaggaaucaucaacagcgaagacgaacaccuccucgcacucgaacgcaaacucaagaaaaugcucggacccuccgcaguagaaaucgguaacggcugcuucgaaaccaaacacaaaugcaaccaaacaugucucgacagaaucgcggccggcaccuucgacgccggcgaguucucacuacccaccuucgacucccucaacaucacugccgccagccuaaacgacgacggucucgacaaucacaccauacuccucuacuacucaacagccgccucaucacuagccgucacccucaugaucgccauauucgucgucuacauggucucccgcgacaacgucuccugcagcaucugccuc

SEQ ID NO: 59004 - RNA, 1749 nt, Artificial Sequence
  derived and/or modified sequence opt11 from anti-influenza_Chain
auggaagcacgcuuacucguauuauugugcgcauucgcggccacaaacgcggacaccaucuguaucggguaccacgcaaacaacucaaccgacaccgucgacaccguccuggaaaagaacguaacagucacucacagcguuaaccuacucgaagacucccacaauggcaagcucugcaaacucaaaggaaucgcgccacuccaacuaggaaaaugcaauaucgcaggauggcuccuaggcaaccccgaaugcgaccuccuucucaccgccuccuccuggagcuauaucguagaaaccagcaacuccgaaaacgguaccugcuaccccggagacuucauagacuacgaagaacuccgagaacagcucucaagcguaagcuccuucgaaaaauucgaaauauucccgaaaaccagcucauggcccaaccacgaaacgacaaagggcgugaccgcagccugcagcuacgcaggggcaagcagcuucuacaggaaccugcucuggcucaccaagaaaggcuccagcuaucccaaacucucaaaaucauacguaaacaacaaaggcaaagaaguucuaguacuauggggcguccaccacccacccacaggcacagaccaacaaagccucuaccaaaacgccgacgccuacgucucaguaggcucaucaaaauauaaccgccguuucacccccgaaauagcagccagacccaagguccgcgaccaagcaggaaggaugaacuacuacuggacacugcuagaaccaggcgacaccaucacauucgaagcgaccggcaauuuaaucgcgccaugguacgcauucgcccucaaccgcgggagcggaagcggaaucauaaccucagacgcccccguacacgacugcaacaccaagugccaaacuccacacggcgcaaucaacuccucacuccccuuccaaaacauccaccccguaacaauaggagaaugccccaaauacguaaggagcacaaaacugcgaauggccaccggccuacgcaacaucccaagcauccaaucacgcgggcuauucggcgcaaucgcaggcuucaucgaaggcggauggacuggaaugaucgacggaugguacggguaccaccaccaaaacgaacaaggcagcggguacgccgcugaccaaaaaucaacacaaaacgcuauagacgggaucacaaacaagguaaacagcguaaucgagaaaaugaacacccaauucaccgcaguagggaaagaguucaacaaccucgaacgacgcauagaaaaccuuaacaagaaagucgacgacggguuucuagacaucuggaccuacaaugccgaacuccuaguccuacucgaaaacgaacgcacacucgacuuccacgacucgaacguccgcaaccuauaugaaaaagucaaaagccaacucaaaaacaacgccaaagaaauaggcaacggcugcuuugaguucuaccacaaaugcgaugacgcgugcauggaaucagucagaaacgguaccuacgacuaccccaaauacucagaagaauccaaacuaaauagagaagaaauagacggcguuaaacuagaaagcaugggcgucuaucaauccggacgccuaguccccagaggauccccgggaucgggauauaucccagaagcaccccgcgacggacaagcauacguccgaaaagacggagaauggguccuccucuccacuuuccucggaaaaccgaucccgaacccacuccucggccuggacuccaccggg

SEQ ID NO: 59005 - RNA, 1749 nt, Artificial Sequence
  derived and/or modified sequence opt11 from anti-influenza_Chain
auggaagcccgccuacugguccuccuaugugcauucgccgcuaccaacgccgacacaaucugcauaggauaccacgccaacaacuccacagacaccgucgacaccguccucgagaaaaacgugacugucacccacuccgugaaccuguuagaagacagccauaacggaaaacuaugcaaacugaaaggaauagcgccccuacaacuaggaaaauguaacauagcgggauggcuacugggcaacccggaaugcgaccuccuacucaccgcuucaagcuggagcuacaucgucgaaacaucaaacucagaaaacggaacgugcuaccccggcgacuuuaucgacuaugaagaacuacgagaacaacuauccagcguguccucauucgaaaaguucgaaauauucccuaaaacgagcagcuggccgaaccacgaaacgaccaaaggcgucaccgcagccugcagcuacgcaggcgccucuagcuucuaccgcaaucuacuauggcucaccaagaagggcucaucauaccccaaacucucaaaauccuacguaaacaacaaaggaaaagaaguacucguccucuggggaguacaucacccacccacaggaacggaucaacaaucccucuaccaaaacgccgacgcguacguauccgucggcuccagcaaauauaaccgccgcuucacccccgaaaucgcagcacguccaaaagugcgagaccaagccggccgaaugaacuacuacuggacccuccucgagccaggagacaccauaacauucgaagcaacaggcaaccuaaucgcaccaugguacgccuucgcucuaaaccgcggaagcgggucaggaaucaucacaucugacgcacccgugcacgacuguaacaccaaaugccaaaccccacacggagccaucaacucgagccucccauuccaaaacauacaccccgucaccauaggcgaaugcccgaaauacguccgauccacgaaacuccguauggcaacaggacuaagaaacaucccuagcauccaaagccgcggccucuucggggcaaucgcaggguucaucgagggaggcuggacaggcaugaucgacggcugguacggcuaccaccaccaaaacgaacaaggcuccggguacgccgccgaccaaaagagcacccaaaacgccaucgacggcaucacgaacaaagucaacagugucaucgagaaaaugaacacccaauucaccgcagucggcaaagaguucaauaaccucgaacgccgcaucgaaaaccucaacaagaaagucgaugacggcuuccucgacauauggacauacaacgccgaacuccuaguucuacucgaaaacgaacgaacccuagacuuccacgacucaaacguccgaaaccucuacgaaaaagucaaaagccaacucaaaaacaacgcaaaagaaaucggcaacggaugcuucgaguucuaccacaaaugcgacgacgcauguauggaauccguucgcaacggaaccuacgacuacccaaaauacuccgaagaaagcaaacucaaccgcgaagaaaucgacggcgugaaacuagaaagcaugggcguauaccaaagcggccgccucgucccaagaggcagcccaggaucagguuacaucccagaagcccccagggacggccaagccuacgugcgaaaggacggagaauggguccuccuaucaacauuucuaggaaaaccaauccccaacccucuacugggccucgauucaaccggc

SEQ ID NO: 59006 - RNA, 1755 nt, Artificial Sequence
  derived and/or modified sequence opt11 from anti-influenza_Chain
auggagagaaccguccuacuccucgccacgguaucccucgucaaaucagaccaaaucugcaucggcuaccacgcgaacaacucuacagaacaagucgacacaauuauggagaaaaacguaaccgucacccacgcccaagacauucucgaacgaacccacaacggcaaacucugcgaccucaacggagucaaacccuuaauccuccgcgacugcuccgucgccggcuggcuccucggaaaccccaugugcgacgaguucaucaacguccccgaauggaguuauauagucgaaaaagcaagccccgcaaacgaccucugcuaccccggcaauuucaacgacuacgaagaacuaaaacaccuccucagcaggaucaaccacuucgagaaaauacaaauaaucccaaaaucaucauggagcaaccacgacgcgagcucaggagucucaagcgcaugucccuaccuaggcagaucauccuuuuuccgcaacgucgucuggcucaucaagaaaaacagcgccuaccccaccaucaaacgauccuacaacaacaccaaccaagaagaccugcuaguccucuggggcgugcaccacccaaacgacgccgcagaacaaacuaaacucuaccagaacccaacgacauauaucucagucggcaccagcacacucaaccaacgccucguccccgaaauagccacccgacccaaagucaacggccaaagcggcagaauggaauuuuucuggaccauacucaaaccaaacgaugcgaucaacuucgaauccaacgguaacuucaucgccccagaauacgccuacaaaauagucaagaaaggugacucaaccaucaugaaauccgaacucgaauacggcaacugcaacaccaaaugccagacccccaugggcgccauuaacucuuccaugccauuccacaacauacacccccucaccauaggcgaaugccccaaauacguaaaaagcaaccgacuuguccuagccaccggccucagaaacaccccucaacgcgaacgccgccgcaagaaacgcggccuuuucggagcaauagccggauucaucgaagggggauggcaaggaaugguagacggcugguacggauaccaccacuccaacgaacaaggcucaugcuacuccgcagacaaagaauccacucaaaaagcaaucgacggugugaccaacaaagucaauuccaucauaaacaaaaugaacacacaauuugaagccgugggcagagaguucaacaaccuagaaagacgaaucgaaaaccucaacaagaaaauggaagacggcuuccuugacgucuggaccuacaacgccgaacugcuaguccucauggaaaacgaacgcacacuagacuuccacgacuccaacgucaaaaaccucuacgacaaaguccgccuccaacugagagacaacgcaaaagaacucggaaauggcugcuuugaguucuaccacaaaugcgacaaugaauguauggaaagcgucaaaaacggcacuuacgacuacccccaauacuccgaagaagccaggcuuaaccgcgaagaaauaaguggagucaaacucgaauccaugggcacguaccaauccggccgccucguaccccggggcucacccggcucgggauacauccccgaagcaccacgcgacggccaagccuacguccgcaaagacggcgaauggguacuacucucgacguuccuaggaaaacccauccccaacccccucuuaggacucgacuccaccggc

SEQ ID NO: 59007 - RNA, 1755 nt, Artificial Sequence
  derived and/or modified sequence opt11 from anti-influenza_Chain
auggaacgcacggugcuccuccuagcgaccguauccuuaguaaaauccgaccaaaucugcauaggauaucacgccaacaacucaacagaacaggucgauaccauaauggaaaaaaacgucaccgucacacacgcccaagacauccuggaaagaacccacaauggaaaacucugcgaccucaacggggucaaaccacucauccuccgugacuguagcgucgccggcuggcuacucggcaaccccaugugcgacgaauucauaaacguccccgaaugguccuacauaguagaaaaagccucgcccgccaacgaccucugcuacccugggaacuucaacgacuacgaagaacugaagcaccuccucuccagaaucaaccacuucgaaaaaauccaaaucauaccaaaauccuccugguccaaccacgacgcauccagcggagucagcuccgccugccccuaccucggaagaagcucauucuuccgaaaugucguaugguuaauaaaaaaaaacuccgccuaccccacaaucaaacgcagcuacaacaacaccaaccaagaagaccuacucguccucuggggcguacaccaccccaacgacgcagccgaacaaacaaaacuauaccaaaacccaaccaccuacaucucaguaggcaccucaacucucaaccaaagacuuguccccgaaaucgccacccgccccaaaguaaacggccaaucuggccgcauggaauucuucuggaccauccucaaacccaacgaugccaucaacuucgaguccaacggaaacuucauagcucccgaauacgccuacaagauaguaaaaaaaggcgacuccacaaucaugaaauccgaauuggaauacggcaacugcaacacaaaaugccaaaccccgaugggagccaucaacagcuccaugccauuccauaacauacacccccuaaccauaggcgaaugccccaaauacgucaagagcaaccgccucgugcuggccaccggucuccgaaacaccccccaacgcgaacgccgcagaaaaaaacgcggacuguucggagccaucgccgguuucaucgaaggcggauggcagggaauggucgacggaugguacggcuaccaccacucuaacgaacaaggcuccugcuacuccgccgacaaagagucaacacaaaaagccauugacggaguaaccaacaaagucaacuccaucaucaacaaaaugaauacucaauuugaagcaguaggacgugaauucaacaaccuagaacgcagaaucgaaaaccucaacaaaaaaauggaagacggcuuccuagacguauggacauacaacgcagaacuacucguccugauggaaaacgaacguacacucgacuuccacgacuccaacgucaaaaaucucuacgacaaaguccgacuacagcuacgcgacaacgcuaaagaacuaggcaauggcugcuucgaauucuaccacaaaugugacaacgaaugcauggaauccgucaaaaauggcaccuacgacuacccccaauacucugaagaagcuagacucaacagagaagaaaucuccggcguaaaacucgaauccaugggcacauaccaaagcggccgacuaguuccccgcggcagccccggcagcggauacauccccgaagcaccaagagacggacaagccuacguccgcaaagacggcgaauggguacuacucagcaccuuccucggaaaaccaauccccaacccacuacucggauuagacuccacagga

SEQ ID NO: 59008 - RNA, 1947 nt, Artificial Sequence
  derived and/or modified sequence opt11 from anti-influenza_Chain
augggcgacaaaaucaacuucaucuucggcauacacaaucaccagccccucggcaacuucggcugggucuucgaagaagcauacgagaaaugcuacuggcccuuccuagaaacccucgaagaauauccaaacaugaaagucgcaauccacaccuccggaccccugaucgaguggcuacaagacaaccgacccgaguacaucgaccuccuacguagccucguaaaacgcggccaagucgaaauagucgucgccggcuucuacgaaccaguccuagcgucaaucccgaaagaggaccggaucgaacaaauccgacugaugaaagaaugggccaaaagcauagguuucgacgcgcgaggagucuggcuuacagaacgcguuuggcaaccagagcuagucaaaacccuaaaagaauccggaauagacuacgucaucgucgacgacuaccacuucaugucagccggacuaaguaaagaagaacuauacuggcccuacuacaccgaagacggaggagaagugaucgccgucuucccaauagacgaaaaacuccgauaccuaauccccuucaggccaguagacaaaguccucgaauaccuacacucacucaucgacggagacgaaagcaaaguagccguuuuucacgacgacggagaaaaauucgggaucuggcccggcacauacgaaugggucuacgaaaaaggcuggcuacgagaguucuucgacaggauaucguccgacgaaaagaucaaccugaugcucuacacagaauaccuggaaaaauacaaaccccgcgggcuagucuaccucccaaucgcaagcuacuucgaaaugagcgaauggagccuccccgccaaacaagcccgacuauucgucgaguucgucaacgaacucaaaguaaaaggcaucuucgaaaaauaccgcguguucgugcgcgggggcauauggaagaacuucuucuacaaauaccccgaaagcaacuacaugcacaaacgcaugcugauggucuccaagcuaguccgcaacaaccccgaagcacgcaaauaccuacuccgagcacaguguaacgacgccuacuggcacggacucuucggcggcguauaccucccccaccuacgacgagccaucuggaacaaucucaucaaagcgaacuccuacgucucgcuaggcaaaguaauccgcgacauagacuacgacggauucgaagaaguccuuaucgagaacgacaacuucuacgcggucuucaaaccaagcuacggaggcagccuaguagaguucagcagcaagaaccgccuaguaaacuacgucgacguccucgcacgacgcugggagcacuaccacggcuacguggagucccaauucgacggaguggccucaauacacgaacucgagaaaaagauccccgacgaaauacgcaaggaaguagcauacgacaaauaccgacgcuucaugcuccaagaccacgucguaccgcucggaaccacacuagaagacuucauguucagucgucaacaagaaaucggagaguucccacguguacccuacagcuacgaacuccucgacggcggcauccgccugaaacgcgaacaccuaggaaucgaaguagaaaagacagucaaacucgucaacgacggauucgaaguagaauacauaguaaacaacaagaccgggaaccccgucuuauucgcaguagagcugaacguagccguccaguccauaauggagagccccggcgugcuccgcggcaaggaaauagucguagacgacaaauacgcggucggaaaauucgcacuaaaauucgaggacgaaauggagguauggaaauaccccgucaagacccucucgcaaucagaaagcggcugggaccugauccagcaaggcgucuccuauauagucccaauaagacuagaagacaagauccgcuucaaacugaaguucgaagaagccagcggg

SEQ ID NO: 59009 - RNA, 1947 nt, Artificial Sequence
  derived and/or modified sequence opt11 from anti-influenza_Chain
augucccgcaugacccugaaaagcuccaugaaaaagcgggugcuaucccuccuaaucgcagucgucuuccucucguuaaccggcguauucccgucaggacucaucgaaacaaaggucuccgccgccaaaaucacagaaaacuaccaauucgacucacgcauccgccugaacagcauaggcuucauccccaaccacucaaagaaagccaccaucgccgcuaacugcuccaccuuuuacguaguaaaagaagacggaacaaucgucuacacaggaaccgcaacaucaauguucgacaacgacacgaaagaaaccgucuacauagccgacuucuccuccgucaacgaagaaggcacauacuaccucgcaguacccggagucggaaaauccguuaacuucaaaaucgccaugaacguauacgaagacgcauucaaaacugccaugcuagggauguacuuacuacgauguggcacauccgucucugccaccuacaacggcauccacuacucccacggcccgugccacaccaacgacgccuaccucgacuacauaaacggccagcauaccaaaaaggacucaacaaaaggcuggcacgacgccggcgacuacaacaaauacgucgucaacgcggggaucaccgucggauccauguuccuagcaugggaacacuucaaagaccaacuugaaccagucgcccucgaaauccccgagaaaaacaacuccauccccgacuuccucgacgaacuaaaauacgaaaucgacuggauccucaccaugcaauaccccgacggcucgggccgggucgcucacaaagucuccacccgcaacuucggcggauucaucaugccagaaaacgaacacgacgagcgcuucuucguccccuggucaucagccgccaccgccgacuucguagccaugaccgccauggccgcccgcauauuccgccccuacgacccucaguacgcagaaaaaugcaucaacgccgccaaggucucauaugaguuccucaaaaacaaccccgccaacgucuucgccaaccaaagcggcuucagcaccggggaauacgcaaccgucagcgacgcagacgaccgacuaugggccgcagccgaaaugugggaaacucuaggcgacgaagaguaccuccgggacuucgaaaacagagccgcccaauucuccaagaaaauagaagcagacuucgacugggacaacguagcaaaccuaggcauguucacauaccuccuauccgaacguccaggcaaaaaccccgcccuaguccaaagcaucaaagacagccuccucuccaccgcagacuccaucguacguacaagccaaaaccacgguuacggccgaacucuagguaccacauacuacuggggcugcaacggcacugucgugcgccaaacaaugauccuacaagucgcaaacaaaaucucaccuaauaacgauuacguaaacgcagcccuagacgccauaucacacgucuucggacgaaacuacuacaacagaucauacguaaccggccuaggcaucaacccucccaugaacccccacgacagacguucaggcgccgacgguaucugggaaccauggcccggguaccuagucggcggcggcuggccaggacccaaagacugggucgacauccaagacuccuaccagaccaacgaaaucgcaaucaacuggaacgcggcacucaucuacgcccucgcaggauucguuaacuauaacucaccacaaaacgagguccuauauggagacguuaacgacgacggaaaagucaacucaacugaccucacacuacuaaagcgcuacguacucaaagccguaagcacccuacccucaucaaaagcagagaaaaaugccgacgucaaccgcgacggccgcguaaacuccuccgacguuacaauccucucccgcuaccugauccgaguaaucgaaaagcucccuauc

SEQ ID NO: 59010 - RNA, 1947 nt, Artificial Sequence
  derived and/or modified sequence opt11 from anti-influenza_Chain
augggagacaaaaucaacuucaucuucggcauccacaaccaccaaccgcugggcaacuucggcuggguauucgaggaagccuacgagaagugcuacuggcccuuccucgagacccucgaagaguacccaaacaugaagguagccauccacaccagcggcccacuaaucgaauggcuacaagacaacagaccagaauacauagaccuauuacgcagccuagucaaacgaggacaagucgagauaguaguagccggcuucuacgaaccgguacuagcauccauccccaaggaggacagaaucgaacaaauacgccucaugaaggagugggccaaaucaauaggauucgacgcacgagggguauggcucacggaaagagucuggcaacccgagcuagucaaaacccuaaaagaauccggaauagacuacgugaucguggacgacuaucacuucaugagcgcaggucucucaaaagaagaacucuacuggccauacuacacagaagacggcggcgaagugaucgcggucuuccccauagacgaaaaacucagauaccucauaccauuccgccccgucgacaaaguccuggaauaccuccacucccuaaucgacggcgacgaaucaaaaguagccgucuuccacgacgacggggaaaaguucggcauauggccaggaaccuacgaaugggucuacgaaaaaggcugguuacgggaguucuucgaccgaauaagcucagacgagaaaaucaaccucaugcuauacaccgaauaccuugaaaaauacaagccacggggucuaguguaucuacccaucgcgaguuacuucgaaaugucagaauggagccugccagccaagcaagcccgacuauucgucgaguucgucaacgaacuaaaaguaaaaggaauauucgaaaaguaccgaguguucguccgaggaggaauauggaagaacuucuucuacaaauacccagaaucgaacuacaugcacaaacgcaugcucaugguaagcaagcuaguccgcaacaacccagaggcaagaaaauaccugcuacgcgcccagugcaacgacgccuacuggcacggccuauucggaggaguauaccucccacaccuaagacgagcaauauggaacaaccucaucaaagcaaacuccuacgucagccugggaaaagucauacgagacauagacuacgacggcuucgaagaaguccucauagaaaacgacaauuucuacgccguguucaagccauccuacggcggaagccuagucgaauuuucauccaagaacagacugguaaacuacgucgacgugcuagcaaggaggugggaacauuaccacggguacguagagagccaauucgacggggucgccaguauacacgagcuagaaaagaagauaccagacgaaauccgaaaagagguagcauacgacaaauacagacgcuucaugcugcaagaccacgucguccccuuaggaaccacgcucgaagacuucauguucucaagacaacaagagaucggagaguucccacgcguacccuacagcuacgaacuacuggauggaggcaucagacucaaacgcgaacaccuaggaaucgaagucgagaaaaccguaaaacugguaaacgacggcuucgaagucgaauacaucguaaacaacaaaacaggaaaucccguacucuucgcaguagaacuaaacgucgccguccaaagcaucauggaaagccccggaguccuacgaggcaaagaaauagucguagacgacaaguacgcagucggcaaauucgcccucaaauuugaagacgaaauggaaguguggaaauaccccgucaaaacccuaagccaauccgaaagcggaugggaccugauacaacagggagucagcuacaucguacccauccgccucgaagacaaaaucagguucaaguuaaaauucgaggaagccagcggg

SEQ ID NO: 59011 - RNA, 1947 nt, Artificial Sequence
  derived and/or modified sequence opt11 from anti-influenza_Chain
auguccaggaugacccuuaaaucauccaugaagaaacggguacucucccuccugaucgcaguugucuuccugucacucacaggcguauuccccucaggucugauugaaaccaaagucucagcagccaaaauaacugaaaacuaccaauucgacagccguauccgccuaaacucaaucggauucauccccaaccacucaaagaaagccacgaucgccgccaacugcuccacauucuacguugucaaagaagauggaaccaucgucuacacaggaacggccaccuccauguucgacaaugacacaaaagaaaccguuuacaucgcggacuuuucauccguaaacgaagaaggcacauacuaccucgccguccccggcgucggcaaauccguuaacuuuaaaauagccaugaacgucuacgaagacgccuucaaaaccgccaugcucggaauguaucuccuccgcugcggaaccucagucucagccacguacaacgguauccacuacucacacggcccaugccacacaaaugacgccuaccucgacuacaucaauggccaacacaccaagaaagacagcacaaaaggcuggcacgacgccggcgauuacaacaaauacguugucaaugccggaaucaccgucggcucaauguuccucgcaugggaacacuucaaagaccaacucgaacccguggcccuggaaauaccggagaaaaacaacagcauacccgacuuccucgaugaacucaaauacgaaaucgacuggauacuuaccaugcaauaccccgauggcucaggccgggucgcccacaaagucucgacacgcaacuucggcggauucaucaugcccgaaaacgaacacgacgaacgauucuucguccccuggagcucugcagcaaccgccgauuucgucgccaugaccgccauggcagcccgaaucuucagaccauaugacccccaauacgccgaaaaaugcaucaacgccgccaaagucucauacgaguuccucaaaaacaaccccgccaacguauucgcaaaccaguccggcuucuccacaggcgaauacgcaaccgucuccgacgccgacgaccgccucugggcagcagcagaaaugugggagacacuaggcgacgaagaauacuuaagagauuucgaaaacagagcagcgcaauucagcaagaaaaucgaagccgacuucgacugggacaacgucgcuaaucugggcauguucaccuaccuucuuuccgaacgccccgggaaaaaccccgcccucguccaaucaaucaaagacucccuccuuuccacagcagacucuaucgucagaacaagccaaaaccacggauacggccgaacccucggaaccacauacuacuggggcugcaacggcaccgucguccgccaaaccaugauccuccaagucgccaacaaaaucucccccaacaacgacuacgucaacgcagcacucgaugccauaucccacguauucggccgcaacuacuauaaccguucauaugucacuggacucggaaucaacccucccaugaacccccacgaccgcagauccggugccgauggaaucugggaacccuggcccggcuaccucgucggcggcggcuggccggggccgaaagacuggguagacauacaagacagcuaucaaaccaacgaaauagccauaaacuggaacgccgcccuaaucuacgccuuagcuggauucguaaacuacaacuccccucaaaacgaaguccucuacggcgacgucaacgacgacggcaaaguuaacuccaccgaccuaacccuccucaaacgcuacguccucaaagccgucuccacccuuccauccucgaaggcagagaaaaaugccgacgucaacagagacggccgaguaaauucauccgacgucacaauccugagccgauaccucauacgcgugaucgaaaaacuacccaua

SEQ ID NO: 59012 - RNA, 2046 nt, Artificial Sequence
  derived and/or modified sequence opt11 from anti-influenza_Chain
augaaacccucacauuucaccgaaaagcgauucaugaagaaagugcucggacuguuccuagucguagucauguuagcgagcguaggaguguuacccaccagcaaagugcaagccgcaggaaccacaguaaccuccauggaauauuuuagccccgcggacgggcccguaaucuccaaaucaggcgucggcaaagccuccuacggcuucguaaugcccaaauucaacggaggcucagccacguggaacgacguauacagugacgugggcgucaacgucaaaguagguaacaacugggucgacaucgaccaagcaggcggauacaucuacaaccaaaacugggggcacugguccgacggcggcuucaacggcuacugguucacucucagcgccaccacugagauacaacuauacuccaaagccaacggcgucaaacucgaauaccaacucgucuuccaaaacauaaacaaaacuaccaucacagcaaugaacccaacccaaggaccacaaauaaccgccuccuucaccggaggcgcaggcuucaccuaccccacauucaacaacgacagcgcggucacauacgaagccguagcagacgaccucaaaguauacgucaaaccaguaaauucauccagcuggaucgacauagacaacaacgccgcauccggauggauauacgaccacaacuucggacaauucacagacggaggaggaggauacugguuuaauguaacagaaucgaucaaugucaaacucgaguccaagaccucaucagcaaaccucgucuacaccaucaccuucaacgaaccaacccgcaacuccuacgucaucacuccguacgaaggcacaacauucaccgcagacgcaaacggauccauagguauaccccuacccaagaucgacggaggcgcaccaauagcaaaagaacuuggcaacuucgucuaccaaaucaacaucaacggucaaugggucgaucucuccaacucuucucaaagcaaauucgccuacuccgccaacggcuauaacaacaugucugacgcgaaccaguggggcuacugggccgacuacauauacggccuaugguuccagccaauccaagaaaacaugcaaauccgaauaggcuacccgcuuaacggccaagccggcggaaacauaggcaacaacuucguaaacuauaccuucaucggcaacccaaacgcaccgcgccccgacgucagugaccaagaagacaucuccauaggcacaccaacggacccggccauagcagggaugaaccucauauggcaagacgaguucaacggcaccacccucgacaccucaaaguggaacuacgaaaccggauacuaccuaaacaacgaccccgcaacauggggcuggggcaacgcagaacuccaacacuacaccaacagcacacaaaacgucuacguccaagacggcaaacuuaacaucaaagccaugaacgacucaaagagcuucccacaagacccaaaccgcuacgcccaguacucguccgggaaaaucaacacaaaagacaaacuuucacucaaauacggaagagucgacuuccgggccaaacuccccaccggcgauggagucuggccagcccuauggaugcuacccaaagacagcguauacggcacaugggcagcaucaggcgaaauagacgucauggaagcccgcggacgccuccccggcucaguauccggcaccauacauuucggaggccaguggccaguaaaccaaagcuccggcggagacuaucacuucccggaaggccaaaccuuugccaacgacuaccacguguacuccguaguaugggaagaagauaacaucaaaugguacguagacggcaaauucuucuacaaaguuacgaaucaacaaugguacucaaccgccgcccccaacaacccaaacgcacccuucgacgaaccauucuaccugaucaugaaccucgccgucggcgguaacuucgauggcggacgaaccccaaacgccagcgacauaccggccacaaugcaagucgacuacguccgcgucuacaaagaacaa

SEQ ID NO: 59013 - RNA, 2046 nt, Artificial Sequence
  derived and/or modified sequence opt11 from anti-influenza_Chain
augaagcccucacacuucaccgagaaacgcuucaugaagaaaguucuaggucuauuccuagucgucgucaugcucgcauccguaggcguccuacccacauccaaaguucaagcggccggcaccacaguaacguccauggaauacuucucucccgccgacgggcccguaaucagcaaauccggcgucggcaaagccagcuacggauucguuaugccaaaauucaacgggggaagcgccacauggaacgacguauacagcgacgucggcguaaacguaaaagucggcaacaauuggguagacaucgaccaagccgguggcuacauauauaaccaaaacuggggccacugguccgauggcggauucaacggcuacugguucacccucagcgccaccaccgaaauccagcuauacagcaaagccaauggagucaaacuagaauaccaacucgucuuccaaaacaucaacaaaacaacaauaacagccaugaacccgacccaagggccccaaaucaccgcuucuuucaccggaggcgcaggcuucacauacccaacauuuaacaaugacucagccguuacauacgaggccguggccgacgaccuaaaagucuacguaaaacccgucaacaguucaucauggaucgacaucgauaacaacgccgccuccggauggauuuacgaccacaacuucggccaauucaccgacggcggcggcggauacugguuuaacguuacugaaucaauaaacgucaaacuagaaagcaagaccuccuccgccaaccuagucuacaccaucacauucaacgaaccuacccggaacucauacgucauaaccccguacgaaggaaccaccuucaccgccgacgccaauggcuccauaggcaucccacucccuaagaucgacgggggagccccgaucgcuaaggaacucggaaacuucgucuaccaaaucaacaucaacggucaaugggucgaccucucaaacucaagccaauccaaauucgccuacuccgccaacggcuacaacaacauguccgacgccaaccaauggggauacugggcagacuacaucuacgggcuaugguuccaaccaauacaagaaaacaugcagauccgcaucggcuacccacuuaacggacaagcgggcgggaacaucggcaacaacuucgucaacuacacauucauaggcaacccaaacgcaccccgcccagacgucuccgaccaagaagacaucucaauaggcacgccuacagaccccgccauagccgggaugaaccucauauggcaggacgaguucaacggaacaacacucgacaccagcaaguggaacuacgaaaccggauacuacuuaaacaacgaccccgccaccuggggcuggggcaaugcagaacuccaacacuacaccaacucaacgcaaaacgucuacguccaagacggcaaacucaacauaaaagcgaugaacgacuccaaaucguucccacaagacccaaaccgauacgcccaauacagcucaggaaaaauaaacaccaaagacaaacuuucccuuaaguacggcaggguagacuuccgcgcuaaacuucccacaggggacggagucuggccagcccuuuggaugcuccccaaagacucaguauacggcaccugggcggcauccggcgaaaucgacgucauggaagcacguggacgccuacccggcucaguaagcggcacaauccacuucggcggccaauggccuguaaaccaaagcuccggcggagacuaccacuuccccgaaggucagaccuucgccaacgacuaccacguauacuccgugguaugggaagaagacaacauaaagugguacgucgacggcaaauucuucuacaaaguaaccaaccaacaaugguacuccaccgcagcccccaacaacccaaacgcacccuucgacgaaccauucuaccuaauaaugaaccucgccgucgguggaaacuucgacggcggacgaacucccaacgccucagacauaccagcuaccaugcaagucgacuacguccgggucuacaaagagcaa

SEQ ID NO: 59014 - RNA, 2058 nt, Artificial Sequence
  derived and/or modified sequence opt11 from anti-influenza_Chain
augaccaaauccaucuacuucucccugggcauccacaaccaccaacccgucggcaacuucgacuucgucaucgaacgugccuacgaaaugagcuacaaaccccuaaucaacuucuucuucaaacacccggacuucccaaucaacguccacuucucgggguuccuacuccuauggcuagaaaagaaccacccggaauacuucgaaaaacuaaagaucauggccgaacgcggacaaaucgaguucguauccggcggcuucuacgaacccauccuaccaauaauccccgacaaggacaaaguccaacaaauuaagaaacuaaacaaauacaucuaugacaaauucggacaaacacccaaaggcauguggcuugccgaacgagugugggaaccccaccucgucaaauacaucgccgaagccggcaucgaauacgucgucgucgacgacgcccacuucuucucaguuggccucaaagaagaagaccuauucggcuacuaccucauggaagaacaaggguacaaacuagccgucuuccccauaagcaugaagcuccgguaccugauccccuucgccgaccccgaggaaacaauaacguaccuagacaaauucgccucggaagacaaaucgaaaauugccuuacucuucgacgacggcgagaaauucggccucuggcccgacacauaccgcaccgucuacgaagagggauggcucgagacauucgucagcaagauuaaagagaacuuccuacuugucacccccgucaaccuguacaccuauaugcaacgcgugaaaccgaaaggccgaauuuaccuucccaccgcauccuaccgcgagaugauggaguggguccucuuccccgaagcccaaaaagaacucgaagaacucgucgaaaaacucaagaccgaaaaccucugggacaaauucagccccuacgucaaaggcggcuucuggcgcaacuuccuagccaaauacgacgaaucaaaccacaugcaaaagaaaaugcuauacgucuggaagaagguccaagacucuccaaaugaagaagucaaagaaaaggccauggaggaaguauuccaaggccaagccaacgaugccuacuggcacggcauauucggcggccucuaccucccacaccuccgcaccgccauauacgaacaccucauaaaagccgaaaacuaccuagaaaacucggaaauccgauucaacaucuucgauuucgacugcgacggcaacgacgaaaucauaguagaaucccccuucuucaaccucuaccuaucccccaaccacgguggaucaguucuggaaugggacuucaaaacaaaagccuucaaccucacaaacguccucacccgccgcaaggaagccuaccacuccaagcucucauacgucaccuccgaagcccaaggaaaaagcauacacgaacgauggaccgcuaaagaagaaggccuagaaaacauccucuucuacgacaaccacagacgcgucuccuuuaccgagaaaaucuucgaaagcgaaccagucuuagaagaccucuggaaggacucaucacgccucgaaguggacuccuucuaugaaaacuacgacuacgaaaucaacaaggacgaaaacaaaauccgcguacuguucuccgggguauuucgcggauucgaacucugcaaauccuacauacuauacaaagauaaauccuucgucgacgucguguacgaaaucaaaaacgucucggaaacaccaauuucccucaacuucggcugggaaaucaaccucaauuuccuagcccccaaucacccggacuacuacuuccugaucggcgaccaaaaauacccccuauccucauucggcaucgaaaaagucaauaacuggaagaucuucaguggcaucggaauagaacucgagugcguccucgacgucgaggcaucccucuaccgauacccaaucgaaaccguaaguuuguccgaagagggcuucgagcgcgucuaccaaggcucagcccucauacacuucuacaaaguggaccugcccguaggaucaaccuggcgcacuacgauccgcuucugggucaag

SEQ ID NO: 59015 - RNA, 2058 nt, Artificial Sequence; identical to SEQ ID NO: 13162
  derived and/or modified sequence opt11 from anti-influenza_Chain

SEQ ID NO: 59016 - RNA, 2115 nt, Artificial Sequence
  derived and/or modified sequence opt11 from anti-influenza_Chain
augcccaccaaccucuucuucaacgcccaccacucucccguaggcgcauucgccaguuuuacacucgguuuccccgggaaaagcggaggccucgaccucgagcuagcccgcccgcccagacaaaacguccugaucggagucgaaucccuccacgagucaggucuauaccacguacuacccuuccuggagaccgcagaggaagacgaauccaaacgauacgacauugaaaaccccgauccgaacccccaaaaaccaaacauacuaaucccauucgccaaggaagaaauacaacgcgaguuccauguggccaccgacacauggaaggcaggagaccucaccuucacaauauacucccccgucaaagcagucccgaaucccgaaaccgcugacgaagaagaguuaaaacuggcccucguccccgcagucauagucgagaugaccauagacaacaccaacggcacacgugcacgccgagcauucuucggguuugaaggcacggauccguacacguccaugaggcggaucgacgacaccuguccacaguuacguggcguaggacaaggacgaauccugucaauagucagcaaagacgaaggcguccggagcgcccuacacuuuagcauggaagacauccugacagcacaacuagaagaaaauuggacuuuuggucucggcaaaguaggagcacucaucgucgaugucccugccggagaaaagaaaaccuaccaguucgccguaugcuucuaccgcggcggcuauguaaccgccggaauggacgccucauacuucuacacccgcuucuuccaaaacauugaagaagucggacucuacgcccuagaacaagcagaaguacuaaaagaacaaucauuccgcuccaacaaacuuauagaaaaggaauggcuaagcgacgaccagacauucaugauggcgcacgccauacgaucauauuacggaaacacacagcuacucgaacacgagggcaaaccuaucugggucguaaacgaaggcgaauaccgcaugaugaauacauucgaccucaccguagaccaacucuucuucgagcucaaacuaaacccguggacagugaaaaacguccuagaccuauacguagaacgcuacucguacgaagaccgcguccgauuuccgggcgaggaaaccgaauaccccuccggcauauccuucacacacgacaugggcguggcaaacaccuucagccgcccacacuacucaagcuacgaacucuacggcauaagcggcugcuucucccacaugacccacgaacaacuggucaacuggguacugugcgcagccguauacauagagcaaacaaaagacugggccuggcgcgacaaacgacucgcaauucuggaacagugccuugaaucgaugguccgcagggaucaccccgaccccgaacaacggaacggcgucaugggccucgacucaacucgaaccaugggcggggccgaaaucacaaccuacgacagccuagacgugucccuaggccaggcaagaaacaaccuauaccucgccggaaaaugcugggcagccuacguggcucucgaaaaauuauuccgcgacgucggcaaagaagaacucgcggcccucgccggcgagcaagccgagaagugcgcugcaaccauaguaucccacguaaccgacgauggauacauacccgccauaaugggcgaaggcaacgacucgaaaaucauaccugccauagaaggccuaguauuccccuacuucacaaauugucaugaagcccucgaugaaaacggccgauucggagccuauauccaagcccuccgaaaccaccuccaauacguccuacgcgaagggauaugccucuuccccgacggcggcuggaagauuuccagcacaucaaacaacucuuggcuauccaaaaucuaccuaugccaauucauagcccgacacauacucggcugggaaugggacgagcaggguaaaagagcagacgcagcccacgucgcauggcugacacaccccacccugucaaucugguccugguccgaccaaaucauagccggggaaauaacaggcucaaaauacuacccacgcggaguaaccagcauacucuggcuagaagagggagag

SEQ ID NO: 59017 - RNA, 2115 nt, Artificial Sequence
  derived and/or modified sequence opt11 from anti-influenza_Chain
augccaacaaaccuauucuucaacgcacaccauuccccggucggagcauucgcauccuucacacucggcuuccccggcaaaagcggcggccucgaccuagaacuagcccgacccccacggcaaaacguacugaucggagucgaaucacuacacgaauccggccucuaccacguccuaccguuccuggaaaccgccgaagaggacgaauccaaacgcuacgacaucgaaaaucccgacccuaauccccaaaaacccaacauccucaucccauuugcaaaagaagaaauucaacgagaguuccacgucgccaccgauaccuggaaagccggcgaccucacuuucacaaucuacucacccgucaaagcgguaccaaauccugaaaccgcggacgaagaagaacucaaacuugcccucgugcccgcggucauagucgaaaugacaaucgacaacaccaacggcacgagagcacgucgcgccuucuucggauucgaaggcaccgacccauacacaucaaugagacgaaucgacgacacaugcccccaacuccgaggcgucggacagggccgcauacuauccaucgugucaaaggaugagggaguccgcucggcacuccacuucagcauggaagacauccucaccgcacaacucgaagaaaacuggacguucggacuaggaaaagucggcgcccuuauagucgacguacccgccggagaaaagaaaaccuaccaguucgcagucugcuucuauagagguggauacgucacagcuggcauggacgccucuuacuucuacacccguuucuuucaaaacaucgaagaaguaggccuuuacgcccuagaacaggcagaaguccugaaagagcaauccuucagauccaacaaacucaucgagaaagaauggcuaagcgacgaucaaaccuucaugauggcccacgccauaagaucguacuacggcaacacccaacuccucgaacacgaaggcaaacccauauggguagucaacgaaggcgaauaccggaugaugaacacauucgaccucacagucgaucaacucuucuucgaacucaaacuaaacccguggaccguuaaaaacguacucgaccucuacguagaacgcuacagcuacgaagaccgcguccgcuucccaggcgaagagaccgaauaccccuccggcaucuccuucacccacgacaugggagucgcuaacaccuucucgagaccgcacuacagcucauacgaacucuacggaauauccggaugcuuuucccacaugacccacgagcaauuagucaauuggguacuaugcgcagccgucuacaucgaacaaaccaaggauugggcauggcgagauaaacggcuggcaauacucgaacaaugccuagaauccaugguccgacgcgaccaccccgacccagaacagagaaacggagucaugggacuggacucaacacgaaccaugggcggggcagaaaucaccaccuacgacucccucgacgucagccugggccaagccagaaacaaccucuaccucgccgguaaaugcugggccgcauacguagcccucgaaaaacucuuccgcgacguaggaaaagaagaacucgccgcacucgcaggagagcaagcugaaaagugcgcagccacgaucguaucacacgucaccgacgacggcuauauaccugccaucaugggcgaaggcaacgacucaaagauaaucccagcgaucgaaggccuagucuuccccuacuucacaaacugccacgaagcacucgacgaaaacggacgcuucggcgcauacauccaagcacuccgaaaccaccuacaauacguccucagagaaggaauaugccucuuccccgacggcggcuggaaaaucuccuccacaagcaacaacagcuggcuaagcaaaauauaccucugccaauucaucgcgcgccacauccucggcugggagugggacgaacaaggcaaacgcgccgacgcagcgcacgucgcguggcuaacccacccaacgcucucaauaugguccuggagcgaccagaucauagcaggagaaauaaccggcuccaaauacuauccaagaggugucacauccauccucuggcucgaagagggcgag

SEQ ID NO: 59018 - RNA, 2148 nt, Artificial Sequence
  derived and/or modified sequence opt11 from anti-influenza_Chain
auggaagauuucguccgccaaugcuucaacccaaugaucguagagcucgcagaaaaagcuaugaaagaguacggagaagaccucaagaucgaaacaaacaaauucgccgcaaucugcacccaccucgaagucugcuucauguacucagacuuccacuucaucaaugaacagggcgaaagcauaaucguggaaccggaagacccaaacgcccuacucaaacacagguucgaaauaaucgagggacgagaccgcaccauggccuggacagucguaaacuccaucuguaauaccaccggggccgaaaagcccaaguuccuacccgaccuguacgacuacaaggaaaaccgauucaucgaaauaggcgucacgcgcagggaaguccacauauacuaucucgagaaggcgaacaaaauaaaaagcgagaaaacacacauccacauauucucauucaccggcgaggagauggcgacgaaagccgacuacacacuagacgaggaaucucgcgcgcgaauaaaaacgcggcuauucacaauccgccaagagauggcaucccgaggccugugggacagcuuccgccaaagcgagcgcggcgaagagacaaucgaagagagauucgaaaucaccggaacaaugcgccggcucgccgaccagucccugcccccaaacuucaguugccucgagaacuuccgcgccuacgucgacggcuucgaaccaaacggcuacauagagggcaaacuaucacaaaugagcaaagaagucaacgcgcgcauagaaccauuccugagaacaacaccgcgcccgauacgauuacccgacggcccuccaugcuuccaaagaucaaaguuccuccucauggacucgcucaaacuaucaauagaagacccaagccacgaaggggaagggauaccgcucuacgacgccaucaaaugcaugcgcacguucuucggcuggaaagagccgucaguagucaaaccccacggaaagggaaucaaccccaacuaccuccucagcuggaagcaagugcucgcagaacuccaagacaucgaaucagaggagaaaauaccacguaccaaaaacaugaagaaaacaagccaacucaaaugggcacucggagaaaacauggcacccgaaaaaguagacuucgacgacugcaaagacauaagcgaccuaaaacaauacgacagugaugaacccgaacucaggagccugagcucuuggauacaaaaugaguucaacaaagccugcgaacugaccgacuccaucuggauugaacucgacgaaaucggagaagacguagcacccauagaacacaucgcauccaugcgaaggaacuauuucacggccgaagucucacacugccgcgcgaccgaauacauaaugaaagguguguacauaaacacagcacuccucaacgcauccugcgcagccauggacgacuuucaacucauaccaaugaucaguaaaugccgcacaaaagaaggccgacgcaaaacaaaccucuauggcuucauuauuaaagggcgcucacacuugcgaaacgacacagacguaguaaacuucguauccauggaguucagccucacagacccacgccucgaaccccacaaaugggaaaaauacugcguccucgaaaucggagacauguuacucagaucagcaaucggccaaguaagcaggccaauguuccuauacguccgcacgaacgguaccucgaaaauaaagaugaaauggggaauggaaaugcgccgcugccuccuccagagcuuacaacaaauagaaagcaugauagaagccgaaucgucggucaaggaaaaagacaugaccaaagaguucuucgagaacaggagcgagaccuggccaaucggcgagagcccaaaaggcguagaagaaggauccauaggaaaagucugccgcacgcuccuggccaaauccguauucaacagccuguacgccuccccacagcuagaaggguucucggccgaaagccgaaaacuguugcuaaucguccaagcacuccgcgacaaccucgaacccggaaccuucgaccuaggcggccuauaugaagcaaucgaagaaugccuaauaaacgaucccuggguccuccuaaacgccagcugguucaacagcuuccucacgcacgcauuacga

SEQ ID NO: 59019 - RNA, 2148 nt, Artificial Sequence
  derived and/or modified sequence opt11 from anti-influenza_Chain
auggaagacuucguacgccagugcuucaacccaaugauaguagaacucgccgaaaaagcaaugaaagaguacggggaagaccuaaagaucgagaccaacaaauucgccgcgaucugcacccaccucgaagucugcuucauguacucggacuuccacuucaucaaugaacaaggagagagcaucaucguagaaccggaagaccccaacgcucuacucaaacacagauucgaaauaaucgaagggcgggaucguacaauggcauggacaguagugaacucgaucugcaacacaacuggagcggagaaacccaaauuccuuccagaccuauacgacuauaaagaaaacagauucaucgaaauaggcguaacacgccgagaaguacacaucuacuaccucgaaaaagccaacaagaucaaaucagagaaaacccacauccacauauucuccuucacaggcgaagaaauggccacuaaagccgacuacacauuagacgaagaaucaagagcacgcauuaaaacacgcuuauucacgauccgccaagaaauggcgucaagaggccucugggacagcuuccggcaaagcgagagaggggaggagaccauagaagaacgcuucgaaauaacaggcacaaugcgccgacucgccgaccagucacuaccaccaaacuucagcugccuagaaaacuuccgcgcauacgucgacggauucgagcccaacggcuacaucgaaggcaaacucucccaaaugagcaaggaagucaacgcacgaauagaaccauuccuacgaacgaccccucgcccgaucagacucccagacggaccucccugcuuccaacgauccaaguuccuacucauggacucccuaaaacuauccaucgaggaccccucccacgaaggcgaaggaaucccccucuacgacgccauaaaaugcaugcgaacguucuucggcuggaaggagcccucagucgugaaaccgcacggaaaggggauaaaccccaacuaucugcucucuuggaaacaggucuuagccgaacuacaagacauagagagcgaagagaaaaucccacggacgaaaaacaugaagaaaacaagccaacuaaagugggcacuaggcgaaaacauggcccccgaaaaggucgauuucgacgacugcaaagacaucucagaccucaaacaauacgacucggacgaacccgagcuccgaagccuaagcagcuggauacagaaugaguucaacaaagcaugcgaacuaacagacucgauauggauagaacuagacgagaucggagaagauguagcacccaucgaacacauagcaaguaugagacgcaacuacuucacagcagaaguaagucacugccgagccacagaauacauaaugaaaggcguauacauuaacacagcccuacucaacgccuccugcgccgccauggacgauuuccaacuaauaccaaugaucagcaaaugccgcacaaaagaaggcagaagaaaaaccaaccuauacggcuucaucaucaaaggccgcucacacuugcgcaacgacacggacguggugaacuucguaucaauggaguucagccuaacagacccccggcucgaaccccacaagugggaaaaguacugcguccucgaaauaggcgacaugcuccuccggagcgcgaucggucaagucagccgccccauguuccucuacgucagaacaaacggcacaucaaaaauaaagaugaaauggggaauggaaaugcgccggugccugcuacaaagccugcaacaaaucgaaagcaugaucgaggcagaaagcucugucaaagaaaaagacaugacgaaggaguucuucgaaaacagauccgaaaccuggccaauaggggaaagcccgaagggagucgaagaaggcagcaucggcaaagucugccgcacucucuuagccaagagcgucuucaacagcuuauacgccagcccgcaacuugagggauucuccgcagaaagccgaaaacuccuacugaucguccaagcacuacgagacaaccuagagcccgggaccuucgaccugggaggccucuacgaagcgaucgaggaaugccucauaaacgaccccuggguacuucuaaacgcauccugguuuaacucauuccuaacgcacgcccugcgu

SEQ ID NO: 59020 - RNA, 2256 nt, Artificial Sequence
  derived and/or modified sequence opt11 from anti-influenza_Chain
augaacauaaaucccuacuuccuauucaucgacgugcccauacaagcagccauaagcacaaccuucccauacacaggagucccacccuacagccacggcaccggcaccggcuacacaaucgacacagucauacgcacacacgaauauuccaacaaaggcaaacaauauaucagcgauguaaccggaugcguaaugguagaccccacaaacggcccccuccccgaggacaacgaacccuccgccuacgcgcagcuagacugcguacuagaagcucucgaccgaauggacgaagaacacccgggauuauuccaagcaggcagccaaaacgccauggaagcccuaaugguaacuaccgucgacaaacuuacccaaggacggcaaaccuucgacuggacgguaugccgcaaccaacccgccgcaaccgcccuaaacaccacaaucaccagcuuccgacucaaugaucucaacggggcugacaaaggcggucucguccccuucugccaagacauaaucgacagccuugacaaacccgaaaugaucuucuucaccgugaagaauaucaaaaagaaacuacccgccaaaaaccggaaaggcuuccucaucaaacgaauccccaugaaagucaaagaccgcaucaccagagucgaauacauaaaacgagcccuaagccuaaacacaaugacuaaagacgccgaacgcggaaaauuaaaaagacgagcgauagccaccgcaggcauccaaauccgcggauucguccucguggucgaaaaccuggccaagaacauaugcgaaaaccuagaacagucagggcuccccguaggcggcaacgaaaagaaagccaaacuaucaaaugccguagccaaaaugcuaucaaacugcccacccggaggcauauccaugaccgugacaggggacaacacaaaauggaacgaaugccucaauccccgaauauuccuagcaaugacggaacgcaucacacgagacucgccaaucugguucagagacuuuugcucgaucgcccccguacuauucagcaacaaaauagccaggcuaggcaaagguuucaugaucaccuccaaaaccaaacgacucaaagcccaaauacccugcccggaucucuucaacaucccccucgaaagguacaacgaagaaacccgcgccaagcucaagaaacugaaacccuucuucaaugaagaagguacugccagccucucccccggaaugaugaugggcauguuuaauaugcuuuccaccguacucggcguugcugcacuaggaauuaaaaacauaggcaauaaagaauaccuaugggacggccuccaguccagcgacgacuucgcacuuuucgucaacgcgaaggacgaagagacaugcauggaaggcauaaacgacuucuaccgaaccugcaaacuacucggaaucaacauguccaaaaagaaauccuacugcaacgaaaccggcauguucgaguucacgagcauguucuaccgggacggcuucguauccaacuucgccauggaacucccaucauucggcguagccggcgucaacgaauccgccgacauggccauaggcaugacaaucaucaaaaacaacaugauaaacaacggaaugggcccagccacagcccaaaccgcgauccaacuguucauagcagacuaccgauauacauacaaaugccacagaggagacaguaaagucgaaggcaaacgcaugaaaaucaucaaggaacucugggaaaauaccaaaggacgugacggccugcuagucgcagacgggggccccaaccucuacaaccuacgcaaccuccacauucccgaaaucaucuuaaaguacaacauaauggacccugaauacaaaggccgccuccuacacccccaaaaccccuuuguaggacaccuguccaucgaaggaauaaaagaagccgacauaacccccgcccauggaccaauaaagaaaauggacuacgacgccgucagcggaacacacuccuggaggacuaaacgcaaccgcagcauccucaacaccgaucaacgcaacaugauccuagaagaacaaugcuacgcaaaaugcugcaaccuauucgaagccugcuucaacuccgcaagcuaucgcaaacccguaggccaacauaguaugcuagaagcaauggcccaccgccuacguauggacgcucgacuagacuacgaaagcggccgaaugucuaaagaagacuucgaaaaagcaauggcccaccuaggcgaaauuggguacaug

SEQ ID NO: 59021 - RNA, 2256 nt, Artificial Sequence
  derived and/or modified sequence opt11 from anti-influenza_Chain
augaacaucaaccccuacuuccuguucaucgacgugccgauccaggccgccaucagcaccaccuuccccuacacgggcgucccgcccuacucccacgggaccggcaccggguacaccaucgacacggugauccgcacacacgaauacagcaacaagggcaaacaguacauuuccgacgugacggggugcgucaugguugacccgaccaacggcccccuccccgaggacaacgagcccagcgcuuacgcgcagcuggacugcgugcuggaggcccucgaccgcauggacgaggagcacccgggccuguuccaggccgggucccagaacgccauggaggcgcugauggucacgaccgucgacaagcugacacagggccgccagaccuucgacuggaccgugugccggaaccagcccgccgccaccgcccugaacaccaccaucacgagcuuccgccugaacgaccucaacggggcugacaagggcgggcugguccccuucugccaagacaucaucgacucccuggacaagcccgagaugaucuucuucaccguaaagaacauuaagaagaagcucccagccaagaaccggaagggcuuccugaucaagcgcauccccaugaaggugaaggacagaaucacccgcgucgaguacauuaagcgggcccugucucuaaacaccaugacaaaggacgccgagcgcggaaaguugaagcggcgggccaucgcgaccgccgggauccagauccggggcuucgugcuagucguggagaaccucgccaaaaacaucugcgagaaccuggagcaguccgggcugccugucggcggcaacgagaagaaggccaagcucagcaacgccguagcgaagaugcuguccaacugcccgcccgggggcaucagcaugaccgucaccggggacaacaccaaguggaacgagugccugaacccccgcaucuuccucgccaugaccgagcggaucacccgcgacucccccaucugguuccgggacuucuguagcaucgcccccgugcuuuucuccaacaagaucgcccgcuuaggcaagggguucaugaucaccagcaagacgaagcggcucaaggcccagauacccugccccgaccuguucaacaucccccuggagcgcuacaaugaggagacccgggcgaagcucaagaagcugaagcccuucuucaacgaggagggcaccgccucccugagcccgggcaugaugauggggauguucaacaugcucuccaccgugcugggcguagccgcccuggggaucaaaaauaucggcaacaaggaguaccucugggacgggcugcagucuagcgacgacuucgcccuuuucgugaacgcaaaggacgaggaaacaugcauggagggcaucaacgacuucuaccgaaccugcaagcuccugggcaucaacauguccaagaagaaguccuacugcaacgagaccgggauguucgaguucaccagcauguucuaccgcgaugguuucgugagcaacuucgccauggagcucccaucuuucggggucgccggcgucaacgagagcgccgacauggcgauugguaugacgaucaucaagaacaacaugaucaacaauggcaugggccccgccaccgcccagaccgccauccaacuguucaucgccgauuaccgcuacaccuacaagugccaccgcggugacuccaaggucgagggcaagcggaugaagaucaucaaggagcucugggagaacaccaaagggcgcgacggccugcucguggccgacggcgggccaaaccuguauaaccugcggaaccuacacaucccggagaucauccugaaguacaacaucauggaucccgaguacaagggccgccugcugcauccccagaacccguucguugggcaccucagcaucgagggaaucaaggaggccgacaucacgcccgcccacgggccuaucaagaagauggauuacgacgccgucuccggcacccacagcuggcggaccaagcgcaaccgcuccauccugaacaccgaccagcgcaacaugauccucgaggagcaguguuacgccaagugcugcaacuuguucgaggcgugcuucaacagcgccuccuaccggaagcccgucggccagcacucgaugcuggaggcuauggcccaucgccugcggauggacgcccgucucgacuacgaauccgggcggaugagcaaggaggacuucgagaaggcgauggcccaccugggcgagaucggguacaug

SEQ ID NO: 59022 - RNA, 2265 nt, Artificial Sequence
  derived and/or modified sequence opt11 from anti-influenza_Chain
auggccguggacaucaaaaagauaauaaaacaaaugacccucgaagaaaaggcaggacucugcaguggacucgacuucuggcacacaaaaccaguagaacgacugggcauuccaucaauaaugaugacggacggaccucacggccugcgcaaacagagagaagacgcagaaaucgcagacaucaauaacagcguacccgcgaccugcuucccaagcgcggccggccuagcaugcucaugggaccgcgaacugguggaacggguaggggccgcacucggcgaagaaugccaagcugaaaacgugaguaucuuacuagggcccggcgcaaacaucaaaaggagcccacuguguggcagaaacuucgaauacuucagcgaagacccauaccucucgagcgagcucgcggcuagucauaucaaaggcguacaaucccagggcguaggcgcgugccugaaacacuucgcagcaaacaaccaagagcaccgcagaaugaccguagacaccaucguagacgaacgaacauugcgagagauauauuuugccagcuucgaaaaugcagucaagaaagccagacccugggucguaaugugugccuacaacaaacuaaauggagaauacugcagcgaaaacagauaccuacucaccgaggugcucaagaacgaauggaugcacgacggcuuuguagugucagacuggggagccgugaacgauagaguaagcggccucgacgcagggcucgaccucgaaaugccaaccagccacggcauaacagacaaaaagaucgucgaggccgugaaaucaggcaaacuaucggaaaacauccuaaacagggcgguagaaaggauacucaaagucauauucauggcacuagaaaacaagaaagaaaacgcccaguacgacaaagacgcacaccaccgccucgcaaggcaagcagcugccgaaagcaugguccuccugaaaaacgaagacgacgugcuaccacucaagaaaucgggcacgaucgcgcucauaggcgcauucgucaagaaaccgagauaccagggcucaggaucgucccacaucacacccacacgucuagacgacauauacgaagaaaucaagaaagccggcggcgacaaagugaaccucguguacucagaaggauaccgacuggaaaacgacggaauagacgaggaacuaauaaacgaggcgaaaaaggccgcguccuccagcgacguagccguaguguucgcgggccugccagacgaguacgaaucagaaggauucgacaggacgcacaugagcauuccagaaaaccaaaacagacuaauagaagcaguagcagagguacaaagcaacaucguaguaguauugcucaacggcagccccgucgaaaugcccuggaucgacaaagugaaaucaguccuagaagcauaccuaggaggacaagcgcuaggcggcgcacucgcagacguacuauucggcgaagucaaccccuccggcaaacuggccgaaacauucccggucaagcucagccacaacccaucauaccuaaacuuucccggggaagacgacagagucgaauacaaggaaggacucuucguaggauacagauacuacgacacaaaaggaauagaaccacuauucccauucggccacgggcucucauacacgaaguucgaguacagcgacaucucaguggacaaaaaggacguaagugacaacagcauaaucaacguaagcguaaaagugaaaaacgucggaaagauggccggcaaagaaaucguacaacucuacgugaaagacgucaaauccucagucagacgcccagaaaaggaacugaaagguuucgagaaagucuuccuaaaccccggagaggagaaaaccguuaccuucacacuagacaagcgcgcauucgccuacuacaacacacaaauaaaagacuggcacguggaaagcggagaguuccuaauacucaucggacgauccagccgcgacaucguccuaaaggaaagcgugcgaguaaacagcaccgucaaaauuagaaaacgcuucaccgugaacuccgccguugaagacgugauguccgacagcagcgcggccgcgguacuaggcccaguacucaaagaaaucacagacgcccuccagaucgacauggauaacgcccacgacaugauggccgccaacaucaaaaacaugccacuuagaagccuagucggauacucgcaagggagacucagugaagaaaugcucgaagaacuggucgacaaaauaaacaacguagaa

SEQ ID NO: 59023 - RNA, 2265 nt, Artificial Sequence
  derived and/or modified sequence opt11 from anti-influenza_Chain
auggccgucgacaucaagaaaauaauaaaacagaugacacuagaagaaaaagcaggccuauguagugggcuagacuucuggcacacaaaaccaguagaacgacugggcauacccucaaucaugaugacggacgggccgcacggccugcgcaagcaaagagaagacgccgagaucgcagacauaaacaacagcgucccagcgaccugcuucccgagugcggcaggccuagcgugcagcugggaccgcgagcucguggaaagggucggagccgcgcucggggaagaaugccaggccgaaaacguaaguauucuccugggaccgggcgcgaacauaaaacgaagcccccuaugcggaagaaacuucgaauauuucucggaagaccccuaccuaagcuccgagcuggcggccagccacauaaagggaguacagagccagggcguaggagcgugccuaaaacacuucgcggcaaacaaccaagaacaccgcaggaugacaguggacacgauaguagaugaaaggacacugcgcgaaauauauuucgcgagcuucgaaaacgcagugaagaaggcccgacccugggucguaaugugcgccuacaacaagcucaacggagaguacugcagugagaaccgauaccuacucacggaaguacucaagaacgaguggaugcaugauggcuucguggugagcgacuggggugcgguaaacgaucgcguaagcggacucgaugcuggacucgaccucgaaaugccaacaucgcacgggaucacggauaagaaaauaguagaagccgucaaaagcggcaagcugucagaaaacauccugaauagggccguggagcgaauacuaaaagugauauucauggcgcuagagaacaagaaagaaaacgcgcaauacgacaaggacgcccaccacagacuagccagacaagcggcggcggaaagcaugguccuccugaaaaacgaagacgacgugcuaccacucaagaaaucgggcaccauagcacucauaggcgcguucgugaaaaagccacgcuaccaaggcagcggcucaagccacaucacgccgacacgccuggacgacauauaugaagagauaaagaaagcgggcggcgacaagguaaaccuaguguacucagaaggcuacagacuagaaaacgacgguauagacgaagaacugauaaacgaagccaagaaagccgcgaguuccagcgacguggccgucguuuucgcaggccuaccagacgaauacgaguccgagggauucgaccgaacgcacaugucaauccccgagaaccagaacaggcuaauugaagcagucgcagaagugcagucgaacauagucguaguacuacucaacggaucgccaguggaaaugcccuggaucgacaaagugaaaucaguacucgaagcguaccugggaggccaagcgcugggaggcgcacucgcggacguucucuucggagaggucaaucccucaggcaaacuagccgaaacguuuccgguaaaacucucacacaacccauccuaccugaacuuucccggggaggacgacagaguugaguacaaagaaggacuguuugucggauacagauacuacgacacgaaagggauagagccacuguucccauucgggcacgggcugagcuacacaaaauucgaauacagcgacaucucagucgacaagaaagacguaagcgacaacucaaucauaaaugugagcgucaaagugaaaaacguagguaagauggcggggaaagaaaucguccaacuguacgugaaagauguaaagagcaguguccgccgcccggaaaaggaacucaaaggguucgaaaaaguguuccugaacccgggcgaagagaaaacagugaccuucaccuuggacaagcgcgcauucgcguacuauaauacccagaucaaggacuggcacgucgaaagcggagaguuccuaauccugaucggcagaagcagccgagacaucgugcuaaaggaaucaguacgagucaacagcacaguuaagauccggaaaagguucaccguaaacagcgcgguagaagacguaaugagcgacucguccgcagccgcggugcucggccccguacuaaaggaaaucacagacgcgcuccaaaucgacauggauaacgcgcacgacaugauggcagcaaacaucaaaaacaugccgcucagaucguuggucggguacagccaaggacgacucagugaggaaaugcucgaagaauugguagacaagauaaacaacguagag

SEQ ID NO: 59024 - RNA, 2277 nt, Artificial Sequence
  derived and/or modified sequence opt11 from anti-influenza_Chain
auggaacgaaucaaagaacuccgcaacuuaaugagccagucccgaacacgagagauccugaccaaaacaacggucgaccacauggccaucaucaagaaauacaccuccggccgccaagagaaaaacccagcccuccgcaugaaauggaugauggcaaugaaauaccccaucacggcagacaaaaggauaacagaaaugauccccgaaagaaacgaacaaggccaaacacuauggucaaagaugaacgaugcaggaucagaccgcgucauggucucaccccuagcagugacaugguggaaccguaacggccccaugaccaacaccguacacuaccccaaaaucuacaaaacauauuucgaacgaguagaacgacucaaacacgggacauucggccccguucacuuccgaaaccaagucaagauccgacgacgcguagacauaaacccagggcacgcagaccuguccgcgaaagaagcccaggacguaaucauggaaguagucuucccgaaugaaguaggcgcgcgaauacucaccuccgaaucccaacuaacaaucaccaaagagaaaaaggaagaacuucaagacuguaaaaucagcccucucaugguagccuacaugcucgaacgcgaacucguccgcaaaaccagauuccuacccgucgccggcggcaccuccagcgucuacaucgaaguacuacacuugacccaagguaccugcugggaacaaauguacacaccgggcggcgaagucaaaaacgacgacgucgaccaaucacucaucaucgcggccagaaacauagucagacgcgccgccguaagcgcagacccgcucgcgagccuccucgaaaugugccacagcacgcaaauuggaggcaucagaaugguagacauacucaaacagaacccgaccgaagaacaagccguaggcaucugcaaagccgcuauggggcuuagaaucuccagcuccuucucauucggaggcuuuaccuucaaacgaaccuccggaucaagcguaaagcgagaagaagagguccucacaggcaaccuacaaacccucaaaauccgaguccacgaaggcuacgaggaguucaccauggucggccgccgagcaaccgccauccuucgcaaagcaacacguagacuaauccaacugauagucucgggacgagacgaacagagcaucgccgaagccauuauaguugcaauggucuucagccaagaagauugcaugauuaaggccgugagaggagaccucaacuucguaaaccgcgcaaaccaacgucucaacccgaugcaccaacugcuacgccacuuccaaaaggacgcaaaaguccuguuccaaaacuggggcguugaaccaaucgacaacguaaugggaaugauaggcauacuccccgacaugacgccgucaaucgagauguccaugcgaggaguccgaaucuccaaaaugggggucgacgaguacucaucaacagaacgaguagucgucagcauagacagauuccugcgaguacgcgaccaacgcggcaacguacuacugucaccagaagaagucagcgaaacacaaggcacagaaaaacucaccauaacauacucuagcagcaugaugugggaaauaaauggcccagaauccguccugguaaacaccuaccaauggaucauccgcaacugggagacaguaaaaauacaauggagccaaaaccccaccaugcucuauaacaaaauggaauuugaaccauuccaaucccugguccccaaggccauacgcggccaguauuccggauucguccgcacccucuuccaacaaaugcgggacguccucggaaccuuugacaccgcccagaucaucaaacuucugcccuucgcugccgccccuccaaaacagagccgcaugcaauucuccuccuucacaguaaacgugcgcggaagcgggaugcgaauacucguccgcggaaacucccccgucuuuaacuacaacaaggccaccaaacgccucacgguccucggcaaggacgcaggaacacuaacugaagacccagacgaggguacagccggcguagagucagcggugcuacgcggcuucuuaauacuaggaaaagaagaccgacgcuauggccccgcccucuccauaaacgaacucagcaaccuagccaagggcgagaaagcaaacguccucaucggacaaggcgacguaguucuagucaugaaaagaaagcgcgacuccucgauccuaaccgacagccagacggccacaaaacgaauccgaauggcaaucaac

SEQ ID NO: 59025 - RNA, 2277 nt, Artificial Sequence
  derived and/or modified sequence opt11 from anti-influenza_Chain
auggagcgaaucaaagaacuccgaaaucuaaugucucaaucgcgcaccagagaaauacuaacaaaaacaacggucgaucacauggccauaauuaagaaauauaccucgggccgccaagagaaaaaccccgcacucagaaugaaauggaugauggcaaugaaauaccccaucacagcggacaaacggaucaccgaaaugaucccugaaagaaacgaacagggccaaacccucuggagcaaaaugaacgacgcaggauccgacagggugaugguauccccguuagccgucaccugguggaaucgcaacgggcccaugacaaacaccguccacuacccaaaaaucuacaaaaccuacuucgagcgcguggaaagacugaaacacgggaccuucggaccaguccacuuccgcaaccaaguaaaaauacggcgccgggucgacaucaacccaggacacgcagaccuaagcgcgaaagaagcucaagacguaaucauggagguaguauuucccaacgaagucggcgcacgcauacuuacaucagagagccaacucaccauaaccaaagagaagaaagaagaacuacaagacugcaaaauaagcccccucaugguagcauacaugcuagagcgcgagcuaguccgcaaaacccgauuccuucccguggcaggcggcaccuccuccgucuacaucgaaguccuccaccucacccagggaacgugcugggaacaaauguacaccccaggaggggaagugaaaaacgacgacguagaccaaagccuaauaaucgcagcucggaacauagucaggcgcgccgccguaagcgcggacccccuagccagccuacuggagaugugccacucaacacaaauagggggaauacgcauggucgacauacugaaacaaaacccaaccgaggaacaggccguagggauaugcaaagccgcaaugggccuacgaauuucaagcagcuucagcuucggaggcuucacauucaaacgcacaagcggcuccucaguaaagcgagaagaagagguacugacagguaaucugcaaacccucaaaauacgcguacacgaaggcuacgaagaauuuaccauggucggaagacgagcaacagccauccuccgaaaagccacaagaagacuaauccagcucauaguguccggacgagacgaacaaaguauagcagaagccauaaucguagccauggucuucucacaagaagacugcaugaucaaggccgugcgcggggaccucaacuucguaaacagggcaaaccaacgccuaaacccgaugcaccaauuacucagacacuuccaaaaagacgcgaaaguucucuuccaaaacuggggcgucgaacccauagacaacgucauggggaugaucgggauccugcccgacaugacgccauccaucgaaaugagcaugcggggagugcggaucaguaaaaugggaguagacgaauacuccagcacagaacgagugguaguaagcaucgaccgauuccuacgcguacgagaccaaaggggcaacgugcugcucuccccggaagaagugagcgaaacacaggggaccgaaaaacuaaccaucacauacagcagcucaaugaugugggaaaucaacggaccggaaucaguccucguuaacacguaucaauggaucauccgcaacugggaaaccgucaagauccaauggagccaaaacccgacgaugcucuacaacaaaauggaguucgaacccuuccaaagccuaguacccaaagccauaagaggacaauauagcggauucguacggacacucuuccaacaaaugcgggacgugcucggcaccuucgacacagcacaaaucauaaaacuacuccccuucgcggccgcaccgccaaaacagucacgaaugcaauucucauccuucaccgucaacguaaggggaaguggaaugagaauccugguccggggcaacagcccagucuucaacuacaacaaagcuaccaaaaggcuaaccguccuaggaaaggacgcaggcacacuaacggaagacccagacgaaggaacagccggcguagaauccgccguccuccgcggauuccucauccucggaaaagaagacagaagauacggcccggcccucagcauaaacgaacucucaaaccuggccaaaggugaaaaagcaaacguacuaauugggcagggagacguaguucuaguaaugaagcgaaaacgagacagcaguaucuuaacagacucccaaacagcuaccaaacgcauccgcauggcaauaaac

SEQ ID NO: 59026 - RNA, 2472 nt, Artificial Sequence
  derived and/or modified sequence opt11 from anti-influenza_Chain
augaugcuacgcaagaaaacgaaacaacucaucagcucaauacucauccucguauuacuacuaagccuguucccagccgcacuggcagcagaaggcaacacacgcgaagacaacuucaaacaccuccuugggaacgacaacguaaaacggccaagcgaagcaggagcccuccaacuccaagaaguagacggccaaaugacccuaguagaccaacacggagaaaagauacaacuccgcggcaugagcacgcacggacuacaaugguucccagaaauacugaacgacaacgccuacaaggcacugucaaacgacugggauagcaacaugaucaggcucgcgauguacguaggcgaaaacggcuacgcaacaaacccagaacuaauaaaacaacguguaaucgacggcauagagcucgccauagaaaacgacauguacguaaucgucgacuggcacguacacgcgcccggagaccccagagauccgguauacgcaggcgcgaaagacuucuuccgagaaauagccgcacuauauccaaacaacccacacaucaucuacgagcuagccaacgaaccauccuccaacaauaacgguggagcaggaauacccaacaacgaagaaggauggaaagcagucaaagaauacgcggacccaaucgucgaaauguuacgaaaauccggcaacgcagacgacaacauaauaauaguggggagccccaauuggagccaacgaccggaccucgccgcagacaacccaaucgacgaccaccacacaauguacacaguccacuuuuacacaggaucacacgcagcuagcaccgaguccuaucccuccgagacccccaacucagaacggggaaacgucauguccaacacucgauacgcccucgaaaacggagucgcgguauucgcaacagaguggggaacaagccaagcgagcggagacggaggaccauacuucgaugaagccgacgucuggauagaguuccugaaugaaaacaacauaucaugggccaacuggucauuaacaaacaaaaacgaagucagcggcgccuucacccccuucgaacucgggaaaucaaacgcgacaaaccuagaccccggacccgaccacgucugggcaccagaagaacugagccuauccggggaguacgucagggccagaauaaaaggcguaaacuacgaacccauagaccgcaccaaauacacgaaaguacucugggacuucaacgacgguaccaaacaaggguucggagucaacagcgacucgccgaacaaggagcuaaucgcagucgacaacgaaaacaauacccugaaagucagcggccuagacgugagcaacgacgucagcgacggcaacuucugggccaacgcacgacuuagcgcaaauggauggggcaaaagcguugacauacucggcgcagaaaaacuaacuauggacgucauagucgacgaaccgaccacgguagccaucgccgccauaccccaaagcagcaaaagcggcugggcaaacccagaacgcgcgguacgcgucaacgcagaggacuucguccaacagacggacgggaaauacaaagcagggcuaacaaucacgggagaagacgcaccaaaccucaaaaacaucgcauuucacgaagaagacaacaacaugaacaacauaauacucuuugucggcaccgacgccgccgacgugauauaccuagacaacauuaaagucauaggaaccgaaguagaaaucccagucguucacgaccccaagggggaggcaguacuuccgucaguauucgaagacggaacgagacaaggaugggacugggcaggcgagagcggcgucaaaacagcacugaccauagaagaagcgaacggauccaacgcccuaagcugggaguucggguaccccgaagucaaacccuccgacaauugggccaccgcacccaggcuagacuucuggaaaagcgaccucgugagaggggagaacgacuacguagcauucgacuucuaccucgacccagucagagccaccgagggggccaugaacauaaaccucgucuuucagccgcccaccaauggguauuggguccaggcaccaaagaccuauacgaucaacuucgacgaauuagaagaggccaaccaaguaaacgggcucuaccacuacgaagucaaaauaaacgucagagacauaacgaacauccaagacgacacacuccuccgaaacaugaugauaaucuucgcagacguagagagugacuucgccggacgaguauucguggacaauguaagauucgaaggcgcagcaacaacagaacccguggaacccgaaccaguagaucccggggaagagacacccccaguggacgagaaagaagccaagaaagaacaaaaggaagcagaaaaagaagaaaaagaagccgucaaagaagaaaagaaagaagccaaagaagagaaaaaggcggugaaaaacgaagccaaaaagaaa

SEQ ID NO: 59027 - RNA, 2472 nt, Artificial Sequence
  derived and/or modified sequence opt11 from anti-influenza_Chain
augaugcuacgcaagaaaacuaaacaacucaucagcagcauacuuauccuaguacuccucuuaagccucuucccagcggcacucgcagcagaaggaaacacgcgagaagacaacuucaagcaccuccucgggaacgacaaugucaaacgaccgagugaagcaggggcacuccaauuacaagagguagacgggcaaaugacacucguagaccaacauggagagaaaauccagcuacggggaaugagcacucacggccuccagugguuuccugaaauacuaaacgacaacgccuacaaagcccucuccaaugacugggacagcaacaugauccgacucgcaauguacguaggagaaaacggcuacgcaacgaacccagaacucauaaaacaaagggucauagacggcaucgagcuagccaucgaaaacgacauguacgucaucguggacuggcacgugcacgcccccggcgacccucgagaccccguauacgcgggcgccaaagacuucuuccgcgaaauagcugcccucuauccaaacaacccccacaucauauacgaacuagcgaacgaacccuccagcaacaacaacggaggggcaggaauccccaacaacgaagaaggcuggaaagcaguaaaggaauacgcggacccuauagucgaaaugcuaagaaaaagcggaaacgcggacgacaacauaaucauugucgggagcccaaacuggagccagcgaccagaccuagccgcggacaacccaauagacgaccaccauacuauguacaccguccacuucuacacaggaucgcacgccgccagcacagagucauaccccuccgaaacgccaaacagcgaaaggggcaacguaaugucuaacacacgcuacgcacucgaaaacggcguagccguauucgccacagaauggggaaccagccaagccaguggcgacggaggaccguacuucgacgaagccgacgucuggauagaguuucuaaacgagaacaacauaagcugggccaacuggagccucaccaacaaaaacgaaguaagcggcgcauucacaccauucgaacucggcaaaaguaacgccacgaaccuagauccagggccggaccacguaugggccccggaagaacuaucacucuccggggaauauguacgagcacgcauaaagggggucaacuacgagcccauagacagaacaaaauacaccaaaguucuuugggacuuuaacgacggcacgaaacaggguuuuggcgucaacuccgacagccccaacaaagaacucauagcaguagacaacgagaacaacacucuuaagguguccggacuagacguaucaaacgacguaagcgacggcaacuucugggcuaacgccaggcuuagcgcaaacggcugggggaaguccguagacauccuaggcgccgaaaagcuaacgauggacguaaucguagacgaaccaacaaccguagcaaucgcagcgauaccgcaaagcucaaagagcgguugggccaaccccgaacgcgccguccgagucaacgcagaagacuucguacaacagaccgacggcaaauacaaggcaggacuuaccaucacaggcgaggacgccccgaaccucaaaaacauagccuuucacgaagaagacaacaacaugaacaacauaauccucuucgucggcaccgacgcagccgacgucauauaccuagacaacauaaaggucaucggaaccgaggucgaaauaccgguaguccaugauccaaaaggcgaagcagugcuccccagcguauucgaagacgggaccagacaaggcugggacugggccggagaaucgggaguaaaaacagcacugacaauagaagaagcaaaugggaguaacgcacugagcugggaguucggauacccagaaguaaaacccagcgauaacugggccacggcaccccgccuagacuucuggaaaagcgaccucguacgcggcgaaaacgacuacguggcguucgacuucuaccucgaccccguacgggcaacagaaggagcaaugaacauaaaccuaguauuccaaccgcccaccaacggauacugggugcaagcacccaaaacuuacaccaucaacuucgacgaacuggaggaagcaaaccaagucaacgggcuauaccacuacgaagugaaaaucaacguucgcgacaucacgaacauacaagacgacacacuacuccgcaauaugaugauuaucuucgccgacguagaaagcgacuucgcgggucgcgucuucguagacaacguacgcuucgaaggagcggcgacaacagaaccaguagaacccgaacccguggacccaggagaggaaacgcccccgguagacgaaaaggaagccaagaaagaacaaaaagaagccgaaaaagaagagaaagaagcugucaaggaggaaaagaaagaggcaaaggaagaaaagaaagccgucaaaaacgaggccaaaaagaaa

SEQ ID NO: 59028 - RNA, 3063 nt, Artificial Sequence
  derived and/or modified sequence opt11 from anti-influenza_Chain
auggccggcccacacaggagccgagcagcaggaccgccacccuucgccgucgacgaacacguagcgcuagagaugguagcuuucagaggagaagucuucgccggccacggccuacucgccgaccaacgacuuauugcgcacacaggcagaccugcccuaaacgcacaaagaauaacacaacaaaaacagcgagaccaaugccgaggacaacgacaccggcaccaccaaggaggucgaaaccuccgaaaagcucaccgcacguuccacgaacaccaguccacgcaagaccaagcacacgaugccccacacggccaacaggcaaaaacagggcacgaaggccugggccaugaacacgcacaagcccagcaccaacaaggucagucgaacguaguagacagacaggacggggaacccguggaggcacagcaccaaaaagacggcgcacaacgcgccggcaacgcacccgcgggacgagucgaacuagaacaacagccaguagaagcacaacaucaacagcaagagggcgacguuagaauaggaaaacgacgacaaaacgccuuugcaccgccugcacuagaccacguccauggcggaccaggccgccuacaaagacacggacucgcaguagaacgccacgucccggccguccaacagcaccagcagcgaguacaacgcggacgccaacaaauagaccauguccuaggccauggccuacccggccgccaacgccuugccuuccgcgacggcccaagacgaccuguaggaguagccucccccguacucggacagagaccauguccuggacaccggaucguacaaaaccucuuccgucacggaaucgacccgugcagagucggacguugccgccgaucaccgagcgagcugcacgguauggggugcgcagacguccgagcaagaggccacgggcgacacaugcgcggacaacgagaugagcacccggguagaggcagaccuugcgcccgccgcagacacgucgacgacgacagagaccgcacaccacaagaaaaacuauacgacguagcaagaggcuuagacgaaccagcccgaagaguccauuucgacgaugaggcagacagauccguauuccgaggccuagcccaaccagcccccgaugaacccgaaggccgaagacgagaccgccuaguacugcagcgacaaucagugaaccacaggagaggacgcuuaagcaggcaccgucaacaacaccagccacagcaacagagaccccacgggaaccaagcauuccuaggcaaauacgagaaaagacggagaaaaccuaccgcaugccucaagucgcuacgacguuucccagacaaggacgcaccaguacucuauuucgugaaccaacucgagaaaaccaaacggaggaugacccugcuauuagucuggcuaauauucacggguguagccggcgaaauacgacucgaagcagaagacggcgaacuacucggaguagccguagacagcacacuaacagguuacuccgggcgagguuaugucacgggauuugacgcgccagaagacucagucagauucuccuucgaagcaccaaggggaguauaccgcguugucuucggagucucauucaguucacgauucgccuccuacgcacuccgggucgacgacuggcaccaaacaggaagccugauaaaacgaggaggcggauucuucgaagccagcaucggcgagauuuggcuagacgaaggcgcucacaccauggcuuuucaacuaaugaacggugcccuugacuacgugagacucgaaccgguaucauacggaccaccagcacgcccaccggcccaacucucugacucacaagcgaccgcgagcgcacaagcccucuucgcauuucuacugucagaauacgguagacacauacuagcaggacaacaacaaaaccccuaccgcagagacuucgacgcaaucaacuacguccgcaaugucacaggaaaagaacccgcccuugucucauucgaccucauugacuacucaccaacccgcgaagcacacgggguaguacacuaccagacaccagaagacuggaucgcaugggcaggccgggacggcaucguaucacucauguggcacuggaaugccccaaccgaccucauagaagacccaagccaagacugcuacuggugguacggcuucuacaccagaugcacuacguucgacgucgcagcagcccuagcagacacauccagcgaaagauacagauugcuacucagggacaucgacgucaucgcggcccaacuccagaaauuccaacaggccgacauccccguccuauggcggccacuacacgaagccgccggagggugguucugguggggcgcaaaagggcccgaaccauucaaacaacuauggcgauuacuuuacgaaagacucgugcaccaccauggguugcauaaccuaauauggguauauacccacgaaccaggugccgccgaaugguaccccggagacgcauacguagacauaguaggacgcgacguauacgccgacgacccagaugcccugaugagaucagacuggaacgagcuccaaacucuauucggcggccguaagcuagucgcgcuaacagagacggguacacuacccgacguagaaguaauaacagacuacggcauaugguggagcugguucuccaucuggaccgacccauuuuuaagagacgucgauccagaccggcucacacgcguguaucacagcgagcgagucuuaaccagagacgaauuacccgacuggagaagcuacgucuuacacgcaaccaccguacagcccgcaggggaccucgcgcuagcaguauaccccaacccaggagccggacgacuccacguagaaguuggcuuaccugucgcagccccaguaguaguagaaguauucaaucuucucggacaacgaguguuccaauaccaagcagguaugcaacccgcaggccucuggcgccgagccuuugagcucgcgcucgcgccaggagucuaccucguacagguacgcgccggaaaccuaguagcaagaagaagguggguaucuguccgu

SEQ ID NO: 59029 - RNA, 3063 nt, Artificial Sequence
  derived and/or modified sequence opt11 from anti-influenza_Chain
auggcgggaccccacagaagcagagccgcggggcccccacccuucgccguagacgaacauguggcgcuagaaaugguggccuucagaggcgaaguauucgccggccauggccuccucgcagaccaacgacucaucgcccacacuggaagacccgcccucaacgcgcaacgaauaacccaacaaaaacagagagaucaaugccgaggucaaaggcacagacaccaccagggcggcagaaaccuacgaaaagcgcacagaaccuuccacgagcaccaaucaacacaagaccaagcacacgacgcaccacacggccaacaagcaaaaaccggacacgagggacucggccacgaacacgcccaggcacaacaccaacaaggacagaguaacgucguagaccgccaggauggcgaaccgguagaagcgcaacaucaaaaggacggcgcgcaaagagccggcaacgcacccgcagggagaguagaacuggaacaacaaccgguagaagcgcaacaccagcaacaagaaggcgacguacgaaucgggaaacgacgacaaaacgccuucgcgcccccagcccucgaccauguacacggagggcccggucgacugcagagacauggccucgcaguugagcgccacguaccagcaguccaacaacaucaacaacgcguccaaagagggcgacaacagaucgaccacguacuaggccacggucucccaggaagacaacgacucgcguuccgagacggaccacggcgcccaguaggcguagccuccccaguacucggccaacgccccugcccaggccacagaaucguacagaaccucuuuagacacggaauagaccccugccgagucggacgaugccgacgcagccccagcgaacuacacggaauggguugcgccgacguaagagcgcggggacacggcagacauaugcgaggacaaagagacgaacacccagggcgaggaagaccaugcgcacgaagaagacacgucgaugacgaccgagacaggacgccccaagaaaaacuauacgacguggcacgcggacuagacgagccagcacggagaguccacuucgaugacgaagccgaccggagcgucuucagaggacuagcccaacccgcaccggacgagccggaaggccgcagacgcgaucgccuaguauuacaaagacaaagcguaaaccaccgaaggggucgucuaucccgacaucgccaacaacaccagccccaacaacaacguccacacggaaaccaggcuuuccuaggaaaguacgaaaaacggagacggaaaccaaccgcgugccuaaaaagccugcggcgcuucccagacaaagacgcaccuguacucuacuucguaaaccagcuagagaaaaccaaacgccgcaugacgcuccuacucguguggcugauauuuacuggcgucgcaggcgaaauaagacucgaagcagaagacggcgaacuccuaggcgucgccgucgacuccacacuaacaggauacucgggacgcggcuacgucacaggcuucgaugcccccgaagauuccgugagauucuccuucgaggccccgcgaggaguauaccggguaguauucggcguaucuuuuagcucacgauucgcuagcuaugcgcugagaguagacgacuggcaccaaaccgggagccuuauaaagaggggaggcggauuuuucgaagcaucuauaggagaaauauggcuagacgaaggggcacacacaauggcauuccaacucaugaacggcgcacuagauuacguucgcuuagagccaguauccuacggaccgcccgcccgcccacccgcacagcucagcgacucccaagcuacagcgagcgcccaagcacucuucgccuuccuacucuccgaauauggaagacacauacuagcagggcaacaacaaaaccccuacagacgcgacuucgacgccauaaacuacguacgaaacgucacuggaaaggaaccagcccuaguauccuucgaccuaauagacuacucccccacccgagaggcacacggaguaguccacuaccagacacccgaagauuggauagcgugggcaggccgcgacggcaucguuucauuaauguggcacuggaacgcacccacagaccucaucgaagaccccucgcaagacugcuacuggugguacggauuuuacacccgaugcacaacuuucgacgucgcagcagcacucgccgacacaagcucugaacgcuaccgacuccucuuacgagacauagacguaauagcagcacaacugcagaaauuccaacaagcagacaucccaguccuauggagaccacuccacgaggccgcaggaggaugguucugguggggagcaaaaggccccgaaccauucaaacaacucuggcgacuacucuacgaacgacucguccaccaccacggcuuacacaaccugaucuggguauacacccacgaaccaggggcugcggagugguacccaggcgacgcauacguagacaucgucggacgagacgucuaugccgacgaccccgacgcgcuaaugcgcucagacuggaacgaauuacaaacgcuuuucgggggcaggaaacucguagcccucacagaaacggguacccuaccagacguagaaguaaucacggacuacggaaucuggugguccugguucagcauauggaccgacccauuucuacgagacgucgacccagacagacucacucgcguguaccacagcgagcgcguccuuacccgcgacgaacucccugauuggagaaguuacgugcuccacgcgacaacgguccaacccgcaggcgaccuugcccuagcaguguacccuaaccccggagcgggucgccuacacguggaagucggacuaccaguagcugcaccagucgucguagaagucuuuaaucuguuaggccagcgcgucuuccaauaccaagcaggaaugcaaccggccggccuuuggcgacgcgcuuucgaacuggcccuugcgcccggcguauaccuuguccaagucagagcgggaaaccuaguugcccgccgucgauggguguccguacgg

SEQ ID NO: 59030 - RNA, 3165 nt, Artificial Sequence
  derived and/or modified sequence opt11 from anti-influenza_Chain
augcgcaagaagcggcgcggcuuccugaacgccagcacagccgugcucgucgggauccuggcgggcuuccuaggcguggugcucgccgccaccggcgcccugggguucgccguccgggagucccuccuccugaagcaguucuuauuccucagcuucgagggcaacacggacggcgccucccccuucgggaaggacgugguggucaccgccagccaggacguggccgccgacggcgaguacucccugaagguggagaaccgcaccuccgucugggaugggguggagaucgaucugaccggcaaagugaacacggggaccgacuaccuccuguccuuccacgucuaccagaccagcgacucaccgcagcuguucagcgugcuggcgcggaccgaggacgagaagggcgagcgcuacaagauccuggccgacaagguugucgugcccaacuacuggaaggagauccuggugcccuucucccccacguucgagggcacgccggccaaguucagccucaucaucaccucccccaagaagacugacuucgucuucuacguggacaacgugcagguccugacgcccaaagaggccgggcccaaagugguguacgagaccagcuucgagaagggcaucggggacuggcagccgcggggcuccgacgucaagauuagcaucucccccaagguggcccacagcggcaagaagucccucuucgucagcaacaggcagaagggguggcacggcgcgcagaucagcuugaaggggauccuuaagaccggcaagaccuacgccuucgaagccuggguguaccaggaguccgggcaggaccagacuaucaucaugaccaugcagcggaaguacagcuccgacagcuccaccaaguaugaguggaucaaagccgccaccguccccagcggccaguggguccagcuguccggcacguacaccauccccgcgggggugaccguggaggaccucacacuguacuucgagucccagaacccgacgcuggaguucuacgucgacgacgugaagguggucgacaccaccuccgccgagaucaagcucgagaugaaccccgaggaggagauccccgcccugaaggacgugcugaaggacuacuuccgcgugggcgucgcccuccccagcaagguguuuaucaaccagaaggacaucgcccugaucuccaagcacagcaacuccagcaccgcggagaacgagaugaagccggacucccuucucgccgggaucgagaacggcaagcugaaguuccgguucgagacggccgacaaguacauagaguucgcccagcagaacgggauggugguccgcggccacacccugguguggcacaaccagacccccgagugguucuucaaggacgagaacggcaaccuccugagcaaggaggagaugaccgagcggcugcgcgaguacauccacacgguggucggacauuucaagggcaagguguacgccugggacguggucaacgaggcgguggaccccaaccagcccgacgggcuccggcgcuccaccugguaccagaucaugggccccgacuacaucgagcuggccuucaaguucgcccgggaggccgaccccaacgcgaagcuguucuacaacgauuacaacaccuucgagcccaagaagcgcgacaucaucuacaaccuugucaagucucugaaagaaaaggggcugaucgacggcaucggcaugcagugucauaucucccucgccaccgacauccggcagaucgaggaggccaucaagaaguucagcacgauacccgggaucgagauccacaucaccgagcuggacaucagcguguaccgcgacuccacaagcaacuacuccgaggcgccgagaaccgcccugaucgagcaggcgcacaagauggcccagcuguucaagaucuucaagaaguacagcaacgugaucaccaacgugacguucuggggcuuaaaggacgacuacuccuggcgcgccacccgccggaacgacuggccacugaucuucgacaaggacuaccaggccaagcuggccuacugggcgaucgucgcccccgaggugcugcccccgcuccccaaagagaguaagaucuccgagggggaggccguggucgugggcaugauggacgacagcuacaugauguccaagcccauugagaucuacgacgaggagggcaacgugaaggccaccauccgcgccaucuggaaggacagcaccaucuacgucuacggagaggugcaggacgcgacgaagaagccggcggaggacggcguggccaucuucauaaaucccaacaacgagcggacccccuaccugcagcccgacgacaccuacgucgugcucuggaccaacuggaaguccgaggugaaccgcgaggacgucgaggugaagaaguucgugggaccgggcuuccggcgcuacagcuucgagauguccaucacgauccccggggucgaguucaagaaagacagcuacaucggcuucgacguggccgugaucgacgauggcaagugguacuccuggagcgacaccaccaacucccagaagaccaacacgaugaacuacgggacccugaagcuggagggcguuaugguggcgaccgccaaguacgggacccccgugaucgacggcgagauagacgacaucuggaacacgaccgaggagaucgagaccaagagcgucgccauggggagccucgagaagaacgccaccgccaaggugcgggugcugugggacgaggagaaccuguacguccucgcgaucgugaaggaccccguccugaacaaggacaacuccaacccgugggagcaggauagcguggagaucuucaucgacgagaacaaccacaagaccgguuacuacgaggacgacgacgcccaguuccgcgugaacuacaugaacgagcaguccuucggcaccggggccagcgccgcccgguucaagaccgcggucaagcugaucgagggcggguacaucguggaggccgccaucaaguggaagaccaucaagcccucccccaacacggugauaggcuucaacguccaggugaacgacgccaacgagaaggggcagcgcgugggcaucaucagcuggucagaccccaccaacaacagcuggcgggacccguccaaguucggcaaucuacgccugaucaaa

SEQ ID NO: 59031 - RNA, 3165 nt, Artificial Sequence
  derived and/or modified sequence opt11 from anti-influenza_Chain
augcgcaagaagcggcgcggcuuccugaacgccagcaccgccgugcucgucgggauccuggcgggcuuccuggggguggugcucgccgcgaccggcgcccugggguucgccgugcgggagucccugcuccugaagcaguuuuuauuccucagcuucgagggcaacacggacggcgcgucccccuucgggaaggacgugguagucaccgccagccaggacguggccgccgacggagaguacucccucaagguggagaaccgcacgagcgucugggacgggguggaaaucgaccugacgggcaaggugaacacggggaccgacuaccuccuguccuuccaugucuaccagaccagcgacuccccgcagcuguucagcgugcucgcgcggaccgaggacgagaagggcgagcgcuacaagauacuggccgacaagguggucgugccuaacuacuggaaggaaauccuugugcccuuuucccccacguucgagggcaccccggccaaguucagccucaucaucacgucccccaagaagaccgacuucgucuuuuacguggacaacgugcagguccugacgcccaaggaggcugggcccaaggugguuuacgagaccagcuucgagaagggcaucggggacuggcagccgcggggcuccgacgucaagaucagcaucagccccaagguggcccacagcggcaagaagucccuguucgucucgaaucgccagaagggguggcacggcgcgcagaucucacucaagggcauccugaagaccgguaaaaccuacgccuucgaagccuggguguaccaggaguccggacaggaccagacgaucaucaugaccaugcagcggaaguacagcuccgacagcuccaccaaguacgaguggaucaaggccgccaccgugcccagcggccaguggguccagcuguccggcacguacaccauccccgcgggggugaccguggaggaccucacccuguacuucgagagccaaaauccgacguuagaguucuacgucgacgacgugaagguagucgauaccaccuccgccgagaucaagcucgagaugaaccccgaggaggagauccccgcucugaaggacgugcugaaggacuacuuccgcgugggcgucgcacuccccagcaagguguucaucaaccagaaggacaucgcccugaucuccaagcacagcaacuccagcaccgcggagaaugagaugaagccggacucgcugcucgccgggaucgagaacggaaagcugaaguuccguuucgagacggccgacaaauacaucgaguucgcccagcaaaaugguauggugguccgcggccacacccucguguggcacaaccagacccccgagugguucuucaaggacgagaacgguaaccuccugucuaaggaggagaugaccgagcggcugcgcgaguacauccacacgguggucggccacuucaagggcaaaguguacgcgugggacgucgucaaugaagcgguggaccccaaucagcccgacgggcuccggcgcuccaccugguaccagaucaugggaccugacuacaucgagcuggccuucaaguucgcacgggaggccgaccccaacgcgaagcuguucuacaacgacuacaauaccuucgagcccaagaaacgcgacaucaucuacaaccucgucaaaagccugaaggagaagggccugaucgacggcauuggcaugcagugccacaucucccucgccaccgacauccgucagaucgaggaggccaucaagaaguucagcacgauuccggggaucgagauccauaucaccgaacuggacaucagcguguaccgcgacuccacuucuaacuacuccgaggccccgcggaccgcccugauugagcaggcgcacaagauggcccagcuauucaagaucuucaaaaaguacagcaacgugaucaccaacgugacguucuggggccucaaggacgacuacucauggcgcgccacccgucgaaacgacuggccccugaucuucgacaaggacuaccaggcuaagcuggccuacugggcgaucgucgcccccgaaguccugcccccgcuccccaaggagagcaagauauccgaaggagaagcaguggucgugggcaugauggacgauagcuacaugaugucgaagcccaucgagaucuacgacgaggagggcaaugugaaggcaaccauccgggccaucuggaaggacagcaccaucuacgucuacggggaggugcaggacgcgacgaagaagccggccgaggauggcguggccaucuucaucaaccccaacaacgagcggacccccuaccugcagcccgacgacaccuacgucgugcucuggaccaacuggaaguccgaggugaaccgcgaggacgucgaggugaagaaguuugugggaccgggcuuccgccgcuacagcuucgagauguccaucacgauccccgggguggaguucaagaaggacagcuacauuggcuucgacguagccgugaucgaugacggcaagugguacuccuggagcgacaccacgaacucccagaaaaccaacacgaugaacuacgggacccugaagcuggagggcgucaugguggcaaccgccaaguacggcacccccgugaucgacggcgagauagacgacauuuggaacaccaccgaggagaucgagaccaaaagcgucgccauggggagccucgaaaagaacgccaccgccaaggugcgggugcugugggacgaggagaaccuguacguccucgcgaucgugaaggaucccguccugaacaaggacaacuccaacccgugggagcaagacagcguggagaucuucauagacgagaacaaccacaagacgggcuauuacgaggacgacgaugcccaguuccgcgugaacuacaugaacgagcaguccuucggcaccggugccagcgccgcccgguucaagaccgcggucaagcugaucgagggcggguacauuguugaggccgccaucaaguggaagacuaucaagcccucccccaacacggugaucggcuucaacguccaggucaacgacgccaacgagaagggccagcgcguuggcaucauaagcugguccgaccccaccaacaacagcuggcgggacccguccaaguuuggcaaccuccgccugaucaaa

SEQ ID NO: 59032 - RNA, 3177 nt, Artificial Sequence
  derived and/or modified sequence opt11 from anti-influenza_Chain
augcagguuagaaaacgccgagggcugcucgaugugagcaccgcggugcucguaggaauacuagcaggauuccuagggguaguccuggcagcgagcggagugcuaucguucggcaaggaggccucaucgaaaggcgacucaucccuagaaacagucuuagcccucagcuuugaaggcaccaccgaaggggucguacccuucgguaaggacguaguccucaccgccucacaggacguagcugccgacggggaauacucccuaaagguagaaaaccgcaccucccccugggacggcguggagaucgaucuaaccggaaaaguaaaauccggcgcagacuaccugcugagcuuccaaguguaccaaagcucggacgccccacaacuguucaacgucgucgcacgcacggaggacgaaaaaggugaacgauacgacguaauacucgacaaggucgucguaucagaccacuggaaggaaauucucguaccuuuuagccccaccuucgagggcaccccagcaaaauacagccuaauuauagucgccuccaaaaacacgaacuucaacuucuaccucgacaaaguacaaguacuagcgccaaaagaaucaggaccuaaagugauauacgaaacaucauucgaaaacggcgucggcgacuggcagccccgaggugacgucaacauagaggccagcuccgaaguagcgcacagcggaaaauccucacuguucaucucaaaccgccagaaaggcuggcagggagcacaaaucaaucuuaagggaauccuaaaaaccggaaaaacguacgcauucgaggccuggguguaccagaacagcggacaggaccaaacaaucauaaugaccaugcagaggaaauacucaagugaugcauccacgcaauacgaguggauaaagucagcgacagucccaagcggccaauggguccaacuaagcggcaccuacacaauaccagcaggggugacaguagaagaucucaccuuauacuucgagagucagaaccccacccuagaauuuuacguagacgacgucaaaaucgucgauaccacaagcgccgaaauaaaaauugaaauggaaccggagaaggagaucccggcccuaaaggaaguacucaaggacuauuucaaaguaggagucgccuuaccaucaaaaguauuccucaaccccaaggacauagaacucaucacaaaacacuuuaacuccauaaccgcagaaaacgagaugaaaccagagucccuuuuagccggaaucgagaacggaaaacuaaaguuccgauucgaaaccgcugacaaauacauccaauucguagaagagaacggcauggucauacgaggacacacacucguguggcacaaccaaaccccagacugguucuucaaagaugagaacgggaaucuucucucaaaagaagccaugaccgaaagacugaaagaauacauccacacagucguaggccacuucaaaggcaaaguauacgcaugggacgucgucaacgaagcaguagacccgaaccaacccgacggauuacgacgcuccaccugguaccaaauaauggggcccgauuacaucgaacuggcauucaaauucgcccgcgaagcagaccccgacgcuaaacuuuucuacaacgacuauaauacauuugagccccgcaaacgagacauaaucuacaaccucgucaaagaccucaaagagaaagggcuuaucgacgggaucggcaugcaaugccacauaagccuugcaaccgacaucaaacaaaucgaggaggccauaaagaaguucucgaccauaccgggaaucgaaauccacauaaccgagcuugacaugagcguauaccgagacagcuccagcaacuacccggaggcaccccgaacggcgcuaaucgaacaagcgcacaagaugaugcagcuguuugaaaucuucaagaaguacucaaacguaauaaccaacguaacauucuggggccucaaggacgacuacagcuggcgcgcaacucgccgcaacgauuggccccucauauucgacaaagaccaucaagccaaacuagccuacugggcgaucgucgcccccgagguccucccaccccuccccaaagaaucccgaaucuccgaaggagaggcaguagucgucggcaugauggacgacuccuaucucaugagcaaacccaucgaaauccuagacgaagaagguaacgucaaagccaccauaagagcaguauggaaagacagcaccaucuacauauacggggaaguacaagacaaaacgaaaaagccggccgaagacggcguagcaauauucauaaacccaaauaacgagcguacuccauaccuccaaccagacgacaccuacgccguccucuggaccaacuggaaaaccgaaguaaaccgagaggacguccaggucaagaaauuugucggaccaggguuccgaagauacagcuucgaaaugagcaucacaaucccaggcgucgaguucaagaaagacaguuacaucggauucgacgcagcaguaauagacgauggaaaaugguacucuuggagcgacaccaccaauucacagaaaacuaacaccaugaacuauggaacccucaaacuagaaggcaucauggucgcgaccgcaaaguacggcacgcccguaauagacggcgaaauagaugaaaucuggaauaccacagaagaaaucgagaccaaagccguggccaugggaucccuggacaaaaacgccaccgcaaaagucaggguacuaugggacgaaaauuaucuauacgucuuagccaucgucaaagaccccguccucaacaaagacaacucaaacccaugggagcaagacagugucgagauauucaucgacgaaaacaaccacaagaccggauauuaugaagaugaugaugcacaauuccgaguaaacuacaugaacgaacaaaccuucggaaccggcgggagcccagcacgguucaaaaccgccgucaaauuaaucgaaggaggcuacaucguggaggcagccauaaaauggaagaccaucaagccaacgccaaauacaguaauaggauucaauauacaggugaaugacgccaacgaaaaaggccaacgcgugggcauaauuagcuggucagaccccaccaacaauucauggcgcgacccauccaaguucgggaaccuucgccuaaucaaa

SEQ ID NO: 59033 - RNA, 3177 nt, Artificial Sequence
  derived and/or modified sequence opt11 from anti-influenza_Chain
augcagguacggaaacgccgaggacuacuggacgucagcacagcuguccuaguaggaauccuagcaggguuccucggggugguacucgcagccuccggcgugcucagcuucggaaaggaagccaguucgaaaggggacagcagucuagagacaguccuagcccucagcuucgaaggcacaaccgaaggcguggucccuuucggaaaagacgucguccuaaccgcaagccaggacguagcagccgacggcgaguacagccucaaagucgaaaaccgaacauccccaugggacggagucgaaaucgaucuaaccggcaaagucaaaucuggcgccgacuaccuccucagcuuccaaguuuaccaaagcuccgacgcaccacagcuuuuuaaugucgucgcccgcacggaggacgaaaaaggagagagguacgacgucauccucgacaagguagucguauccgaccacuggaaagaaaucuuaguaccauucucgccaacguucgaaggcacgccagcaaaauacagccuaauaauaguggcgagcaaaaacaccaacuucaacuuuuaccucgacaaaguacagguacuagccccgaaggaaucaggccccaaggucaucuaugaaacauccuucgaaaacggcgucggcgacuggcaaccaagaggggacguaaacauagaagcgucauccgaagucgcacacucaggcaaaagcucacuguucauaaguaacaggcagaaaggcuggcagggcgcacaaauaaaccugaaagggauucuaaaaacaggcaagaccuacgcauucgaagcguggguguaccaaaacucaggccaggaccaaacgauaaucaugacaaugcaacgcaaguacucguccgacgccagcacgcaauacgaguggauaaagucggcaacagugccaagcgggcaauggguccagcuaagcggcacguacacgauaccagccggcgucacaguugaagaucucacgcuauacuuugaaagccaaaaccccacacuagaguucuacgucgacgacguaaaaaucgucgacacgaccagcgccgaaaucaagaucgaaauggaacccgaaaaagaaaucccagcccuaaaagaaguccuaaaagacuacuucaagguaggagucgcccuacccaguaaagucuuccuaaacccgaaagacauugaacugaucacaaaacacuucaacaguauaaccgcagaaaacgagaugaaaccagagagccuccuagccggcaucgaaaacggcaagcuaaaauuccgcuucgaaacagcagauaaguacauucaauucgucgaagaaaacggcauggugauacguggacacacccuagucuggcacaaccaaaccccggacugguucuucaaagacgaaaacggcaaccugcuaucuaaagaggccaugacagaacgacucaaagaguacauacacaccguaguaggacacuucaaagggaaaguuuacgcgugggacguaguaaaugaggccgucgauccaaaccagcccgacggacucagacgcucaacaugguaccaaaucaugggcccggacuacaucgaacucgccuuuaaguucgccagggaagcagacccagacgccaaacuguucuacaacgacuacaacaccuucgaaccgcggaagagggacaucaucuacaaccucgugaaagacuugaaagagaaaggucugauagacggcaucggcaugcaaugccacauaagccuagccacugacauaaaacaaaucgaggaagcuaucaagaaauucagcacaauacccggaaucgaaauucacaucaccgaacuggacaugucagucuaccgagacucgucgucgaacuauccagaagcaccccgaacggcccucaucgaacaagcacacaaaaugaugcaacucuuugaaauauucaagaaauauucgaacguaaucacaaacguuaccuucuggggccucaaagacgacuacucuuggagggcaacccgacgcaacgacuggccauuaaucuucgacaaagaccaucaagcuaaacucgcauacugggcaaucgucgcgcccgaaguacugccaccccuacccaaagaaucccggaucagugaaggcgaagccgucguaguagguaugauggacgacagcuaccugaugagcaaaccaaucgaaauacucgacgaggagggaaacguaaaagcaaccauccgugcuguauggaaagacagcaccaucuacauauacggcgaaguucaagacaagaccaagaaaccagcagaagacggcgucgcgaucuucaucaauccaaacaaugaacgcacccccuaccuacagccugaugacaccuacgccguccuauggaccaacuggaaaaccgagguaaacagagaggacguccaagucaagaaauucgugggcccuggguucagacguuacagcuucgagauguccaucacaauuccagggguagaguucaagaaagacagcuacaucgguuucgaugcggcgguuaucgacgacggaaaaugguacagcuggucagacacgacgaacagccagaaaaccaacaccaugaacuaugggacccuaaaacucgaggguaucaugguagccaccgccaaauauggcacacccgugaucgacggagagaucgacgaaauauggaacaccacagaagaaaucgaaacuaaggcagucgccaugggcagucucgacaaaaacgccacagccaaaguaagaguacuaugggacgaaaacuaccuauauguacucgcgauaguuaaagacccuguacugaacaaggacaacuccaacccaugggaacaagacucgguagaaaucuuuaucgacgagaacaaccacaaaacaggcuacuacgaagacgacgacgcccaauuccgaguaaacuacaugaacgaacaaaccuucggcaccggcggcucaccagcgcgguucaaaacagcaguaaagcucaucgaagggggauacauagucgaggcggcgaucaaauggaaaaccauaaaacccacccccaacaccguaaucggauucaacauacaagucaaugacgcaaacgaaaaaggacaacgggucggcaucaucagcuggagcgaucccaccaauaacucauggcgcgaccccagcaaauucggcaaccuacgucugaucaaa

SEQ ID NO: 59034 - RNA, 318 nt, Artificial Sequence
  derived and/or modified sequence opt11 from anti-OX40_LightChain
gaaaucgucgucacccaaucccccgccacccucucccucucccccggcgaacgcgccacccucuccugccgcgccucccaauccgucuccuccuaccucgccugguaccaacaaaaacccggccaagccccccgacuccucaucuacgacgccuccaaccgcgccaccggcauccccgcccgauucuccggcuccggcuccggcaccgacuucacccucaccaucuccucccucgaacccgaagacuucgccgucuacuacugccaacaacgcuccaacuggcccaccuucggccaaggcaccaaagucgaaaucaaa

SEQ ID NO: 59035 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucaccugccgcgccucccaaggcaucuccuccuggcucgccugguaccaacaaaaacccgaaaaagcccccaaaucccucaucuacgccgccucaucccuccaauccggcguccccucccgcuucuccggcuccggcuccggcaccgacuucacccucaccaucuccucccuccaacccgaagacuucgccaccuacuacugccaacaauacaacuccuacccccccaccuucggcggcggcaccaaagucgaaaucaaa

SEQ ID NO: 59036 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucaccugccgcgccucccaagacaucuccaacuaccucaacugguaccaacaaaaacccggcaaagcccccaaacuccucaucuacuacaccucccgccuccgcuccggcguccccucccgcuucuccggcuccggcuccggcaccgacuucacccucaccaucuccucccuccaacccgaagacuucgccaccuacuacugccaacaaggccacacccucccccccaccuucggccaaggcaccaaagucgaaaucaaa

SEQ ID NO: 59037 - RNA, 321 nt, Artificial Sequence
  derived and/or modified sequence opt11 from anti-OX40_LightChain
gacauccaaaugacccaaucccccuccucccucuccgccuccgucggcgaccgagucaccaucaccugccgcgccucccaagacaucuccaacuaccucaacugguaccaacaaaaacccggcaaaaccgucaaacuccucaucuacuacaccucccgccuccgcuccggcguccccucccgcuucuccggcuccggcuccggcaccgacuucacccucaccaucuccucccuccaacccgaagacuucgccaccuacuacugccaacaaggccacacccucccccccaccuucggccaaggcaccaaagucgaaaucaaa

SEQ ID NO: 59038 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucaccugccgcgccucccaagacaucuccaacuaccucaacugguaccaacaaaaacccggcaaaaccgucaaacuccucaucuacuacaccucccgccuccgcuccggcguccccucccgauucuccggcuccggcuccggcaaagacuacacccucaccaucuccucacuccaacccgaagacuucgccaccuacuucugccaacaaggccacacccucccccccaccuucggccaaggcaccaaagucgaaaucaaa

SEQ ID NO: 59039 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucacaugccgcgccucccaagacaucuccaacuaccucaacugguaccaacaaaaacccggcaaagcccccaaacuccuaaucuacuacaccucccgccuccgauccggcguccccucccgcuucuccggcuccggcuccggcaccgacuucacccucaccaucuccucccuccaacccgaagacuucgccaccuacuacugccaacaaggccacacccuccccgccaccuucggccaaggcaccaaagucgaaaucaaa

SEQ ID NO: 59040 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucaccugccgcgccucccaagacaucuccaacuaccucaacugguaccaacaaaaacccggcaaagcccccaaacuccucaucuacuacaccucccgccuccgcuccggcguccccucccgcuucuccggcuccggcuccggcaccgacuucacccucaccaucuccucccuccaacccgaagacuucgccaccuacuacugccaacaaggccacaccgccccccccaccuucggccaaggcaccaaagucgaaaucaaa

SEQ ID NO: 59041 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucacaugccgcgccucccaagacaucuccaacuaccucaacugguaccaacaaaaacccggcaaagcccccaaacuccucauauacuacaccucccgccuccgcuccggcguccccucccgcuucuccggcucaggcuccggcaccgacuucacccucaccaucuccucccuccaacccgaagacuucgccaccuacuacugccaacaaggcgccacccucccccccaccuucggccaaggcaccaaagucgaaaucaaa

SEQ ID NO: 59042 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucaccugccgcgccucccaagacaucuccaacuaccucaacugguaccaacaaaaacccggcaaagcccccaaacuccucaucuacuacaccucccgccuccgcucaggcguccccucccgcuucuccggcuccggcuccggcaccgacuucacccucaccaucuccucacuccaacccgaagacuucgccaccuacuacugccaacaaggccacgcccucccccccaccuucggccaaggcaccaaagucgaaaucaaa

SEQ ID NO: 59043 - RNA, 321 nt, Artificial Sequence
  derived and/or modified sequence opt11 from anti-OX40_LightChain
gacauccaaaugacccaaucccccuccucccuauccgccuccgucggcgaccgcgucaccaucaccugccgcgccucccaagacaucuccaacuaccucaacugguaccaacaaaaacccggcaaagcccccaaacuccucaucuacuacaccucccgccuccgcuccggcguccccucccgcuucuccggcuccggcuccggcaccgacuucacccucaccaucuccucccuccaacccgaagacuucgccaccuacuacugccaacaagcccacacccucccccccaccuucggccaaggcaccaaagucgaaaucaaa

SEQ ID NO: 59044 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucaccugccgcgccucccaagacaucuccaacuaccucaacugguaccaacaaaaacccggcaaagcccccaaacuccucaucuacuacaccucccgccuccgcuccggcguccccucccgauucuccggcuccggcuccggcaccgacuucacccucaccaucuccucccuccaacccgaagacuucgccaccuacuacugccaacaaggccacacccucgcccccaccuucggccaaggcaccaaagucgaaaucaaa

SEQ ID NO: 59045 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucaccugccgcgccucccaagacaucuccaacuaccucaacugguaccaacaaaaacccggcaaagcccccaaacuccucaucuacuacaccucccgccuccgcuccggcguccccucccgcuucuccggcuccggcuccggcaccgacuucacccucaccaucuccucccuccaacccgaagacuucgccaccuacuacugccaagccggccacacccucccccccaccuucggccaaggcaccaaagucgaaaucaaa

SEQ ID NO: 59046 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucaccugccgcgccucccaagacaucuccaacuaccucaacugguaccaacaaaaacccggcaaagcccccaaacuccucaucuacuacaccuccaaacuccacuccggcguccccucacgcuucuccggcucaggcuccggcaccgacuacacccucaccaucuccucccuccaacccgaagacuucgccaccuacuacugccaacaaggcuccgcccuccccuggaccuucggccaaggcaccaaagucgaaaucaaa

SEQ ID NO: 59047 - RNA, 321 nt, Artificial Sequence
  derived and/or modified sequence opt11 from anti-OX40_LightChain
gacauccaaaugacccaaucccccuccucccucuccgccuccgucggcgaccgcgucaccaucaccugccgcgccucccaagacaucuccaacuaccucaacugguaccaacaaaaacccggcaaagccgucaaacuccucaucuacuacaccuccaaacuccacuccggcguccccucccgcuucuccggcuccggcucccgcaccgacuacacccucaccaucuccucccuccaacccgaagacuucgccaccuacuacugccaacaaggcuccgcccuccccuggaccuucggccaaggcaccaaagucgaaaucaaa

SEQ ID NO: 59048 - RNA, 351 nt, Artificial Sequence
  derived and/or modified sequence opt11 from anti-OX40_HeavyChain
gaagugcaauugguccagagcggagccgaggucaagaaaccgggcgcgagcgugaaagugagcuguaaagcgagcggguacacguucacggacucguacaugagcugggucaggcaagcgcccgggcaagggcucgaguggauaggcgauauguaucccgauaacggggacucgagcuauaaccagaaauuucgcgagcgcguaaccauaaccagggacacgagcacgagcacggccuaucucgagcucucgagcuugcgcucggaagauaccgcggucuauuacugugucuuggccccgcgcugguacuuuagcgugugggggcaagggaccuuggucacggucucgagc

SEQ ID NO: 59049 - RNA, 351 nt, Artificial Sequence
  derived and/or modified sequence opt11 from anti-OX40_HeavyChain
gaagugcaauugguccagagcggggccgaggucaagaaaccgggcgcgagcgugaaagugagcuguaaagcgagcggguacacguucacggacucguacaugagcugggucaggcaagcgcccgggcaagggcucgaguggauaggcgauauguaucccgauaacggggacucgagcuauaaccagaaauuucgcgagcgcgugaccauaaccguggacacgagcacgagcacggccuaucucgagcucucgagcuugagaucggaagauaccgcggucuauuacuguguccuggccccgcgcugguacuuuagcgugugggggcaagggaccuuggucacggucucgagc

SEQ ID NO: 59050 - RNA, 351 nt, Artificial Sequence
  derived and/or modified sequence opt11 from anti-OX40_HeavyChain
gaagugcaauugguccagagcggggccgaggucaagaaaccgggcgcgagcgugaaagugagcuguaaagcgagcggguacacguucacggacucguacaugagcugggucagacaagcgcccgggcaagggcucgaguggauaggcgauauguaucccgauaacggggacucgagcuauaaccagaaauuucgcgagcgcgugacccugaccguggacacgagcacgagcacggccuaucucgagcucucgagccugcgaucggaagauaccgcggucuauuacugugucuuggccccgcgcugguacuuuagcgugugggggcaagggaccuuggucacggucucgagc

SEQ ID NO: 59051 - RNA, 351 nt, Artificial Sequence
  derived and/or modified sequence opt11 from anti-OX40_HeavyChain
gaagugcaacugguccagagcggagccgaggucaagaaaccgggcgcgagcgugaaagugagcuguaaagcgagcggguacacguucacggacgcguacaugagcugggucaggcaagcgcccgggcaagggcucgaguggauaggcgauauguaccccgauaacggggacucgagcuauaaccagaaauuucgcgagcgcgugaccauaaccagggacacgagcacgagcacggccuaucucgagcucucgagcuugcgcucggaagauaccgcggucuauuacuguguccuggccccgcgcugguacuuuagcgugugggggcaagggaccuugguaacggucucgagc

SEQ ID NO: 59052 - RNA, 351 nt, Artificial Sequence
  derived and/or modified sequence opt11 from anti-OX40_HeavyChain
gagguccagcucgugcaaucgggcgcggaagugaaaaagcccggggccucggucaaggucucgugcaaggccucgggcuauaccuuuaccgagagcuauaugucgugggugcgccaggccccgggccagggcuuggaauggaucggggacauguacccggacaauggcgauagcucguacaaucaaaaguucagggaaagggucacgaucacgcgcgauaccucgaccucgaccgcguacuuggaauugagcucgcucaggagcgaggacacggccguguacuauugcgugcucgcgcccaggugguauuucucggucuggggacagggcacgcucgugaccgugagcucg

SEQ ID NO: 59053 - RNA, 351 nt, Artificial Sequence
  derived and/or modified sequence opt11 from anti-OX40_HeavyChain
gaaguccaacucguccaauccggcgccgaagucaaaaaacccggcgccuccgucaaagucuccugcaaagccuccggcuacaccuucaccgacuccuacauguccuggguacgccaagcccccggccaaggccucgaauggaucggcgacauguaccccgacaacgccgacuccucauacaaccaaaaauuccgcgaacgcgucaccaucacccgcgacaccuccaccuccaccgccuaccucgaacucuccucccuccgcuccgaagacaccgccgucuacuacugcguccucgccccccgcugguacuucuccgucuggggccaaggcacccucgucaccgucuccucc

SEQ ID NO: 59054 - RNA, 351 nt, Artificial Sequence
  derived and/or modified sequence opt11 from anti-OX40_HeavyChain
gaaguccaacucguccaauccggagccgaagucaaaaaacccggcgccuccgucaaagucuccugcaaagccuccggcuacaccuucaccgacuccuacauguccuggguccgccaagcccccggacaaggccucgaauggaucggcgacauguaccccgacaacgccgacgccuccuacaaccaaaaauuccgcgaacgagucaccaucacccgcgacaccuccaccuccaccgccuaccucgaacucuccucccuccgcuccgaagacaccgccgucuacuacugcguccucgccccccgcugguacuucuccgucuggggccaaggcacccucgucaccgucuccucc

SEQ ID NO: 59055 - RNA, 351 nt, Artificial Sequence
  derived and/or modified sequence opt11 from anti-OX40_HeavyChain
gaagugcaauugguccagagcggggccgaggucaagaaaccgggcgcgagcgugaaagugagcuguaaagcgagcggguacacguucacggacucguacaugagcugggucaggcaagcgcccgggcaagggcucgaguggauaggcgauauguaucccgauaacggggacgcgagcuauaaccagaaauuucgcgagcgcgugaccauaaccagggacacgagcacgagcacggccuaucucgagcucucgagcuugcgcucggaagauaccgcggucuauuacugugucuuggccccgcgcugguacuuuagcgugugggggcaagggaccuuggucacggucucgagc

SEQ ID NO: 59056 - RNA, 351 nt, Artificial Sequence
  derived and/or modified sequence opt11 from anti-OX40_HeavyChain
gaagugcaauugguccagagcggggccgaggucaagaaaccgggcgcgagcgugaaagugagcuguaaagcgagcggguacacguucacggacucguacaugagcugggucaggcaagcgcccgggcaagggcucgaguggauaggcgauauguaucccgauagcggggacucgagcuauaaccagaaauuucgcgagcgcgugaccauaaccagagacacgagcacgagcacggccuaucucgagcucucgagcuugcgcucggaagauaccgcggucuauuacugugucuuggccccgcgcugguacuuuagcgugugggggcaagggacccuggucacggucucgagc

SEQ ID NO: 59057 - RNA, 351 nt, Artificial Sequence
  derived and/or modified sequence opt11 from anti-OX40_HeavyChain
gaagugcaauugguccagagcggggccgaggucaagaaaccgggcgcgagcgugaaagugagcugcaaagcgagcggguacacguucacggacucguacaugagcugggucaggcaagcgcccgggcaagggcucgaguggauaggcgauauguaucccgauaacgggagcucgagcuauaaccagaaauuucgcgagcgcgugaccauaaccagggacacgagcacgagcacggccuaucucgagcucucgagcuugcgcucggaagauaccgcggucuauuacugugucuuggccccgcgcugguacuuuagcgugugggggcaagggaccuuggucacggucucgagc

SEQ ID NO: 59058 - RNA, 351 nt, Artificial Sequence
  derived and/or modified sequence opt11 from anti-OX40_HeavyChain
gaagugcaauugguccagagcggggccgaggucaagaaaccgggcgcgagcgugaaagugagcuguaaagcgagcggguacacguucacggacgcguacaugagcugggucaggcaagcgcccgggcaagggcucgaguggauaggcgauauguaucccgauaacgcggacgcgagcuauaaccagaaauuucgcgagcgcgugaccauaaccagggacacgagcacgagcacggccuaucuagagcucucgagcuugcgcucggaagauaccgcggucuauuacugugucuuggccccgcgcugguacuuuagcgugugggggcaagggaccuugguaacggucucgagc

SEQ ID NO: 59059 - RNA, 351 nt, Artificial Sequence
  derived and/or modified sequence opt11 from anti-OX40_HeavyChain
gaagugcaauugguccagagcggggccgaggucaagaaaccgggcgcgagcgugaaagugagcuguaaagcgagcggguacacguucacggacucguacaugagcugggucaggcaagcgcccgggcaagggcucgaguggauaggcgauauguaucccgauaacggggacucaagcuauaaccagaaauuucgcgagcgcgugaccauaaccagggacacgagcacgagcacggccuaucucgagcucucgagcuugcgcucggaagauaccgcggucuauuacugugucuuggccccgcgcugguacuuuagcgcgugggggcaaggaaccuuggucacggucucgagc

SEQ ID NO: 59060 - RNA, 351 nt, Artificial Sequence
  derived and/or modified sequence opt11 from anti-OX40_HeavyChain
gaagugcaauugguccagagcggggccgaggucaagaaaccgggcgcgagcgugaaagugagcuguaaagcgagcggguacacguucacggacucguacaugagcugggucaggcaagcgcccgggcaagggcucgaguggauaggcgauauguaucccgauaacggggacucgagcuauaaccagaaauuucgcgagcgcgugaccauaaccagggacacgagcacgagcacggccuaucucgagcucucgagcuugcgcucggaagauaccgcggucuauuacugugucuuggccccgcgcugguacuuugccgugugggggcaagggaccuuggucacggucucgagc

SEQ ID NO: 59061 - RNA, 351 nt, Artificial Sequence
  derived and/or modified sequence opt11 from anti-OX40_HeavyChain
gaagugcaauugguccagagcggggccgaggucaagaaaccgggcgcgagcgugaaagugagcuguaaagcgagcggguacacguucacggacucguacaugagcugggucaggcaagcgcccgggcaagggcucgaguggauaggcgauauguaucccgauaacggggacucgagcuauaaccagaaauuucgcgagcgcgugaccauaaccagggacacgagcacgagcacggccuaucucgagcucagcucauugcgcucggaagauaccgcggucuauuacugugccuuggccccgcgcugguacuuuagcguaugggggcaagggacccuggucacggucucgagc

SEQ ID NO: 59062 - RNA, 351 nt, Artificial Sequence
  derived and/or modified sequence opt11 from anti-OX40_HeavyChain
gaagugcaauugguccagagcggggccgaggucaagaaaccgggcgcgagcgugaaagugagcuguaaagcgagcggguacacguucacggacucguacaugagcugggucaggcaagcgcccgggcaagggcucgaguggauaggcgauauguaucccgauaacggggacucgagcuauaaccagaaauuucgcgagcgcgugaccauaaccagggacacgagcacgagcacggccuaucucgagcucucgagcuugcgcucggaagauaccgcgguauauuacugugucgcggccccgcgcugguacuuuagcgugugggggcaagggaccuugguaacggucucgagc

SEQ ID NO: 59063 - RNA, 354 nt, Artificial Sequence
  derived and/or modified sequence opt11 from anti-OX40_HeavyChain
gagguccagcucguggaaucgggcgggggcuugguccagcccgggggcucgcucaggcucucgugcgcggccucaggcuuuaccuuuagcucguacucgaugaauugggugcgccaggccccgggcaagggcuuggaaugggucucguacauaagcucgagcucgagcacgaucgauuacgcggacucggucaagggcagguucacgaucucgcgcgauaacgcgaaaaauagcuuguacuugcaaaugaacucgcucagggacgaggacacggccguguacuauugcgcgcgcgagagcgggugguaucucuuugacuauugggggcaagggaccuuggucacggucucgagc

SEQ ID NO: 59064 - RNA, 363 nt, Artificial Sequence
  derived and/or modified sequence opt11 from anti-OX40_HeavyChain
caaguccaacuccaagaauccggccccggccucgucaaacccucccaaacccucucccucaccugcgccgucuacggcggcuccuucuccuccggcuacuggaacuggauccgccaacaccccggcaaaggccucgaauggaucggcuacaucuccuacaacggcaucaccuaccacaaccccucccucaaaucccgcaucaccaucaaccccgacaccuccaaaaaccaauucucccuccaacucaacuccgucacccccgaagacaccgccgucuacuacugcgcccgcuaccgcuacgacuacgacggcggccacgccauggacuacuggggccaaggcacccucgucaccgucuccucc

SEQ ID NO: 59065 - RNA, 363 nt, Artificial Sequence
  derived and/or modified sequence opt11 from anti-OX40_HeavyChain
caaguccaacuccaagaauccggccccggccucgucaaacccucccaaacccucucccucaccugcgccgucuacggcggcuccuucuccuccggcuacuggaacuggauccgcaaacaccccggcaaaggccucgaauggaucggcuacaucuccuacaacggcaucaccuaccacaaccccucccucaaaucccgcaucaccaucaaccgcgacaccuccaaaaaccaauucucccuccaacucaacuccgucacccccgaagacaccgccgucuacuacugcgcccgcuaccgauacgacuacgacggcggccacgccauggacuacuggggccaaggcacccucgucaccgucuccucc

SEQ ID NO: 59066 - RNA, 363 nt, Artificial Sequence
  derived and/or modified sequence opt11 from anti-OX40_HeavyChain
caaguccaacuccaagaaucaggccccggccucgucaaacccucccaaacccucucccuaaccugcgccgucuacggcgacuccuucuccuccggcuacuggaacuggauccgcaaacaccccggcaaaggccucgaauacaugggcuacaucuccuacaacggcaucaccuaccacaaccccucccucaaaucccgcaucaccaucaaccgcgacaccuccaaaaaccaauacucccuccaacucaacuccgucacccccgaagacaccgccgucuacuucugcgcccgcuaccgcuacgacuacgacggcggccacgccauggacuacuggggccaaggcacccucgucaccgucuccucc

SEQ ID NO: 59067 - RNA, 363 nt, Artificial Sequence
  derived and/or modified sequence opt11 from anti-OX40_HeavyChain
caaguccaacuccaagaauccggccccggccucgucaaacccucacaaacccucucccucaccugcgccgucuacggcgacuccuucuccuccggcuacuggaacuggauccgcaaacaccccggcaaaggccucgaauacaucggcuacaucuccuacaacggcaucaccuaccacaaccccucccucaaaucccgcaucaccaucaaccgcgacaccuccaaaaaccaauacucccuccaacucaacuccgucacccccgaagacaccgccgucuacuucugcgcccgcuaccgauacgacuacgacggcggccacgccauggacuacuggggccaaggcacccucgucaccgucucaucc

SEQ ID NO: 59068 - RNA, 363 nt, Artificial Sequence
  derived and/or modified sequence opt11 from anti-OX40_HeavyChain
caaguccaacuccaagaauccggccccggccucgucaaacccucccaaacccucucccuaaccugcgccgucuacggcgacuccuucucauccggcuacuggaacuggauccgcaaacaccccggcaaaggccucgaauacaucggcuacaucuccuacaacggcaucaccuaccacaaccccucccucaaaucccgcaucaccaucaaccgcgacaccuccaaaaaccaauucucacuccaacucaacuccgucacccccgaagacaccgccgucuacuucugcgcccgcuaccgcuacgacuacgacggcggccacgccauggacuacuggggccaaggcacccucgucaccgucuccucc

SEQ ID NO: 59069 - RNA, 363 nt, Artificial Sequence
  derived and/or modified sequence opt11 from anti-OX40_HeavyChain
caaguccaacuccaagaauccggccccggccucgucaaacccucccaaacccucucacucaccugcgccgucuacggcgacuccuucuccuccggcuacuggaacuggauccgcaaacaccccggcaaaggccucgaauacaucggcuacaucuccuacaacggcaucaccuaccacaacccaucccucaaaucccgcaucaccaucaaccgcgacaccuccaaaaaccaauacucccuccaacucaacuccgucacccccgaagacaccgccgucuacuacugcgcccgcuaccgcuacgacuacgacggcggccacgccauggacuacuggggccaaggcacccucgucaccgucuccucc

SEQ ID NO: 59070 - RNA, 363 nt, Artificial Sequence
  derived and/or modified sequence opt11 from anti-OX40_HeavyChain
caaguccaacuccaagaauccggccccggccucgucaaacccucccaaacccucucccucacaugcgccgucuacggcgacuccuucuccuccggcuacuggaacuggauccgcaaacaccccggcaaaggccucgaauacaucggcuacaucuccuacaacggcaucaccuaccacaaccccucccucaaaucccgcaucaccaucaaccgcgacaccuccaaaaaccaauucucccuccaacucaacuccgucacccccgaagacaccgccgucuacuacugcgcccgcuaccgcuacgacuacgacggcggccacgccauggacuacuggggccaaggcacccucgucaccgucuccucc

SEQ ID NO: 59071 - RNA, 363 nt, Artificial Sequence
  derived and/or modified sequence opt11 from anti-OX40_HeavyChain
caaguccaacuccaagaauccggccccggccucgucaaacccucucaaacccuaucccuaaccugcgccgucuacggcggcuccuucuccuccggcuacuggaacuggauccgcaaacaccccggcaaaggccucgaauacaucggcuacaucuccuacaacggcaucaccuaccacaaccccucccucaaaucccgcaucaccaucaaccccgacaccuccaaaaaccaauacucccuccaacucaacuccgucacccccgaagacacagccgucuacuucugcgcccgcuaccgcuacgacuacgacggcggccacgccauggacuacuggggccaaggcacccucgucaccgucuccucc

SEQ ID NO: 59072 - RNA, 363 nt, Artificial Sequence
  derived and/or modified sequence opt11 from anti-OX40_HeavyChain
caaguccaacuccaagaauccggccccggccucgucaaacccucccaaacccucucccucacaugcgccgucuacggcggcucauucuccuccggcuacuggaacuggauccgcaaacaccccggcaaaggccucgaauacaucggcuacaucuccuacaacggcaucaccuaccacaaccccucccucaaaucccgcaucaccaucaaccgcgacaccuccaaaaaccaauacucccuccaacucaacuccgucacccccgaagacaccgccgucuacuucugcgcccgcuaccgcuacgacuacgacggcggccacgccauggacuacuggggccaaggaacccucgucaccgucuccucc

SEQ ID NO: 59073 - RNA, 363 nt, Artificial Sequence
  derived and/or modified sequence opt11 from anti-OX40_HeavyChain
caaguccaacuccaagaauccggccccggccucgucaaacccucccaaacccucucccucaccugcgccgucuacggcggcuccuucuccuccggcuacuggaacuggauccgcaaacaccccggcaaaggccucgaauacaucggcuacaucuccuacaacggcaucaccuaccacaaccccucccucaaaucccgcaucaccaucaaccgcgacaccuccaaaaaccaauacucccuccaacucaacuccgucacccccgaagacaccgccgucuacuacugcgcccgcuaccgcuacgacuacgacggcggccacgccauggacuacuggggccaaggcacccucgucaccgucuccucc

SEQ ID NO: 59074 - RNA, 363 nt, Artificial Sequence
  derived and/or modified sequence opt11 from anti-OX40_HeavyChain
caaguccaacuccaagaauccggccccggccucgucaaacccucccaaacccucucccucacaugcgccgucuacggcggcuccuucuccuccggcuacuggaacuggauccgcaaacaccccggcaaaggccucgaauacaucggcuacaucuccuacaacggcaucaccuaccacaaccccucccucaaaucccgcaucaccaucaaccccgacaccuccaaaaaccaauacucccuccaacucaacuccgucacccccgaagacaccgccgucuacuacugcgcccgcuaccgcuacgacuacgacggcggccacgccauggacuacuggggccaaggcacccucgucaccgucuccucc

SEQ ID NO: 59075 - RNA, 363 nt, Artificial Sequence
  derived and/or modified sequence opt11 from anti-OX40_HeavyChain
caaguccaacuccaagaauccggccccggccucgucaaacccucccaaacccucucccuaaccugcgccgucuacggcggcuccuucucauccggcuacuggaacuggauccgcaaacaccccggcaaaggccucgaauacaucggcuacaucuccuacaacgccaucaccuaccacaaccccucccucaaaucccgcaucaccaucaaccgcgacaccuccaaaaaccaauacucccuccaacucaacuccgucacccccgaagacaccgccgucuacuacugcgcccgcuacaaauacgacuacgacgccggccacgccauggacuacuggggccaaggcacccucgucaccgucuccucc

SEQ ID NO: 59076 - RNA, 363 nt, Artificial Sequence
  derived and/or modified sequence opt11 from anti-OX40_HeavyChain
caaguccaacuccaagaauccggccccggccucgucaaacccucccaaacccucucccuaaccugcgccgucuacggcggcuccuucucauccggcuacuggaacuggauccgcaaacaccccggcaaaggccucgaauacaucggcuacaucuccuacaacgccaucaccuaccacaaccccucccucaaaucccgcaucaccaucaaccgcgacaccuccaaaaaccaauacucccuccaacucaacuccgucacccccgaagacaccgccgucuacuacugcgcccgcuaccgcuacgacuacgacggcggccacgccauggacuacuggggccaaggcacccucgucaccgucuccucc

SEQ ID NO: 59077 - RNA, 363 nt, Artificial Sequence
  derived and/or modified sequence opt11 from anti-OX40_HeavyChain
caaguccaacuccaagaauccggccccggccucgucaaacccucccaaacccucucccuaaccugcgccgucuacggcggcuccuucuccuccggcuacuggaacuggauccgcaaacaccccggaaaaggccucgaauacaucggcuacaucuccuacaacggcaucaccuaccacaaccccucacucaaaucccgaaucaccaucaaccgcgacaccuccaaaaaccaauacucccuccaacucaacucagucacccccgaagacaccgccgucuacuacugcgcccgcuacaaauacgacuacgacggcggccacgccauggacuacuggggccaaggcacacucgucaccgucuccucc

SEQ ID NO: 59078 - RNA, 363 nt, Artificial Sequence
  derived and/or modified sequence opt11 from anti-OX40_HeavyChain
caaguccaacuccaagaauccggccccggccucgucaaacccucccaaacccucucccucaccugcgccgucuacggcggcucauucuccuccggcuacuggaacuggauccgcaaacaccccggcaaaggccucgaauacaucggcuacaucuccuacuccggcaucaccuaccacaaccccucccucaaaucccgcaucaccaucaaccgcgacaccucaaaaaaccaauacucccuccaacucaacuccguaacccccgaagacaccgccgucuacuacugcgcccgcuaccgcuacgacuacgacggcggccacgccauggacuacuggggccaaggcacccucgucaccgucuccucc

SEQ ID NO: 59079 - RNA, 363 nt, Artificial Sequence
  derived and/or modified sequence opt11 from anti-OX40_HeavyChain
caaguccaacuccaagaauccggccccggccucgucaaacccucccaaacccucucccucaccugcgccgucuacggcggcuccuucuccuccggcuacuggaacuggauccgaaaacaccccggcaaaggccucgaauacaucggcuacaucuccuacuccggcaucaccuaccacaacccaucccucaaaucccgcaucaccaucaaccgcgacaccuccaaaaaccaauacucacuccaacucaacuccgucacccccgaagacaccgccgucuacuacugcgcccgauacaaauacgacuacgacggcggccacgccauggacuacuggggccaaggcacccucgucaccgucuccucc

SEQ ID NO: 59080 - RNA, 363 nt, Artificial Sequence
  derived and/or modified sequence opt11 from anti-OX40_HeavyChain
gaaguccaacuccaagaauccggccccucccucgucaaacccucccaaacccucucacucaccugcuccgucaccggcgacuccuucaccuccggcuacuggaacuggauccgcaaauuccccggcaaccgacucgaauacaugggcuacaucuccuacaacgccaucaccuaccacaaccccucccucaaaucccgcaucuccaucacccgcgacaccuccaaaaaccacuacuaccuccaacucaacuccgucaccaccgaagacaccgccaccuacuucugcgcccgcuaccgcuacgacuacgacggcggccacgccauggacuacuggggccaaggcacccucgucaccgucuccucc

SEQ ID NO: 59081 - RNA, 363 nt, Artificial Sequence
  derived and/or modified sequence opt11 from anti-OX40_HeavyChain
caaguccaacuccaagaauccggccccggccucgucaaacccucccaaacccucucccuaaccugcgccgucuacggcggcuccuucuccuccggcuacuggaacuggauccgcaaacaccccggcaaaggccucgaauacaucggcuacaucuccuacaacgccaucaccuaccacaaccccucccucaaaucccgaaucaccaucaaccgcgacaccuccaaaaaccaauacucacuccaacucaacuccgucacccccgaagacaccgccgucuacuacugcgcccgcuacaaauacgacuacgacggcggccacgccauggacuacuggggccaaggcacccucgucaccgucuccuca

SEQ ID NO: 59082 - RNA, 372 nt, Artificial Sequence
  derived and/or modified sequence opt11 from anti-OX40_HeavyChain
gaagugcaauugguggagagcgggggcgggcucgugcaaccgggcaggagcuugcgcuugagcugugccgcgagcggguucacguucgaugacuaugcaaugcacugggucaggcaagcgcccgggaaagggcuagagugggugagcgggauaucguggaauagcgggagcauaggcuaugcagauagcgugaaagggcgcuuuacaauaagcagggacaaugccaagaacucgcucuaucuacagaugaauagcuugcgagcggaagauaccgcgcucuauuacugugccaaggaccagagcacggccgauuacuauuucuauuacgggauggaugucuggggccagggcacgaccgugaccgugagcucg

SEQ ID NO: 59083 - RNA, 381 nt, Artificial Sequence
  derived and/or modified sequence opt11 from anti-OX40_LightChain
auggaaacccccgcccaacuccuauuccuacuccuccucuggcuccccgacaccaccggcgaaaucguccucacccaaucacccggcacccucucccucucccccggagaacgcgccauccucuccugccgcgccucccaauccgucuccuccuccuuccucgccugguaccaacaaaaacccggccaagccccacgccuccucaucuacggcgccuucucccgcgccaccggcauacccgaccgcuucuccggcuccggcuccggcaccgacuucacccucaccaucucacgccucgaacccgaagacuucgccgucuacuacugccaacaauacgacuccucccgcaccuucggccaaggcaccaaagucgaaaucaaa

SEQ ID NO: 59084 - RNA, 381 nt, Artificial Sequence
  derived and/or modified sequence opt11 from anti-OX40_LightChain
auggaagcccccgcccaacuccucuuccuccuccuccucuggcuccccgacaccaccggcgaaaucguccucacccaaucccccgccacccucucccucucccccggcgaacgcgccacccucuccugccgcgccucccaaggcgucucauccuaccucgccugguaccaacaaaaacccggccaagccccccgccuccucaucuacgacgccuccaaccgcgccaccggcauccccgcccgcuucuccggcucaggccccggcaccgacuucacccucaccaucuccucccucgaacccgaagacuucgccgucuacuacugccaacaacgcuccaacuggcaccccaccuucggacaaggcaccaaagucgaaaucaaa

SEQ ID NO: 59085 - RNA, 381 nt, Artificial Sequence
  derived and/or modified sequence opt11 from anti-OX40_LightChain
auggaagcccccgcccaacuccucuuccuccuccuccucuggcuccccgacaccaccggcgaaaucguccucacccaaucacccgccacccuaucccucucccccggagaacgcgccacccucuccugccgcgccucacaauccgucuccuccuaccucgccugguaccaacaaaaacccggccaagccccccgccuccucaucuacgacgccuccaaccgcgccaccggcauccccgcccgcuucuccggcucaggcucaggcaccgacuucacccucaccaucuccucccucgaacccgaagacuucgccgucuacuacugccaacaacgcuccaacuggcccaucaccuucggccaaggcacccgccucgaaaucaaa

SEQ ID NO: 59086 - RNA, 387 nt, Artificial Sequence
  derived and/or modified sequence opt11 from anti-OX40_LightChain
auggaaacccccgcccaacuccucuuccuccuccuccucuggcuccccgacaccaccggcgaaaucguccucacccaaucccccggcacccucucacucucccccggcgaacgcgccacccuauccugccgcgccucccaauccguauccuccuccuaccucgccugguaccaacaaaaacccggccaagcaccccgccuccucaucuacggcgccuccucccgagccaccggcauccccgaccgcuucuccggcuccggcuccggcaccgacuucacccucaccaucucccgccucgaacccgaagacuucgccgucuacuacugccaacaauacgacuccucccucaccuucggcggcggcacaaaagucgaaaucaaacgcacc

SEQ ID NO: 59087 - RNA, 390 nt, Artificial Sequence
  derived and/or modified sequence opt11 from anti-OX40_LightChain
auggacaugcgcguccucgcccaacuccucggccuccuccuccucugcuuccccggcgcccgcugcgacauccaaaugacccaaucccccuccucccucuccgccuccgucggcaaccgcgucaccaucaccugccgcgccucccaagacaucuccuccuggcucgccugguaccaacaaaaacccgaaaaagcccccaaaucccuaaucuacgccgccuccucccuccaauccggcguccccucacgcuucuccggcuccggcuccggcaccgacuucacccucaccaucuccucccuccaacccgaagacuucgccaccuacuacugccaacaauacaacuccuacccccucaccuucggccaaggcacccgccucgaaaucaaacgc

SEQ ID NO: 59088 - RNA, 408 nt, Artificial Sequence
  derived and/or modified sequence opt11 from anti-OX40_HeavyChain
auggacacacucugcuccacccuccuccuccucaccauccccuccuggguccuaucccaaaucacccucaaagaauccggccccacccucgucaaacccacccaaacccucacccucuccugcaccuucuccggcuucucccucuccaccuccggcgucggcgucggcuggauccgccaaccacccggcaaagcccucgaauggcucgcccucauccacugggacgacgccgaacgcuacucccccucccucaaaucccgccucaccaucaccaaagacaccuccaaaaaccaagucguccucaccaugaccaacauggaccucgucgacaccgccaccuacuacugcgcccacacccgcggcgccuucgacaucuggggccaaggcaccauggucacagucuccucc

SEQ ID NO: 59089 - RNA, 408 nt, Artificial Sequence
  derived and/or modified sequence opt11 from anti-OX40_HeavyChain
auggacacccucugcuccacccuccuccuccucaccaucccauccuggguccucucccaaaucacccuaaaagaauccggccccacccucgucaaacccacccaaacccucacccuaaccugcaccuucuccggcuucucccucuccacauccggcgucggagucggcuggauccgccaaccacccggcaaagcccuagaauggcucgcccucaucuacugggacgaccacucccccuacucccccucccucaaaucccgccucaccaucaccaaagacaccuccaaaaaccaagucguccucaccaugaccaacauggaccccgucgacaccgccaccuacuacugcgcccgcacccgcggcgccuucgacaucuggggccaaggcaccauggucaccgucucaucc

SEQ ID NO: 59090 - RNA, 420 nt, Artificial Sequence
  derived and/or modified sequence opt11 from anti-OX40_HeavyChain
auggagugggggccguguuggguguuuuugguggugauauuggagggggugcaguguggggugcagcugguggagaguggggggggguuggugcagccgggggggaguuugagguugagcugugcggcgaguggguuuacguuuaguaguuauaguaugaauugggugaggcaggcgccggggaagggguuggagugggugagcuauauaaguaguaguagcaguacgauauauuaugcggauagugugaaggggagguuuacgauaaguagagauaaugcgaagaauagucuguauuugcagaugaauagccugagggaugaggauacggcgguguauuauugugcgagggggguguaucauaauggguggaguuuuuuugauuauugggggcaggggacgcuguugacggugaguagu

SEQ ID NO: 59091 - RNA, 423 nt, Artificial Sequence
  derived and/or modified sequence opt11 from anti-OX40_HeavyChain
auggacacccucugcuccacccuccuccuccucaccauccccuccuggguccucucccaaaucacccucaaagaauccggccccacccuagucaaacccaaacaaacccucacccucaccugcaccuucuccggcuucucccucuccaccuccggcaugggcgucggcuggauccgccaaccccccggcaaagcccucgaauggcucgccgucaucuacugggacgaccaccaacucuacucccccucccucaaaucccgccucaccaucaccaaagacaccuccaaaaaccaaguaguccucaccaugaccaacauggaccccgucgacaccgccaccuacuacugcgcccaccgccgcggcgccuuccaacacuggggccaaggcacccucgucaccgucuccuccgccuccaccaaaggc

SEQ ID NO: 59092 - RNA, 462 nt, Artificial Sequence
  derived and/or modified sequence opt11 from anti-OX40_HeavyChain
augaccaugaucacacccucccucguacccucauccgacccccucgucaccgccgccuccguccucgaauucgcccuccucauccgccucaccaucggccaagccgucgucucaacccaauccaccggcggcggccucguccaacccggccgcucccuccgccucucaugcgccgccuccggcuucacccucgacgacuacggcaugcacuggguccgccaagcccccggcaaaggccucgaaugggucuccggcaucuccuggaacuccgacuccaucggcuacgucgacuccgucaaaggccgcuucaccaucucccgcgacaacgccaaaaacucccucuaccuccaaaugaacucccuccgcgucgaagacaccgcccucuacuacugcgucaaagacaucuccggcugguacuccuucgacuacuggggccaaggcacccucgucaccgucuccucc

SEQ ID NO: 59093 - RNA, 639 nt, Artificial Sequence
  derived and/or modified sequence opt11 from anti-OX40_LightChain
gaaaucgucgucacccaaucacccgccacccucucccucucccccggcgaacgcgccacccucuccugccgcgccucacaauccgucuccuccuaccucgccugguaccaacaaaaacccggccaagccccacgccuccucaucuacgacgccucaaaccgagccacaggcauccccgcccgauucuccggcuccggcuccggaaccgacuucacacuaaccaucuccucccucgaacccgaagacuucgccgucuacuacugccaacaacgauccaacuggcccaccuucggccaaggcaccaaagucgaaaucaaacgcaccgucgccgcccccuccgucuucaucuucccacccucagacgaacaacucaaauccggcaccgccuccgucgucugccuccucaacaacuucuacccccgcgaagccaaaguacaauggaaagucgacaacgcccuccaauccggaaacucccaagaauccgucacagaacaagacuccaaagacuccaccuacucacuuuccuccacccucacccucuccaaagccgacuacgaaaaacacaaagucuacgccugcgaaguaacccaccaaggccucuccucccccgucaccaaauccuucaaccgcggcgaaugc

SEQ ID NO: 59094 - RNA, 1350 nt, Artificial Sequence
  derived and/or modified sequence opt11 from anti-OX40_HeavyChain
gaaguccaacucgucgaauccggcggcggccuuguacagcccggacgaucccuccgccuaucgugcgccgccuccggcuucacauucgacgacuacgcaaugcacuggguacgccaagcacccggcaaaggccucgaaugggucuccggcauaucauggaacucaggaucuaucggauacgccgacuccgucaaaggccgcuucacaaucucccgcgacaacgcuaaaaacucccucuaccuccaaaugaacucacuccgagcggaagauaccgcacucuacuacugcgccaaagaccaauccaccgccgauuacuacuucuacuacggcauggacgucuggggccagggcaccaccgucacagucucgucagcaagcaccaaaggacccuccgucuucccacucgcaccuugcucucgcagcaccucagaauccacugcagcucucggcugccucgucaaagacuacuucccagaaccagucacagucagcuggaacuccggcgcacucaccucuggcguucacaccuuccccgcgguccuccaaucauccggccucuacucccuauccucuguagucaccguccccucaaguaauuucgguacccaaaccuauaccugcaaugucgaccacaaacccuccaacacaaaagucgacaaaaccguagaacgaaaaugcugcguagagugcccaccaugccccgcaccacccguagcaggccccuccgucuuucucuucccacccaaacccaaggacacccuaaugauaucccgcacccccgaaguaaccugcgucgucgucgacguuucccacgaagaccccgaaguccaguucaacugguacgucgacggaguagaaguccacaacgccaaaaccaaaccccgagaagaacaauucaacuccaccuuccgcgucgucucuguacucaccguaguucaccaagacuggcuaaacggaaaagaauacaaaugcaaagucagcaacaaaggccuccccgcccccaucgagaaaaccauaucuaaaaccaaaggccaaccccgcgaaccacaagucuacacccucccacccucacgugaagaaaugaccaaaaaccaagucucacucacaugccucgucaaaggcuucuacccaagcgacaucgcaguagaaugggaauccaacggccaacccgaaaacaacuacaaaaccaccccacccaugcuagacucagacggguccuucuuccucuacuccaagcucaccgucgacaaaucucgcuggcaacaaggaaacgucuucuccugcucagucaugcacgaagcccuucacaaccauuacacccaaaaauccuuaucccuaucccccggaaaa

SEQ ID NO: 59095 - RNA, 21 nt, Artificial Sequence
  derived and/or modified sequence opt11 from anti-HIV_VRC01_VRC02_NIH45-46_LightChain_CDR
ugccaacaauacgaauucuuc

SEQ ID NO: 59096 - RNA, 42 nt, Artificial Sequence
  derived and/or modified sequence opt11 from anti-HIV_VRC01_HeavyChain_CDR
acgcgcgggaaaaauugcgauuacaauugggauuucgagcac

SEQ ID NO: 59097 - RNA, 21 nt, Artificial Sequence
  derived and/or modified sequence opt11 from anti-HIV_3BNC60_LightChain_CDR
ugccaaguguacgaguucaua

SEQ ID NO: 59098 - RNA, 36 nt, Artificial Sequence
  derived and/or modified sequence opt11 from anti-HIV_3BNC60_HeavyChain_CDR
gcgcgccagcgcucggacuuuugggauuucgauguc

SEQ ID NO: 59099 - RNA, 36 nt, Artificial Sequence
  derived and/or modified sequence opt11 from anti-HIV_5H/I1-BMV-D5_HeavyChain_CDR
gcgcgcgauaacccgaccuugcucgggagcgauuac

SEQ ID NO: 59100 - RNA, 33 nt, Artificial Sequence
  derived and/or modified sequence opt11 from anti-HIV_8ANC195_LightChain_CDR
ugccaacaauacgacaccuaccccggcaccuuc

SEQ ID NO: 59101 - RNA, 33 nt, Artificial Sequence
  derived and/or modified sequence opt11 from anti-HIV_CH01_CH02_CH03_LightChain_CDR
ugccaacaauacggcggcagcccauacacauuc

SEQ ID NO: 59102 - RNA, 78 nt, Artificial Sequence
  derived and/or modified sequence opt11 from anti-HIV_CH01_HeavyChain_CDR
gcgcgcgggaccgauuacacgaucgaugacgcgggcauacacuaucaagggagcgggaccuuuugguauuucgaucuc

SEQ ID NO: 59103 - RNA, 78 nt, Artificial Sequence
  derived and/or modified sequence opt11 from anti-HIV_CH02_HeavyChain_CDR
gcccgcggcaccgacuacacaaucgacgaccaaggccgauucuaccaaggcuccggcaccuucugguacuucgacuuc

SEQ ID NO: 59104 - RNA, 78 nt, Artificial Sequence
  derived and/or modified sequence opt11 from anti-HIV_CH03_HeavyChain_CDR
gcccgcggcaccgacuacacaaucgacgaccaaggcauauucuacaaaggauccggcaccuucugguacuucgaccuc

SEQ ID NO: 59105 - RNA, 33 nt, Artificial Sequence
  derived and/or modified sequence opt11 from anti-HIV_CH04_LightChain_CDR
ugccaacaauacggccgcucccccuacaccuuc

SEQ ID NO: 59106 - RNA, 78 nt, Artificial Sequence
  derived and/or modified sequence opt11 from anti-HIV_CH04_HeavyChain_CDR
gcgcgcgggaccgauuacacgaucgaugaccagggcauacgcuaucaagggagcgggaccuuuugguauuucgauguc

SEQ ID NO: 59107 - RNA, 54 nt, Artificial Sequence
  derived and/or modified sequence opt11 from anti-HIV_NIH45-46_HeavyChain_CDR
acacgcggaaaauacugcacggccagagacuacuacaacugggacuucgaacac

SEQ ID NO: 59108 - RNA, 90 nt, Artificial Sequence
  derived and/or modified sequence opt11 from anti-HIV_PG16_HeavyChain_CDR
gcccgagaagccggcggcccaaucuggcacgacgacgucaaauacuacgacuucaacgacggcuacuacaacuaccacuacauggacguc

SEQ ID NO: 59109 - RNA, 36 nt, Artificial Sequence
  derived and/or modified sequence opt11 from anti-HIV_PGT122_LightChain_CDR
cacauaugggacagcagacgcccgaccaacugggua

SEQ ID NO: 59110 - RNA, 72 nt, Artificial Sequence
  derived and/or modified sequence opt11 from anti-HIV_PGT122_HeavyChain_CDR
accaagcacgggcgcaggaucuauggcguggucgcguucaaggaaugguucacguacuuuuacauggacgug

SEQ ID NO: 59111 - RNA, 36 nt, Artificial Sequence
  derived and/or modified sequence opt11 from anti-HIV_PGT123_LightChain_CDR
cacauauacgacgccagaggcggaacaaacuggguc

SEQ ID NO: 59112 - RNA, 72 nt, Artificial Sequence
  derived and/or modified sequence opt11 from anti-HIV_PGT123_HeavyChain_CDR
gcccuccacggcaaacgcaucuacggcaucgucgcccucggcgaacucuucaccuacuucuacauggacguc

SEQ ID NO: 59113 - RNA, 30 nt, Artificial Sequence
  derived and/or modified sequence opt11 from anti-HIV_PGT125_PGT128_LightChain_CDR
gggaguuuggucgggaacugggacgugaua

SEQ ID NO: 59114 - RNA, 57 nt, Artificial Sequence
  derived and/or modified sequence opt11 from anti-HIV_PGT125_HeavyChain_CDR
uuugacggggaagugcucguguacaaucacuggcccaagcccgcguggguggacuug

SEQ ID NO: 59115 - RNA, 30 nt, Artificial Sequence
  derived and/or modified sequence opt11 from anti-HIV_PGT126_PGT127_LightChain_CDR
ucgagcuuggucgggaacugggacgugaua

SEQ ID NO: 59116 - RNA, 57 nt, Artificial Sequence
  derived and/or modified sequence opt11 from anti-HIV_PGT126_HeavyChain_CDR
uucgacggagaaguacucguauaccacgacuggcccaagcccgcauggguagaccug

SEQ ID NO: 59117 - RNA, 57 nt, Artificial Sequence
  derived and/or modified sequence opt11 from anti-HIV_PGT127_HeavyChain_CDR
uuugggggggagguguugguguauagggauuggccgaagccggcguggguggauuug

SEQ ID NO: 59118 - RNA, 57 nt, Artificial Sequence
  derived and/or modified sequence opt11 from anti-HIV_PGT128_HeavyChain_CDR
uuuggcggggaagugcucagguacacggacuggcccaagccagcguggguggacuug

SEQ ID NO: 59119 - RNA, 30 nt, Artificial Sequence
  derived and/or modified sequence opt11 from anti-HIV_PGT130_LightChain_CDR
ucgaguuuguucgggcgcugggacgugguc

SEQ ID NO: 59120 - RNA, 57 nt, Artificial Sequence
  derived and/or modified sequence opt11 from anti-HIV_PGT130_HeavyChain_CDR
uccggcggcgacauccucuacuacuacgaauggcaaaaaccccacugguucucaccc

SEQ ID NO: 59121 - RNA, 30 nt, Artificial Sequence
  derived and/or modified sequence opt11 from anti-HIV_PGT131_LightChain_CDR
ucgagcuugagcgggcgaugggacauaguc

SEQ ID NO: 59122 - RNA, 57 nt, Artificial Sequence
  derived and/or modified sequence opt11 from anti-HIV_PGT131_HeavyChain_CDR
agcgggggcgauaucuuguacuauaucgaguggcagaaaccgcacugguucuauccc

SEQ ID NO: 59123 - RNA, 27 nt, Artificial Sequence
  derived and/or modified sequence opt11 from anti-HIV_PGT135_PGT136_PGT137_LightChain_CDR
caacaguacgaagaauggcccagaacc

SEQ ID NO: 59124 - RNA, 54 nt, Artificial Sequence
  derived and/or modified sequence opt11 from anti-HIV_PGT135_HeavyChain_CDR
caccgacaccacgacguauucaugcucguccccaucgccggcugguucgacguc

SEQ ID NO: 59125 - RNA, 54 nt, Artificial Sequence
  derived and/or modified sequence opt11 from anti-HIV_PGT136_HeavyChain_CDR
cacaaauaccacgacaucuuccgcgucguccccgucgccggcugguucgacccc

SEQ ID NO: 59126 - RNA, 54 nt, Artificial Sequence
  derived and/or modified sequence opt11 from anti-HIV_PGT137_HeavyChain_CDR
cacaaauaccacgacaucgucauggucguccccaucgccggcugguucgacccc

SEQ ID NO: 59127 - RNA, 27 nt, Artificial Sequence
  derived and/or modified sequence opt11 from anti-HIV_PGT141_PGT142_PGT143_PGT144_LightChain_CDR
augcaaggacucaaccgcccguggacg

SEQ ID NO: 59128 - RNA, 96 nt, Artificial Sequence
  derived and/or modified sequence opt11 from anti-HIV_PGT141_HeavyChain_CDR
ggcucaaaacaccgccuccgcgacuacguccucuacgacgacuacggccucaucaacuaccaagaauggaacgacuaccucgaauuccucgacguc

SEQ ID NO: 59129 - RNA, 96 nt, Artificial Sequence
  derived and/or modified sequence opt11 from anti-HIV_PGT144_HeavyChain_CDR
ggcucaaaacaccgccuccgcgacuacguccucuacgacgacuacggccucaucaaccaacaagaauggaacgacuaccucgaauuccucgacguc

SEQ ID NO: 59130 - RNA, 27 nt, Artificial Sequence
  derived and/or modified sequence opt11 from anti-HIV_PGT145_LightChain_CDR
augcaaggacuccacagcccguggaca

SEQ ID NO: 59131 - RNA, 93 nt, Artificial Sequence
  derived and/or modified sequence opt11 from anti-HIV_PGT145_HeavyChain_CDR
ggcucaaaacaccgccuccgcgacuacuuccucuacaacgaauacggccccaacuacgaagaauggggcgacuaccucgccacccucgacguc

SEQ ID NO: 59132 - RNA, 21 nt, Artificial Sequence
  derived and/or modified sequence opt11 from anti-HIV_VRC-CH30_VRC-CH31_VRC-CH32_VRC-CH33_VRC-CH34_LightChain _CDR
ugccaacaauacgaaaccuuc

SEQ ID NO: 59133 - RNA, 45 nt, Artificial Sequence
  derived and/or modified sequence opt11 from anti-HIV_VRC-CH30_VRC-CH31_VRC-CH32_VRC-CH34_HeavyChain_CDR
gccagagcacaaaaacgaggcagaucagaaugggccuacgcccac

SEQ ID NO: 59134 - RNA, 45 nt, Artificial Sequence
  derived and/or modified sequence opt11 from anti-HIV_VRC-CH33_HeavyChain_CDR
gcgcgagcgcaaaagcgagcgcgcucggaaugggccuaugcccau

SEQ ID NO: 59135 - RNA, 21 nt, Artificial Sequence
  derived and/or modified sequence opt11 from anti-HIV_VRC-PG04_LightChain_CDR
ugccaacaacucgaauucuuc

SEQ ID NO: 59136 - RNA, 48 nt, Artificial Sequence
  derived and/or modified sequence opt11 from anti-HIV_VRC-PG04_HeavyChain_CDR
gcgcgccagaaauuuuacacgggcgggcaagggugguauuucgaucuc

SEQ ID NO: 59137 - RNA, 21 nt, Artificial Sequence
  derived and/or modified sequence opt11 from anti-HIV_VRC-PG04b_LightChain_CDR
ugccaacaagucgaauucuuc

SEQ ID NO: 59138 - RNA, 48 nt, Artificial Sequence
  derived and/or modified sequence opt11 from anti-HIV_VRC-PG04b_HeavyChain_CDR
gcgaggcagaaguuugagaggggggggcaggggugguauuuugauuug

SEQ ID NO: 59139 - RNA, 21 nt, Artificial Sequence
  derived and/or modified sequence opt11 from anti-HIV_VRC03_LightChain_CDR
ugccaacaauucgaauucuuc

SEQ ID NO: 59140 - RNA, 48 nt, Artificial Sequence
  derived and/or modified sequence opt11 from anti-HIV_VRC03_HeavyChain_CDR
gugcgcaggggcucgugcgauuacuguggcgauuucccguggcaguac

SEQ ID NO: 59141 - RNA, 21 nt, Artificial Sequence
  derived and/or modified sequence opt11 from anti-HIV_1TJG_P-Chain
gaacuggacaagugggcaagu

SEQ ID NO: 59142 - RNA, 69 nt, Artificial Sequence
  derived and/or modified sequence opt11 from anti-HIV_2B1H_P-Chain
aacaacaccaaaaaauccaucaaaauccgcccccgccaagccuucuacgccaccaacggcaucaucggc

SEQ ID NO: 59143 - RNA, 69 nt, Artificial Sequence
  derived and/or modified sequence opt11 from anti-HIV_2B1A_P-Chain
aacaacacccgcaaauccauacaccucggccccggccgcgccuucuacgccaccggcgacaucaucggc

SEQ ID NO: 59144 - RNA, 57 nt, Artificial Sequence
  derived and/or modified sequence opt11 from anti-HIV_2B0S_P-Chain
aaacgcaaacgcauccacaucggccccggccgcgccuucuacaccaccaaaaacgcc

SEQ ID NO: 59145 - RNA, 69 nt, Artificial Sequence
  derived and/or modified sequence opt11 from anti-HIV_3UJJ_P-Chain
aauaacacgcgcaagagcauacgcauaggcccgggccaggccuuuuacgcgaccggggacauaaucggg

SEQ ID NO: 59146 - RNA, 69 nt, Artificial Sequence
  derived and/or modified sequence opt11 from anti-HIV_3UJI_P-Chain
uacaacaaacgcaaacgcauccacaucggccccggccgcgccuucuacaccaccaaaaacaucaucggc

SEQ ID NO: 59147 - RNA, 75 nt, Artificial Sequence
  derived and/or modified sequence opt11 from anti-HIV_3MLZ_P-Chain
agcaacaacacgcgcaagggcauacacauaggcccgggcagggccuucuacgcgaccgggcaaauaaccggggac

SEQ ID NO: 59148 - RNA, 60 nt, Artificial Sequence
  derived and/or modified sequence opt11 from anti-HIV_3MLV_Q-Chain
aacaacacacgcaaacgcauacgcguaggcccaggccaaaccguauacgcaaccaacgcc

SEQ ID NO: 59149 - RNA, 69 nt, Artificial Sequence
  derived and/or modified sequence opt11 from anti-HIV_3MLU_P-Chain
aauaacacgcgcaagagcauacgcauaggcccgggccaggccuuuuacgcgaccgggggcauaaucggg

SEQ ID NO: 59150 - RNA, 60 nt, Artificial Sequence
  derived and/or modified sequence opt11 from anti-HIV_3MLR_P-Chain
aacaacaccaaaaagggcauagccauaggcccgggcaggacacuguacgcgcgcgagaaa

SEQ ID NO: 59151 - RNA, 48 nt, Artificial Sequence
  derived and/or modified sequence opt11 from anti-HIV_4XCF_P-Chain
aacuggugggacauaacgaacuggcucugguacaucaaaaagaaaaag

SEQ ID NO: 59152 - RNA, 45 nt, Artificial Sequence
  derived and/or modified sequence opt11 from anti-HIV_4XBE_P-Chain
aacugguucgacauaacgaacuggcucugguacaucaaaaagaaa

SEQ ID NO: 59153 - RNA, 48 nt, Artificial Sequence
  derived and/or modified sequence opt11 from anti-HIV_4XAW_P-Chain
aacugguucgacauaacgaacuggcucugguacaucaaaaagaaaaag

SEQ ID NO: 59154 - RNA, 45 nt, Artificial Sequence
  derived and/or modified sequence opt11 from anti-HIV_2QSC_P-Chain
cgcaaacgcauccacaucggccccggccgcgccuucuacaccacc

SEQ ID NO: 59155 - RNA, 60 nt, Artificial Sequence
  derived and/or modified sequence opt11 from anti-HIV_3MLS_S-Chain
gccugccaagccuucuacgccuccuccccccgcaaauccauacacaucggcgccugcgcc

SEQ ID NO: 59156 - RNA, 42 nt, Artificial Sequence
  derived and/or modified sequence opt11 from anti-HIV_3GO1_P-Chain
cgcaagcgcauacacauaggcccgggcagggccuucuacaca

SEQ ID NO: 59157 - RNA, 42 nt, Artificial Sequence
  derived and/or modified sequence opt11 from anti-HIV_4M1D_Q-Chain
ugccgcauccacaucggccccggccgagccuucuacaccugc

SEQ ID NO: 59158 - RNA, 39 nt, Artificial Sequence
  derived and/or modified sequence opt11 from anti-HIV_3C2A_Q-Chain
aaauccauccaccucggccccggccgcgccuucuacgcc

SEQ ID NO: 59159 - RNA, 12 nt, Artificial Sequence
  derived and/or modified sequence opt11 from anti-HIV_CDR
caauccaaaacc

SEQ ID NO: 59160 - RNA, 12 nt, Artificial Sequence
  derived and/or modified sequence opt11 from anti-HIV_CDR
gaccugaucgau

SEQ ID NO: 59161 - RNA, 15 nt, Artificial Sequence
  derived and/or modified sequence opt11 from anti-HIV_CDR
gaccacuacugguca

SEQ ID NO: 59162 - RNA, 15 nt, Artificial Sequence
  derived and/or modified sequence opt11 from anti-HIV_CDR
ggcagguucuggagu

SEQ ID NO: 59163 - RNA, 15 nt, Artificial Sequence
  derived and/or modified sequence opt11 from anti-HIV_CDR
aacuacuacuggacc

SEQ ID NO: 59164 - RNA, 15 nt, Artificial Sequence
  derived and/or modified sequence opt11 from anti-HIV_CDR
gacgccuacugguca

SEQ ID NO: 59165 - RNA, 15 nt, Artificial Sequence
  derived and/or modified sequence opt11 from anti-HIV_CDR
gauagcuauuggucg

SEQ ID NO: 59166 - RNA, 15 nt, Artificial Sequence
  derived and/or modified sequence opt11 from anti-HIV_CDR
gacaacuacugguca

SEQ ID NO: 59167 - RNA, 15 nt, Artificial Sequence
  derived and/or modified sequence opt11 from anti-HIV_CDR
aacagcuacuggacc

SEQ ID NO: 59168 - RNA, 15 nt, Artificial Sequence
  derived and/or modified sequence opt11 from anti-HIV_CDR
uccuauuacuggucc

SEQ ID NO: 59169 - RNA, 15 nt, Artificial Sequence
  derived and/or modified sequence opt11 from anti-HIV_CDR
agcuucggcaugcac

SEQ ID NO: 59170 - RNA, 15 nt, Artificial Sequence
  derived and/or modified sequence opt11 from anti-HIV_CDR
gccgcauuucagugg

SEQ ID NO: 59171 - RNA, 15 nt, Artificial Sequence
  derived and/or modified sequence opt11 from anti-HIV_CDR
caacaacuccgcacc

SEQ ID NO: 59172 - RNA, 15 nt, Artificial Sequence
  derived and/or modified sequence opt11 from anti-HIV_CDR
caacaauacgacagc

SEQ ID NO: 59173 - RNA, 15 nt, Artificial Sequence
  derived and/or modified sequence opt11 from anti-HIV_CDR
caacaacucgccacc

SEQ ID NO: 59174 - RNA, 15 nt, Artificial Sequence
  derived and/or modified sequence opt11 from anti-HIV_CDR
gagagcuuucagugg

SEQ ID NO: 59175 - RNA, 15 nt, Artificial Sequence
  derived and/or modified sequence opt11 from anti-HIV_CDR
gagguguaugaguuu

SEQ ID NO: 59176 - RNA, 15 nt, Artificial Sequence
  derived and/or modified sequence opt11 from anti-HIV_CDR
gccucgcucgaguuu

SEQ ID NO: 59177 - RNA, 15 nt, Artificial Sequence
  derived and/or modified sequence opt11 from anti-HIV_CDR
agcguguacgaguuc

SEQ ID NO: 59178 - RNA, 15 nt, Artificial Sequence
  derived and/or modified sequence opt11 from anti-HIV_CDR
gccgcgcucgaguuu

SEQ ID NO: 59179 - RNA, 15 nt, Artificial Sequence
  derived and/or modified sequence opt11 from anti-HIV_CDR
gcggugguggaguuu

SEQ ID NO: 59180 - RNA, 15 nt, Artificial Sequence
  derived and/or modified sequence opt11 from anti-HIV_CDR
caauuguucgaguuc

SEQ ID NO: 59181 - RNA, 15 nt, Artificial Sequence
  derived and/or modified sequence opt11 from anti-HIV_CDR
gccgucuuccaaugg

SEQ ID NO: 59182 - RNA, 15 nt, Artificial Sequence
  derived and/or modified sequence opt11 from anti-HIV_CDR
gccgugcucgaguuu

SEQ ID NO: 59183 - RNA, 15 nt, Artificial Sequence
  derived and/or modified sequence opt11 from anti-HIV_CDR
aacggguucgauguc

SEQ ID NO: 59184 - RNA, 15 nt, Artificial Sequence
  derived and/or modified sequence opt11 from anti-HIV_CDR
caacaguacgaauuc

SEQ ID NO: 59185 - RNA, 15 nt, Artificial Sequence
  derived and/or modified sequence opt11 from anti-HIV_CDR
caacacuacgaauuc

SEQ ID NO: 59186 - RNA, 15 nt, Artificial Sequence
  derived and/or modified sequence opt11 from anti-HIV_CDR
caaguguacgagguc

SEQ ID NO: 59187 - RNA, 15 nt, Artificial Sequence
  derived and/or modified sequence opt11 from anti-HIV_CDR
caaguguacgaguuc

SEQ ID NO: 59188 - RNA, 15 nt, Artificial Sequence
  derived and/or modified sequence opt11 from anti-HIV_CDR
uucucgaaagagagc

SEQ ID NO: 59189 - RNA, 15 nt, Artificial Sequence
  derived and/or modified sequence opt11 from anti-HIV_CDR
cucaagcucucgagc

SEQ ID NO: 59190 - RNA, 15 nt, Artificial Sequence
  derived and/or modified sequence opt11 from anti-HIV_CDR
uacaaggucucgagc

SEQ ID NO: 59191 - RNA, 15 nt, Artificial Sequence
  derived and/or modified sequence opt11 from anti-HIV_CDR
cccccacaagaaucc

SEQ ID NO: 59192 - RNA, 15 nt, Artificial Sequence
  derived and/or modified sequence opt11 from anti-HIV_CDR
accgcacgcgauuac

SEQ ID NO: 59193 - RNA, 15 nt, Artificial Sequence
  derived and/or modified sequence opt11 from anti-HIV_CDR
augcagucgauccag

SEQ ID NO: 59194 - RNA, 15 nt, Artificial Sequence
  derived and/or modified sequence opt11 from anti-HIV_CDR
caccaacucgacacc

SEQ ID NO: 59195 - RNA, 15 nt, Artificial Sequence
  derived and/or modified sequence opt11 from anti-HIV_CDR
caccaacucgacagc

SEQ ID NO: 59196 - RNA, 15 nt, Artificial Sequence
  derived and/or modified sequence opt11 from anti-HIV_CDR
caacaacucggcacc

SEQ ID NO: 59197 - RNA, 15 nt, Artificial Sequence
  derived and/or modified sequence opt11 from anti-HIV_CDR
caaaaagccaccaca

SEQ ID NO: 59198 - RNA, 15 nt, Artificial Sequence
  derived and/or modified sequence opt11 from anti-HIV_CDR
uuauuugccggcacc

SEQ ID NO: 59199 - RNA, 18 nt, Artificial Sequence
  derived and/or modified sequence opt11 from anti-HIV_CDR
guacgcgggagcucgcca

SEQ ID NO: 59200 - RNA, 18 nt, Artificial Sequence
  derived and/or modified sequence opt11 from anti-HIV_CDR
ggccugcucuuugucgug

SEQ ID NO: 59201 - RNA, 18 nt, Artificial Sequence
  derived and/or modified sequence opt11 from anti-HIV_CDR
auggacuggacauggagc

SEQ ID NO: 59202 - RNA, 18 nt, Artificial Sequence
  derived and/or modified sequence opt11 from anti-HIV_CDR
auggauuggacguggagg

SEQ ID NO: 59203 - RNA, 18 nt, Artificial Sequence
  derived and/or modified sequence opt11 from anti-HIV_CDR
augaaacaccucugguuc

SEQ ID NO: 59204 - RNA, 18 nt, Artificial Sequence
  derived and/or modified sequence opt11 from anti-HIV_CDR
auggacuggauauggagg

SEQ ID NO: 59205 - RNA, 18 nt, Artificial Sequence
  derived and/or modified sequence opt11 from anti-HIV_CDR
auggauuggacguggacg

SEQ ID NO: 59206 - RNA, 18 nt, Artificial Sequence
  derived and/or modified sequence opt11 from anti-HIV_CDR
augaaacaccucuuccuc

SEQ ID NO: 59207 - RNA, 18 nt, Artificial Sequence
  derived and/or modified sequence opt11 from anti-HIV_CDR
caacuccuccaauccaac

SEQ ID NO: 59208 - RNA, 18 nt, Artificial Sequence
  derived and/or modified sequence opt11 from anti-HIV_CDR
ggaggaucgcccgagcau

SEQ ID NO: 59209 - RNA, 18 nt, Artificial Sequence
  derived and/or modified sequence opt11 from anti-HIV_CDR
cuagagggcacggacuau

SEQ ID NO: 59210 - RNA, 18 nt, Artificial Sequence
  derived and/or modified sequence opt11 from anti-HIV_CDR
caacaauaccccuccacc

SEQ ID NO: 59211 - RNA, 21 nt, Artificial Sequence
  derived and/or modified sequence opt11 from anti-HIV_CDR
aacaaucacgaccgcccaagc

SEQ ID NO: 59212 - RNA, 21 nt, Artificial Sequence
  derived and/or modified sequence opt11 from anti-HIV_CDR
aacaaucaagaccgcccggcc

SEQ ID NO: 59213 - RNA, 21 nt, Artificial Sequence
  derived and/or modified sequence opt11 from anti-HIV_CDR
aacaauaacgaccgcccaagc

SEQ ID NO: 59214 - RNA, 21 nt, Artificial Sequence
  derived and/or modified sequence opt11 from anti-HIV_CDR
aacaaucaagaccgcccgagc

SEQ ID NO: 59215 - RNA, 21 nt, Artificial Sequence
  derived and/or modified sequence opt11 from anti-HIV_CDR
gacgacagcgaccgcccaagc

SEQ ID NO: 59216 - RNA, 21 nt, Artificial Sequence
  derived and/or modified sequence opt11 from anti-HIV_CDR
ugggcaagcacacgccauacc

SEQ ID NO: 59217 - RNA, 21 nt, Artificial Sequence
  derived and/or modified sequence opt11 from anti-HIV_CDR
ggcgcgaccgcgcgcgauuuc

SEQ ID NO: 59218 - RNA, 21 nt, Artificial Sequence
  derived and/or modified sequence opt11 from anti-HIV_CDR
gccuccaucaaacucgcccua

SEQ ID NO: 59219 - RNA, 21 nt, Artificial Sequence
  derived and/or modified sequence opt11 from anti-HIV_CDR
caacaauacggccgcucaccc

SEQ ID NO: 59220 - RNA, 21 nt, Artificial Sequence
  derived and/or modified sequence opt11 from anti-HIV_CDR
caacaauacuacaucuccccc

SEQ ID NO: 59221 - RNA, 21 nt, Artificial Sequence
  derived and/or modified sequence opt11 from anti-HIV_CDR
caacaaucccacucccccucc

SEQ ID NO: 59222 - RNA, 21 nt, Artificial Sequence
  derived and/or modified sequence opt11 from anti-HIV_CDR
gggaggugugcgaggaggugg

SEQ ID NO: 59223 - RNA, 21 nt, Artificial Sequence
  derived and/or modified sequence opt11 from anti-HIV_CDR
agguucuuguucguggucgcg

SEQ ID NO: 59224 - RNA, 21 nt, Artificial Sequence
  derived and/or modified sequence opt11 from anti-HIV_CDR
auguccgucuccuuccucauc

SEQ ID NO: 59225 - RNA, 21 nt, Artificial Sequence
  derived and/or modified sequence opt11 from anti-HIV_CDR
ggaagcucgaacaggugcccg

SEQ ID NO: 59226 - RNA, 21 nt, Artificial Sequence
  derived and/or modified sequence opt11 from anti-HIV_CDR
augaaacaccucugguucuuc

SEQ ID NO: 59227 - RNA, 21 nt, Artificial Sequence
  derived and/or modified sequence opt11 from anti-HIV_CDR
gccucaugggacuucgacuuc

SEQ ID NO: 59228 - RNA, 21 nt, Artificial Sequence
  derived and/or modified sequence opt11 from anti-HIV_CDR
gaaauagggguggcggagcau

SEQ ID NO: 59229 - RNA, 21 nt, Artificial Sequence
  derived and/or modified sequence opt11 from anti-HIV_CDR
caaaaauacgacaccgccccc

SEQ ID NO: 59230 - RNA, 21 nt, Artificial Sequence
  derived and/or modified sequence opt11 from anti-HIV_CDR
caacaauccuccuccaccccc

SEQ ID NO: 59231 - RNA, 21 nt, Artificial Sequence
  derived and/or modified sequence opt11 from anti-HIV_CDR
caacagagcgcaggcacaccc

SEQ ID NO: 59232 - RNA, 21 nt, Artificial Sequence
  derived and/or modified sequence opt11 from anti-HIV_CDR
caacaauccuccuccaaaccc

SEQ ID NO: 59233 - RNA, 21 nt, Artificial Sequence
  derived and/or modified sequence opt11 from anti-HIV_CDR
caagaauacaacaccuacacc

SEQ ID NO: 59234 - RNA, 21 nt, Artificial Sequence
  derived and/or modified sequence opt11 from anti-HIV_CDR
caagaauacaacaacuacaac

SEQ ID NO: 59235 - RNA, 21 nt, Artificial Sequence
  derived and/or modified sequence opt11 from anti-HIV_CDR
cacuacgacgcccuagacuac

SEQ ID NO: 59236 - RNA, 24 nt, Artificial Sequence
  derived and/or modified sequence opt11 from anti-HIV_CDR
gcgaucuuuaaagggguccagugc

SEQ ID NO: 59237 - RNA, 24 nt, Artificial Sequence
  derived and/or modified sequence opt11 from anti-HIV_CDR
ggcccccucggcgauuacgacuuc

SEQ ID NO: 59238 - RNA, 24 nt, Artificial Sequence
  derived and/or modified sequence opt11 from anti-HIV_CDR
caacaauacggcucaucccuccgc

SEQ ID NO: 59239 - RNA, 24 nt, Artificial Sequence
  derived and/or modified sequence opt11 from anti-HIV_CDR
caacaauacucccacuaccgcacc

SEQ ID NO: 59240 - RNA, 24 nt, Artificial Sequence
  derived and/or modified sequence opt11 from anti-HIV_CDR
caauacuacggcauguccgucacc

SEQ ID NO: 59241 - RNA, 24 nt, Artificial Sequence
  derived and/or modified sequence opt11 from anti-HIV_CDR
caacaguacgagaacuggcucaca

SEQ ID NO: 59242 - RNA, 24 nt, Artificial Sequence
  derived and/or modified sequence opt11 from anti-HIV_CDR
uccggaguccacuacauggacguc

SEQ ID NO: 59243 - RNA, 24 nt, Artificial Sequence
  derived and/or modified sequence opt11 from anti-HIV_CDR
caacaauacuccggcccccucacc

SEQ ID NO: 59244 - RNA, 24 nt, Artificial Sequence
  derived and/or modified sequence opt11 from anti-HIV_CDR
caacaauacuacaccguccccucc

SEQ ID NO: 59245 - RNA, 24 nt, Artificial Sequence
  derived and/or modified sequence opt11 from anti-HIV_CDR
caacaauacggcucauccaucacc

SEQ ID NO: 59246 - RNA, 24 nt, Artificial Sequence
  derived and/or modified sequence opt11 from anti-HIV_CDR
caccaauacaacaaaugggacacc

SEQ ID NO: 59247 - RNA, 24 nt, Artificial Sequence
  derived and/or modified sequence opt11 from anti-HIV_CDR
caacaauccuacaccaccccccuc

SEQ ID NO: 59248 - RNA, 24 nt, Artificial Sequence
  derived and/or modified sequence opt11 from anti-HIV_CDR
cagcgcugggaaacgaucgauuac

SEQ ID NO: 59249 - RNA, 24 nt, Artificial Sequence
  derived and/or modified sequence opt11 from anti-HIV_CDR
ugcucguacgcgggcucguacacg

SEQ ID NO: 59250 - RNA, 24 nt, Artificial Sequence
  derived and/or modified sequence opt11 from anti-HIV_CDR
caacaauacgacaaccuccccacc

SEQ ID NO: 59251 - RNA, 24 nt, Artificial Sequence
  derived and/or modified sequence opt11 from anti-HIV_CDR
caacaaugcacccucccccucacc

SEQ ID NO: 59252 - RNA, 24 nt, Artificial Sequence
  derived and/or modified sequence opt11 from anti-HIV_CDR
caacaauccuacuccuccgucacc

SEQ ID NO: 59253 - RNA, 24 nt, Artificial Sequence
  derived and/or modified sequence opt11 from anti-HIV_CDR
caacaaucccacaccuccgucacc

SEQ ID NO: 59254 - RNA, 24 nt, Artificial Sequence
  derived and/or modified sequence opt11 from anti-HIV_CDR
caacaaacauacgccuccgucacc

SEQ ID NO: 59255 - RNA, 24 nt, Artificial Sequence
  derived and/or modified sequence opt11 from anti-HIV_CDR
caacaauacaacuccgacuacacc

SEQ ID NO: 59256 - RNA, 24 nt, Artificial Sequence
  derived and/or modified sequence opt11 from anti-HIV_CDR
caccuauacgucuccagacccguc

SEQ ID NO: 59257 - RNA, 24 nt, Artificial Sequence
  derived and/or modified sequence opt11 from anti-HIV_CDR
caacaauacggccgcuccccccuc

SEQ ID NO: 59258 - RNA, 24 nt, Artificial Sequence
  derived and/or modified sequence opt11 from anti-HIV_CDR
caacaauacggcuccuccccccuc

SEQ ID NO: 59259 - RNA, 24 nt, Artificial Sequence
  derived and/or modified sequence opt11 from anti-HIV_CDR
caacaauacaacgacuggccagcc

SEQ ID NO: 59260 - RNA, 24 nt, Artificial Sequence
  derived and/or modified sequence opt11 from anti-HIV_CDR
caccaauacggcucaucccaacgc

SEQ ID NO: 59261 - RNA, 24 nt, Artificial Sequence
  derived and/or modified sequence opt11 from anti-HIV_CDR
caacaaaccuacuccuccgucacc

SEQ ID NO: 59262 - RNA, 24 nt, Artificial Sequence
  derived and/or modified sequence opt11 from anti-HIV_CDR
caacaaaccuaccgcuccgucacc

SEQ ID NO: 59263 - RNA, 24 nt, Artificial Sequence
  derived and/or modified sequence opt11 from anti-HIV_CDR
caacaauacggcucaagcuggacc

SEQ ID NO: 59264 - RNA, 24 nt, Artificial Sequence
  derived and/or modified sequence opt11 from anti-HIV_CDR
agcucauacgccggcauaaacaac

SEQ ID NO: 59265 - RNA, 24 nt, Artificial Sequence
  derived and/or modified sequence opt11 from anti-HIV_CDR
caaaaauacggcuccucccucacc

SEQ ID NO: 59266 - RNA, 24 nt, Artificial Sequence
  derived and/or modified sequence opt11 from anti-HIV_CDR
augcaagcgcucgagaccuugggc

SEQ ID NO: 59267 - RNA, 24 nt, Artificial Sequence
  derived and/or modified sequence opt11 from anti-HIV_CDR
caacaauacgccggcucccucacc

SEQ ID NO: 59268 - RNA, 24 nt, Artificial Sequence
  derived and/or modified sequence opt11 from anti-HIV_CDR
cggaacuggggcaauuucgaccac

SEQ ID NO: 59269 - RNA, 27 nt, Artificial Sequence
  derived and/or modified sequence opt11 from anti-HIV_CDR
caacaacacuacaccacccccuggacc

SEQ ID NO: 59270 - RNA, 27 nt, Artificial Sequence
  derived and/or modified sequence opt11 from anti-HIV_CDR
caacaauccuucgccguccccuacacc

SEQ ID NO: 59271 - RNA, 27 nt, Artificial Sequence
  derived and/or modified sequence opt11 from anti-HIV_CDR
caacaauacaaauccuacuccggcacc

SEQ ID NO: 59272 - RNA, 27 nt, Artificial Sequence
  derived and/or modified sequence opt11 from anti-HIV_CDR
caccaauacgccuacucaccccgcacc

SEQ ID NO: 59273 - RNA, 27 nt, Artificial Sequence
  derived and/or modified sequence opt11 from anti-HIV_CDR
caacaauacaacuccuucccccccacc

SEQ ID NO: 59274 - RNA, 27 nt, Artificial Sequence
  derived and/or modified sequence opt11 from anti-HIV_CDR
cagcaaacauacucaaacccgcgcaug

SEQ ID NO: 59275 - RNA, 27 nt, Artificial Sequence
  derived and/or modified sequence opt11 from anti-HIV_CDR
caacaauacgaagacccgcccuggacc

SEQ ID NO: 59276 - RNA, 27 nt, Artificial Sequence
  derived and/or modified sequence opt11 from anti-HIV_CDR
caccaauacuucaacaccccccgcacc

SEQ ID NO: 59277 - RNA, 27 nt, Artificial Sequence
  derived and/or modified sequence opt11 from anti-HIV_CDR
caccaauacuucuccaccccccgcacc

SEQ ID NO: 59278 - RNA, 27 nt, Artificial Sequence
  derived and/or modified sequence opt11 from anti-HIV_CDR
caacaccgcuccaacuggcccuggacc

SEQ ID NO: 59279 - RNA, 27 nt, Artificial Sequence
  derived and/or modified sequence opt11 from anti-HIV_CDR
cgcgggcgcaggcaaauaggcgauuac

SEQ ID NO: 59280 - RNA, 27 nt, Artificial Sequence
  derived and/or modified sequence opt11 from anti-HIV_CDR
caacaauacggccucucacccuggacc

SEQ ID NO: 59281 - RNA, 27 nt, Artificial Sequence
  derived and/or modified sequence opt11 from anti-HIV_CDR
caacaaaccuacaccucccccaucacc

SEQ ID NO: 59282 - RNA, 27 nt, Artificial Sequence
  derived and/or modified sequence opt11 from anti-HIV_CDR
caacaauacggcuccuccccccccacc

SEQ ID NO: 59283 - RNA, 27 nt, Artificial Sequence
  derived and/or modified sequence opt11 from anti-HIV_CDR
caacaauacggcaccuccuccugcacc

SEQ ID NO: 59284 - RNA, 27 nt, Artificial Sequence
  derived and/or modified sequence opt11 from anti-HIV_CDR
caacaauacgacgacgcacccauaacc

SEQ ID NO: 59285 - RNA, 27 nt, Artificial Sequence
  derived and/or modified sequence opt11 from anti-HIV_CDR
ggcccacuccuccgcuaucucgacagc

SEQ ID NO: 59286 - RNA, 27 nt, Artificial Sequence
  derived and/or modified sequence opt11 from anti-HIV_CDR
ugccucaaaaaaaccuccuccuacguc

SEQ ID NO: 59287 - RNA, 27 nt, Artificial Sequence
  derived and/or modified sequence opt11 from anti-HIV_CDR
caacaauacaaccacuggccccaaacc

SEQ ID NO: 59288 - RNA, 27 nt, Artificial Sequence
  derived and/or modified sequence opt11 from anti-HIV_CDR
caacaauacuccaaccuccccuacacc

SEQ ID NO: 59289 - RNA, 27 nt, Artificial Sequence
  derived and/or modified sequence opt11 from anti-HIV_CDR
caacaauacgacaccuaccccggcacc

SEQ ID NO: 59290 - RNA, 27 nt, Artificial Sequence
  derived and/or modified sequence opt11 from anti-HIV_CDR
caagaguacucgagcacgcccuauaac

SEQ ID NO: 59291 - RNA, 27 nt, Artificial Sequence
  derived and/or modified sequence opt11 from anti-HIV_CDR
ggggcgugggacgacacguuauaugua

SEQ ID NO: 59292 - RNA, 27 nt, Artificial Sequence
  derived and/or modified sequence opt11 from anti-HIV_CDR
gcggccugggacgacacauuauacgua

SEQ ID NO: 59293 - RNA, 27 nt, Artificial Sequence
  derived and/or modified sequence opt11 from anti-HIV_CDR
caacaauacuacuccgacuccaucacc

SEQ ID NO: 59294 - RNA, 27 nt, Artificial Sequence
  derived and/or modified sequence opt11 from anti-HIV_CDR
caacaauacggccgcucacccuacacc

SEQ ID NO: 59295 - RNA, 27 nt, Artificial Sequence
  derived and/or modified sequence opt11 from anti-HIV_CDR
caacaauacaccaacuaccccuggacc

SEQ ID NO: 59296 - RNA, 27 nt, Artificial Sequence
  derived and/or modified sequence opt11 from anti-HIV_CDR
caacaacgccacaacuggcccaucucc

SEQ ID NO: 59297 - RNA, 27 nt, Artificial Sequence
  derived and/or modified sequence opt11 from anti-HIV_CDR
caacaauaccacaacuggccccgcacc

SEQ ID NO: 59298 - RNA, 27 nt, Artificial Sequence
  derived and/or modified sequence opt11 from anti-HIV_CDR
caacaacgcuccaccuggccccccacc

SEQ ID NO: 59299 - RNA, 27 nt, Artificial Sequence
  derived and/or modified sequence opt11 from anti-HIV_CDR
caacaauacgacuccuucuccuggacc

SEQ ID NO: 59300 - RNA, 27 nt, Artificial Sequence
  derived and/or modified sequence opt11 from anti-HIV_CDR
caacaauacaacaaccuccccgucacc

SEQ ID NO: 59301 - RNA, 27 nt, Artificial Sequence
  derived and/or modified sequence opt11 from anti-HIV_CDR
caacaauacaaccgcuacuccuacacc

SEQ ID NO: 59302 - RNA, 27 nt, Artificial Sequence
  derived and/or modified sequence opt11 from anti-HIV_CDR
caagaauacuacauccuccccugcucc

SEQ ID NO: 59303 - RNA, 27 nt, Artificial Sequence
  derived and/or modified sequence opt11 from anti-HIV_CDR
caacaauacgacaaccuacucgcccac

SEQ ID NO: 59304 - RNA, 27 nt, Artificial Sequence
  derived and/or modified sequence opt11 from anti-HIV_CDR
caccagugcgauaacuugaucgcacgc

SEQ ID NO: 59305 - RNA, 27 nt, Artificial Sequence
  derived and/or modified sequence opt11 from anti-HIV_CDR
caacaauccuucuccacccucuggacc

SEQ ID NO: 59306 - RNA, 27 nt, Artificial Sequence
  derived and/or modified sequence opt11 from anti-HIV_CDR
caccaauccuacuccaccccccccacc

SEQ ID NO: 59307 - RNA, 27 nt, Artificial Sequence
  derived and/or modified sequence opt11 from anti-HIV_CDR
caacaaggcuacuccacccccuggacc

SEQ ID NO: 59308 - RNA, 27 nt, Artificial Sequence
  derived and/or modified sequence opt11 from anti-HIV_CDR
caacaauacuccaccaccccccgcacc

SEQ ID NO: 59309 - RNA, 27 nt, Artificial Sequence
  derived and/or modified sequence opt11 from anti-HIV_CDR
caacucuacaacuccgucccccaaacc

SEQ ID NO: 59310 - RNA, 27 nt, Artificial Sequence
  derived and/or modified sequence opt11 from anti-HIV_CDR
caacaacgcaccuccuggccccaaacc

SEQ ID NO: 59311 - RNA, 27 nt, Artificial Sequence
  derived and/or modified sequence opt11 from anti-HIV_CDR
caacaauucaacaccuacucccaaacc

SEQ ID NO: 59312 - RNA, 27 nt, Artificial Sequence
  derived and/or modified sequence opt11 from anti-HIV_CDR
augcaaucccuccaaacccccaucacc

SEQ ID NO: 59313 - RNA, 27 nt, Artificial Sequence
  derived and/or modified sequence opt11 from anti-HIV_CDR
caacaauacaacuccuacccccucacc

SEQ ID NO: 59314 - RNA, 27 nt, Artificial Sequence
  derived and/or modified sequence opt11 from anti-HIV_CDR
caacaauacaacuccuacuccggcacc

SEQ ID NO: 59315 - RNA, 27 nt, Artificial Sequence
  derived and/or modified sequence opt11 from anti-HIV_CDR
caauccuacgacuccucacucuccggc

SEQ ID NO: 59316 - RNA, 27 nt, Artificial Sequence
  derived and/or modified sequence opt11 from anti-HIV_CDR
agccaaggcaauaccgcaaucgacuac

SEQ ID NO: 59317 - RNA, 27 nt, Artificial Sequence
  derived and/or modified sequence opt11 from anti-HIV_CDR
gaggaacccagggacgcguucgaucua

SEQ ID NO: 59318 - RNA, 27 nt, Artificial Sequence
  derived and/or modified sequence opt11 from anti-HIV_CDR
caacaauccuacaccacccccgucacc

SEQ ID NO: 59319 - RNA, 27 nt, Artificial Sequence
  derived and/or modified sequence opt11 from anti-HIV_CDR
gccgggcgagagggcugguucgaucca

SEQ ID NO: 59320 - RNA, 27 nt, Artificial Sequence
  derived and/or modified sequence opt11 from anti-HIV_CDR
caacaauacuacuccaccccccacacc

SEQ ID NO: 59321 - RNA, 27 nt, Artificial Sequence
  derived and/or modified sequence opt11 from anti-HIV_CDR
cagcaaucguacucgaucgcgggcacg

SEQ ID NO: 59322 - RNA, 27 nt, Artificial Sequence
  derived and/or modified sequence opt11 from anti-HIV_CDR
caaaacuacaacaaacccccccgcacc

SEQ ID NO: 59323 - RNA, 27 nt, Artificial Sequence
  derived and/or modified sequence opt11 from anti-HIV_CDR
augcaauccauccaacucccccucacc

SEQ ID NO: 59324 - RNA, 27 nt, Artificial Sequence
  derived and/or modified sequence opt11 from anti-HIV_CDR
augcaagcgcuccagaccucgcucacg

SEQ ID NO: 59325 - RNA, 27 nt, Artificial Sequence
  derived and/or modified sequence opt11 from anti-HIV_CDR
caacaauacuccuccuccccccgcacc

SEQ ID NO: 59326 - RNA, 27 nt, Artificial Sequence
  derived and/or modified sequence opt11 from anti-HIV_CDR
caagcgugggauagcucgaccgcgguc

SEQ ID NO: 59327 - RNA, 27 nt, Artificial Sequence
  derived and/or modified sequence opt11 from anti-HIV_CDR
caacacuacaacaacuggcccuacacc

SEQ ID NO: 59328 - RNA, 27 nt, Artificial Sequence
  derived and/or modified sequence opt11 from anti-HIV_CDR
caacaauacgaccgccuacccauaacc

SEQ ID NO: 59329 - RNA, 27 nt, Artificial Sequence
  derived and/or modified sequence opt11 from anti-HIV_CDR
caacaauacggcuccucacccaucacc

SEQ ID NO: 59330 - RNA, 27 nt, Artificial Sequence
  derived and/or modified sequence opt11 from anti-HIV_CDR
caacaauacgacgucuggccccucacc

SEQ ID NO: 59331 - RNA, 27 nt, Artificial Sequence
  derived and/or modified sequence opt11 from anti-HIV_CDR
caccaauacgccuccucaccccgcacc

SEQ ID NO: 59332 - RNA, 27 nt, Artificial Sequence
  derived and/or modified sequence opt11 from anti-HIV_CDR
augcaaucccuccaccuccccuacacc

SEQ ID NO: 59333 - RNA, 27 nt, Artificial Sequence
  derived and/or modified sequence opt11 from anti-HIV_CDR
caacaauacuacuccuccccccucacc

SEQ ID NO: 59334 - RNA, 27 nt, Artificial Sequence
  derived and/or modified sequence opt11 from anti-HIV_CDR
caacaacacgacaccuuccccuucacc

SEQ ID NO: 59335 - RNA, 27 nt, Artificial Sequence
  derived and/or modified sequence opt11 from anti-HIV_CDR
caacaauccuacuccacccccuacacc

SEQ ID NO: 59336 - RNA, 27 nt, Artificial Sequence
  derived and/or modified sequence opt11 from anti-HIV_CDR
caacaauacaaaaccuaccccgucacc

SEQ ID NO: 59337 - RNA, 27 nt, Artificial Sequence
  derived and/or modified sequence opt11 from anti-HIV_CDR
caacaauacuacuccacccccgucacc

SEQ ID NO: 59338 - RNA, 27 nt, Artificial Sequence
  derived and/or modified sequence opt11 from anti-HIV_CDR
caacaauacaacuggccccccuucacc

SEQ ID NO: 59339 - RNA, 27 nt, Artificial Sequence
  derived and/or modified sequence opt11 from anti-HIV_CDR
augcaaggaacccacuggccauggaca

SEQ ID NO: 59340 - RNA, 27 nt, Artificial Sequence
  derived and/or modified sequence opt11 from anti-HIV_CDR
caccaaugcggcuccucaccccgcacc

SEQ ID NO: 59341 - RNA, 27 nt, Artificial Sequence
  derived and/or modified sequence opt11 from anti-HIV_CDR
caacaauacaacuccuacuuccgcacc

SEQ ID NO: 59342 - RNA, 27 nt, Artificial Sequence
  derived and/or modified sequence opt11 from anti-HIV_CDR
caacaauaccacaacuggccccccucc

SEQ ID NO: 59343 - RNA, 27 nt, Artificial Sequence
  derived and/or modified sequence opt11 from anti-HIV_CDR
augcagggaacguacuggcuguggaca

SEQ ID NO: 59344 - RNA, 27 nt, Artificial Sequence
  derived and/or modified sequence opt11 from anti-HIV_CDR
caacaaggcuucuccgcccccuucacc

SEQ ID NO: 59345 - RNA, 27 nt, Artificial Sequence
  derived and/or modified sequence opt11 from anti-HIV_CDR
caacaauacaacaccuacccccucacc

SEQ ID NO: 59346 - RNA, 27 nt, Artificial Sequence
  derived and/or modified sequence opt11 from anti-HIV_CDR
augcaaggaacccacuggccacgcaca

SEQ ID NO: 59347 - RNA, 27 nt, Artificial Sequence
  derived and/or modified sequence opt11 from anti-HIV_CDR
uucgggcgcacgcccugguucgauccc

SEQ ID NO: 59348 - RNA, 27 nt, Artificial Sequence
  derived and/or modified sequence opt11 from anti-HIV_CDR
caacaauacuucaccuccgucaucacc

SEQ ID NO: 59349 - RNA, 27 nt, Artificial Sequence
  derived and/or modified sequence opt11 from anti-HIV_CDR
caccacuacauguccgaccuccaaacc

SEQ ID NO: 59350 - RNA, 27 nt, Artificial Sequence
  derived and/or modified sequence opt11 from anti-HIV_CDR
caccacuacuccuccuccucccacacc

SEQ ID NO: 59351 - RNA, 27 nt, Artificial Sequence
  derived and/or modified sequence opt11 from anti-HIV_CDR
caccacuacaaauccgacugccaaacc

SEQ ID NO: 59352 - RNA, 27 nt, Artificial Sequence
  derived and/or modified sequence opt11 from anti-HIV_CDR
cagcacagaagcucguggccgcucaca

SEQ ID NO: 59353 - RNA, 27 nt, Artificial Sequence
  derived and/or modified sequence opt11 from anti-HIV_CDR
cuccaacaccacuccuaccccuggacc

SEQ ID NO: 59354 - RNA, 27 nt, Artificial Sequence
  derived and/or modified sequence opt11 from anti-HIV_CDR
caacaauacggcaccucacccggcacc

SEQ ID NO: 59355 - RNA, 27 nt, Artificial Sequence
  derived and/or modified sequence opt11 from anti-HIV_CDR
caacaauacggcuccucacccaccacc

SEQ ID NO: 59356 - RNA, 27 nt, Artificial Sequence
  derived and/or modified sequence opt11 from anti-HIV_CDR
caacaauacggcaccucacccaccacc

SEQ ID NO: 59357 - RNA, 27 nt, Artificial Sequence
  derived and/or modified sequence opt11 from anti-HIV_CDR
augcaagcaacccacuggccacccgga

SEQ ID NO: 59358 - RNA, 27 nt, Artificial Sequence
  derived and/or modified sequence opt11 from anti-HIV_CDR
caacgcuacaaccgcgaccccuacauc

SEQ ID NO: 59359 - RNA, 27 nt, Artificial Sequence
  derived and/or modified sequence opt11 from anti-HIV_CDR
caacaauacgacaaccuaccccucgcc

SEQ ID NO: 59360 - RNA, 27 nt, Artificial Sequence
  derived and/or modified sequence opt11 from anti-HIV_CDR
ucaucauacuccgccaccggcgucgcc

SEQ ID NO: 59361 - RNA, 27 nt, Artificial Sequence
  derived and/or modified sequence opt11 from anti-HIV_CDR
caacacuacggcaacucacgcuggacc

SEQ ID NO: 59362 - RNA, 27 nt, Artificial Sequence
  derived and/or modified sequence opt11 from anti-HIV_CDR
caacaauacgaaaccuaccccuggacc

SEQ ID NO: 59363 - RNA, 27 nt, Artificial Sequence
  derived and/or modified sequence opt11 from anti-HIV_CDR
caacaauacggcuccucccccuccacc

SEQ ID NO: 59364 - RNA, 27 nt, Artificial Sequence
  derived and/or modified sequence opt11 from anti-HIV_CDR
caacaaucccaacgcaccccccacacc

SEQ ID NO: 59365 - RNA, 27 nt, Artificial Sequence
  derived and/or modified sequence opt11 from anti-HIV_CDR
caacaauacgacauccucccccucacc

SEQ ID NO: 59366 - RNA, 27 nt, Artificial Sequence
  derived and/or modified sequence opt11 from anti-HIV_CDR
caacaauccaacuccucccccuggacc

SEQ ID NO: 59367 - RNA, 27 nt, Artificial Sequence
  derived and/or modified sequence opt11 from anti-HIV_CDR
caacaaucauacgacaccccccgcacc

SEQ ID NO: 59368 - RNA, 27 nt, Artificial Sequence
  derived and/or modified sequence opt11 from anti-HIV_CDR
caacaauucggcuccucacccggcacc

SEQ ID NO: 59369 - RNA, 27 nt, Artificial Sequence
  derived and/or modified sequence opt11 from anti-HIV_CDR
caccaauacggcuccucaccccaaacc

SEQ ID NO: 59370 - RNA, 27 nt, Artificial Sequence
  derived and/or modified sequence opt11 from anti-HIV_CDR
caccaauacggcuccucaccccaaucc

SEQ ID NO: 59371 - RNA, 27 nt, Artificial Sequence
  derived and/or modified sequence opt11 from anti-HIV_CDR
cuccaacacaacuccuacccccucacc

SEQ ID NO: 59372 - RNA, 27 nt, Artificial Sequence
  derived and/or modified sequence opt11 from anti-HIV_CDR
caacaauacaacgacuggcccaucacc

SEQ ID NO: 59373 - RNA, 27 nt, Artificial Sequence
  derived and/or modified sequence opt11 from anti-HIV_CDR
caacaaaccuucaccuuccccuacacc

SEQ ID NO: 59374 - RNA, 27 nt, Artificial Sequence
  derived and/or modified sequence opt11 from anti-HIV_CDR
caacaauccuacaccuuccccuacauc

SEQ ID NO: 59375 - RNA, 27 nt, Artificial Sequence
  derived and/or modified sequence opt11 from anti-HIV_CDR
caauacuacggcuccucccccuacacc

SEQ ID NO: 59376 - RNA, 27 nt, Artificial Sequence
  derived and/or modified sequence opt11 from anti-HIV_CDR
caacaauccuucggcaccccccgcacc

SEQ ID NO: 59377 - RNA, 27 nt, Artificial Sequence
  derived and/or modified sequence opt11 from anti-HIV_CDR
caacaauacaacgacuggccccgcacc

SEQ ID NO: 59378 - RNA, 27 nt, Artificial Sequence
  derived and/or modified sequence opt11 from anti-HIV_CDR
caacaauacggcuccucaccccgcacc

SEQ ID NO: 59379 - RNA, 27 nt, Artificial Sequence
  derived and/or modified sequence opt11 from anti-HIV_CDR
cuccaacacaaccgcuaccccuggacc

SEQ ID NO: 59380 - RNA, 27 nt, Artificial Sequence
  derived and/or modified sequence opt11 from anti-HIV_CDR
cuccaacacaacaacuaccccuggacc

SEQ ID NO: 59381 - RNA, 27 nt, Artificial Sequence
  derived and/or modified sequence opt11 from anti-HIV_CDR
cuccaauacuccaccuacccccucacc

SEQ ID NO: 59382 - RNA, 27 nt, Artificial Sequence
  derived and/or modified sequence opt11 from anti-HIV_CDR
cuccaauacaacgccuacccccucacc

SEQ ID NO: 59383 - RNA, 27 nt, Artificial Sequence
  derived and/or modified sequence opt11 from anti-HIV_CDR
caacaauacgacuccgcacccguaacc

SEQ ID NO: 59384 - RNA, 27 nt, Artificial Sequence
  derived and/or modified sequence opt11 from anti-HIV_CDR
caacaaaccuacaccuuccccuacucc

SEQ ID NO: 59385 - RNA, 27 nt, Artificial Sequence
  derived and/or modified sequence opt11 from anti-HIV_CDR
ggcuacgacaacucaggcccggacuau

SEQ ID NO: 59386 - RNA, 27 nt, Artificial Sequence
  derived and/or modified sequence opt11 from anti-HIV_CDR
caacaauacaacaacuggccccccgcc

SEQ ID NO: 59387 - RNA, 27 nt, Artificial Sequence
  derived and/or modified sequence opt11 from anti-HIV_CDR
caccaauacgcccucucacccuggacc

SEQ ID NO: 59388 - RNA, 27 nt, Artificial Sequence
  derived and/or modified sequence opt11 from anti-HIV_CDR
caaaaauacgacaccgaccccaugacc

SEQ ID NO: 59389 - RNA, 27 nt, Artificial Sequence
  derived and/or modified sequence opt11 from anti-HIV_CDR
caacaauacaacuacuaccccaucacc

SEQ ID NO: 59390 - RNA, 27 nt, Artificial Sequence
  derived and/or modified sequence opt11 from anti-HIV_CDR
caacaaaccuucaccgaccccgucacc

SEQ ID NO: 59391 - RNA, 27 nt, Artificial Sequence
  derived and/or modified sequence opt11 from anti-HIV_CDR
gcggccugggacgauaguuugcacgug

SEQ ID NO: 59392 - RNA, 27 nt, Artificial Sequence
  derived and/or modified sequence opt11 from anti-HIV_CDR
caacaauacgccuccucacccuucacc

SEQ ID NO: 59393 - RNA, 27 nt, Artificial Sequence
  derived and/or modified sequence opt11 from anti-HIV_CDR
caacaauccuccuccacccccuucacc

SEQ ID NO: 59394 - RNA, 27 nt, Artificial Sequence
  derived and/or modified sequence opt11 from anti-HIV_CDR
cagcaaaggagcaacugggcgaucaca

SEQ ID NO: 59395 - RNA, 27 nt, Artificial Sequence
  derived and/or modified sequence opt11 from anti-HIV_CDR
caacaauacggcuccucccccuucacc

SEQ ID NO: 59396 - RNA, 27 nt, Artificial Sequence
  derived and/or modified sequence opt11 from anti-HIV_CDR
caaaaauacaacggcgcccccuggacc

SEQ ID NO: 59397 - RNA, 27 nt, Artificial Sequence
  derived and/or modified sequence opt11 from anti-HIV_CDR
caaaaauacaacaacgcccccuggacc

SEQ ID NO: 59398 - RNA, 27 nt, Artificial Sequence
  derived and/or modified sequence opt11 from anti-HIV_CDR
caacaacgcgucaacuggcccccaaac

SEQ ID NO: 59399 - RNA, 27 nt, Artificial Sequence
  derived and/or modified sequence opt11 from anti-HIV_CDR
caacaacgcggccacuggccccuaacc

SEQ ID NO: 59400 - RNA, 27 nt, Artificial Sequence
  derived and/or modified sequence opt11 from anti-HIV_CDR
caacaauaccgcuacuccgucaucauc

SEQ ID NO: 59401 - RNA, 27 nt, Artificial Sequence
  derived and/or modified sequence opt11 from anti-HIV_CDR
caacaauccggcaccucccuccucacc

SEQ ID NO: 59402 - RNA, 27 nt, Artificial Sequence
  derived and/or modified sequence opt11 from anti-HIV_CDR
augaaaucccaacacucaccccgcacc

SEQ ID NO: 59403 - RNA, 27 nt, Artificial Sequence
  derived and/or modified sequence opt11 from anti-HIV_CDR
augcaaccccuccaaacccccuacacc

SEQ ID NO: 59404 - RNA, 27 nt, Artificial Sequence
  derived and/or modified sequence opt11 from anti-HIV_CDR
caacaauacaccgccuaccccuggacc

SEQ ID NO: 59405 - RNA, 27 nt, Artificial Sequence
  derived and/or modified sequence opt11 from anti-HIV_CDR
cuccaaaaccacaacuacccccgcacc

SEQ ID NO: 59406 - RNA, 27 nt, Artificial Sequence
  derived and/or modified sequence opt11 from anti-HIV_CDR
cuccaaacccacuccuacccccgcacc

SEQ ID NO: 59407 - RNA, 30 nt, Artificial Sequence
  derived and/or modified sequence opt11 from anti-HIV_CDR
gccgccugggacgacucauucgacuacgua

SEQ ID NO: 59408 - RNA, 30 nt, Artificial Sequence
  derived and/or modified sequence opt11 from anti-HIV_CDR
caacacuccuucggcucaccccccuggacc

SEQ ID NO: 59409 - RNA, 30 nt, Artificial Sequence
  derived and/or modified sequence opt11 from anti-HIV_CDR
agcucauucacgcccacaaacacgcucgug

SEQ ID NO: 59410 - RNA, 30 nt, Artificial Sequence
  derived and/or modified sequence opt11 from anti-HIV_CDR
caacaauacggcacccuacacccccgcacc

SEQ ID NO: 59411 - RNA, 30 nt, Artificial Sequence
  derived and/or modified sequence opt11 from anti-HIV_CDR
caacaauacaacaacuggccccccaucacc

SEQ ID NO: 59412 - RNA, 30 nt, Artificial Sequence
  derived and/or modified sequence opt11 from anti-HIV_CDR
caacaauacuaccaauggcucuccuacacc

SEQ ID NO: 59413 - RNA, 30 nt, Artificial Sequence
  derived and/or modified sequence opt11 from anti-HIV_CDR
caacagcgcgcaaacuggcgccugcucaca

SEQ ID NO: 59414 - RNA, 30 nt, Artificial Sequence; identical to SEQ ID NO: 21204
  derived and/or modified sequence opt11 from anti-HIV_CDR

SEQ ID NO: 59415 - RNA, 30 nt, Artificial Sequence
  derived and/or modified sequence opt11 from anti-HIV_CDR
cgccgauccgacuacugcgacuucgacguc

SEQ ID NO: 59416 - RNA, 30 nt, Artificial Sequence
  derived and/or modified sequence opt11 from anti-HIV_CDR
cgacacaccgacuacugcgacuucgacguc

SEQ ID NO: 59417 - RNA, 30 nt, Artificial Sequence
  derived and/or modified sequence opt11 from anti-HIV_CDR
caacgauccgacuacugggacuucgacguc

SEQ ID NO: 59418 - RNA, 30 nt, Artificial Sequence; identical to SEQ ID NO: 21208
  derived and/or modified sequence opt11 from anti-HIV_CDR

SEQ ID NO: 59419 - RNA, 30 nt, Artificial Sequence
  derived and/or modified sequence opt11 from anti-HIV_CDR
ugcgaggucgaugccgaugaaacgauaacg

SEQ ID NO: 59420 - RNA, 30 nt, Artificial Sequence
  derived and/or modified sequence opt11 from anti-HIV_CDR
ugcgaggucgaugccgaggaaacgauaaua

SEQ ID NO: 59421 - RNA, 30 nt, Artificial Sequence
  derived and/or modified sequence opt11 from anti-HIV_CDR
caacgauccgacuucugggacuucgacguc

SEQ ID NO: 59422 - RNA, 30 nt, Artificial Sequence; identical to SEQ ID NO: 21212
  derived and/or modified sequence opt11 from anti-HIV_CDR

SEQ ID NO: 59423 - RNA, 30 nt, Artificial Sequence
  derived and/or modified sequence opt11 from anti-HIV_CDR
ugcucguacgcgggcgggcgaacggucgug

SEQ ID NO: 59424 - RNA, 30 nt, Artificial Sequence
  derived and/or modified sequence opt11 from anti-HIV_CDR
gccgcgugggaugacucgcuagauuacgug

SEQ ID NO: 59425 - RNA, 30 nt, Artificial Sequence
  derived and/or modified sequence opt11 from anti-HIV_CDR
caacaacgcuccaacuggccccgccucacc

SEQ ID NO: 59426 - RNA, 30 nt, Artificial Sequence
  derived and/or modified sequence opt11 from anti-HIV_CDR
caacaauacaacaacuggccccccuucacc

SEQ ID NO: 59427 - RNA, 30 nt, Artificial Sequence
  derived and/or modified sequence opt11 from anti-HIV_CDR
augcaaggcaccuacuggccaccccuaacc

SEQ ID NO: 59428 - RNA, 30 nt, Artificial Sequence
  derived and/or modified sequence opt11 from anti-HIV_CDR
caacaauacggcuccucccuccucuacacc

SEQ ID NO: 59429 - RNA, 30 nt, Artificial Sequence
  derived and/or modified sequence opt11 from anti-HIV_CDR
caacaauccuucggcauaccccccuggacc

SEQ ID NO: 59430 - RNA, 30 nt, Artificial Sequence
  derived and/or modified sequence opt11 from anti-HIV_CDR
ugcucguacgcgggcucguacucguacgug

SEQ ID NO: 59431 - RNA, 30 nt, Artificial Sequence
  derived and/or modified sequence opt11 from anti-HIV_CDR
uacucguacgcgggcaauagcuugggcgug

SEQ ID NO: 59432 - RNA, 30 nt, Artificial Sequence; identical to SEQ ID NO: 21222
  derived and/or modified sequence opt11 from anti-HIV_CDR

SEQ ID NO: 59433 - RNA, 30 nt, Artificial Sequence
  derived and/or modified sequence opt11 from anti-HIV_CDR
caagaaugggaacuccaacccuucgacuac

SEQ ID NO: 59434 - RNA, 30 nt, Artificial Sequence
  derived and/or modified sequence opt11 from anti-HIV_CDR
cucauacccgucuccggcgccuucgacguc

SEQ ID NO: 59435 - RNA, 30 nt, Artificial Sequence
  derived and/or modified sequence opt11 from anti-HIV_CDR
gaccgcgauuacgaugaagacuucgacuuc

SEQ ID NO: 59436 - RNA, 30 nt, Artificial Sequence
  derived and/or modified sequence opt11 from anti-HIV_CDR
caagaauacggccgcucaccacccuucccc

SEQ ID NO: 59437 - RNA, 30 nt, Artificial Sequence
  derived and/or modified sequence opt11 from anti-HIV_CDR
acacucgacggcaacuuccacugggacuuc

SEQ ID NO: 59438 - RNA, 30 nt, Artificial Sequence
  derived and/or modified sequence opt11 from anti-HIV_CDR
uucacccaacgccaaggcggcuucgacuac

SEQ ID NO: 59439 - RNA, 30 nt, Artificial Sequence
  derived and/or modified sequence opt11 from anti-HIV_CDR
caacaauacuacaaauggccccccaucacc

SEQ ID NO: 59440 - RNA, 30 nt, Artificial Sequence
  derived and/or modified sequence opt11 from anti-HIV_CDR
caacaauacggcuccuccgcccccuacacc

SEQ ID NO: 59441 - RNA, 30 nt, Artificial Sequence
  derived and/or modified sequence opt11 from anti-HIV_CDR
caacaacucaacuccgacccccccuggacc

SEQ ID NO: 59442 - RNA, 30 nt, Artificial Sequence
  derived and/or modified sequence opt11 from anti-HIV_CDR
caacaccacggcuccuccccaaccuggacc

SEQ ID NO: 59443 - RNA, 30 nt, Artificial Sequence
  derived and/or modified sequence opt11 from anti-HIV_CDR
caacaauacaaaaaauggccccccuggacc

SEQ ID NO: 59444 - RNA, 30 nt, Artificial Sequence
  derived and/or modified sequence opt11 from anti-HIV_CDR
caacaauacggcuucucccuccccgucacc

SEQ ID NO: 59445 - RNA, 30 nt, Artificial Sequence
  derived and/or modified sequence opt11 from anti-HIV_CDR
caaucauacaacggcgacccccccgucacc

SEQ ID NO: 59446 - RNA, 30 nt, Artificial Sequence
  derived and/or modified sequence opt11 from anti-HIV_CDR
caacaguacgggagcucgagaagguggacg

SEQ ID NO: 59447 - RNA, 30 nt, Artificial Sequence; identical to SEQ ID NO: 51805
  derived and/or modified sequence opt11 from anti-HIV_CDR

SEQ ID NO: 59448 - RNA, 30 nt, Artificial Sequence
  derived and/or modified sequence opt11 from anti-HIV_CDR
agagagggcucgcaaggggccuuugacaua

SEQ ID NO: 59449 - RNA, 30 nt, Artificial Sequence
  derived and/or modified sequence opt11 from anti-HIV_CDR
ggcgacagcgggccaacaggauuugacuau

SEQ ID NO: 59450 - RNA, 30 nt, Artificial Sequence
  derived and/or modified sequence opt11 from anti-HIV_CDR
gucaggagagggagcucguacccggacuau

SEQ ID NO: 59451 - RNA, 30 nt, Artificial Sequence; identical to SEQ ID NO: 21241
  derived and/or modified sequence opt11 from anti-HIV_CDR

SEQ ID NO: 59452 - RNA, 30 nt, Artificial Sequence
  derived and/or modified sequence opt11 from anti-HIV_CDR
caaucguacgauagcucggucucggucgug

SEQ ID NO: 59453 - RNA, 30 nt, Artificial Sequence; identical to SEQ ID NO: 21243
  derived and/or modified sequence opt11 from anti-HIV_CDR

SEQ ID NO: 59454 - RNA, 30 nt, Artificial Sequence
  derived and/or modified sequence opt11 from anti-HIV_CDR
uacgagggcaagagaucgggcauggacgug

SEQ ID NO: 59455 - RNA, 30 nt, Artificial Sequence
  derived and/or modified sequence opt11 from anti-HIV_CDR
caacaguacggaagcucgcccgaguacaca

SEQ ID NO: 59456 - RNA, 30 nt, Artificial Sequence
  derived and/or modified sequence opt11 from anti-HIV_CDR
caauacuacgaccacagacccgccaucgcc

SEQ ID NO: 59457 - RNA, 30 nt, Artificial Sequence
  derived and/or modified sequence opt11 from anti-HIV_CDR
caacaauacgacaaccucccccgcgucacc

SEQ ID NO: 59458 - RNA, 30 nt, Artificial Sequence
  derived and/or modified sequence opt11 from anti-HIV_CDR
ggcgcguacacgaccacgagcacgcucgug

SEQ ID NO: 59459 - RNA, 30 nt, Artificial Sequence; identical to SEQ ID NO: 51817
  derived and/or modified sequence opt11 from anti-HIV_CDR

SEQ ID NO: 59460 - RNA, 30 nt, Artificial Sequence
  derived and/or modified sequence opt11 from anti-HIV_CDR
caacaauccuacaacacccgcccccucacc

SEQ ID NO: 59461 - RNA, 30 nt, Artificial Sequence
  derived and/or modified sequence opt11 from anti-HIV_CDR
caacaguacggaggcucgccaccggacaca

SEQ ID NO: 59462 - RNA, 30 nt, Artificial Sequence; identical to SEQ ID NO: 21252
  derived and/or modified sequence opt11 from anti-HIV_CDR

SEQ ID NO: 59463 - RNA, 30 nt, Artificial Sequence; identical to SEQ ID NO: 21253
  derived and/or modified sequence opt11 from anti-HIV_CDR

SEQ ID NO: 59464 - RNA, 30 nt, Artificial Sequence
  derived and/or modified sequence opt11 from anti-HIV_CDR
caacacuacggcaacagcccacgcguaacc

SEQ ID NO: 59465 - RNA, 30 nt, Artificial Sequence
  derived and/or modified sequence opt11 from anti-HIV_CDR
gacgcguucgugagcucggccauggacgug

SEQ ID NO: 59466 - RNA, 30 nt, Artificial Sequence
  derived and/or modified sequence opt11 from anti-HIV_CDR
uugcgcgcgaccacgcccggguucgauuac

SEQ ID NO: 59467 - RNA, 30 nt, Artificial Sequence
  derived and/or modified sequence opt11 from anti-HIV_CDR
cuacgcgcaaccauacccggauucgacuac

SEQ ID NO: 59468 - RNA, 30 nt, Artificial Sequence
  derived and/or modified sequence opt11 from anti-HIV_CDR
cuccgcgccaccauagccggauucgacuac

SEQ ID NO: 59469 - RNA, 30 nt, Artificial Sequence
  derived and/or modified sequence opt11 from anti-HIV_CDR
ugcucguacgcgggcucguacauaugggug

SEQ ID NO: 59470 - RNA, 30 nt, Artificial Sequence
  derived and/or modified sequence opt11 from anti-HIV_CDR
ugcucguacgcgggcacguacucguacgug

SEQ ID NO: 59471 - RNA, 30 nt, Artificial Sequence
  derived and/or modified sequence opt11 from anti-HIV_CDR
agcucguacgcgggcucgaacaauuucgug

SEQ ID NO: 59472 - RNA, 30 nt, Artificial Sequence; identical to SEQ ID NO: 21262
  derived and/or modified sequence opt11 from anti-HIV_CDR

SEQ ID NO: 59473 - RNA, 30 nt, Artificial Sequence
  derived and/or modified sequence opt11 from anti-HIV_CDR
caacaauacgccaccuccucccucuacacc

SEQ ID NO: 59474 - RNA, 30 nt, Artificial Sequence
  derived and/or modified sequence opt11 from anti-HIV_CDR
caaugguacggcacccuacacccccgcacc

SEQ ID NO: 59475 - RNA, 30 nt, Artificial Sequence; identical to SEQ ID NO: 21265
  derived and/or modified sequence opt11 from anti-HIV_CDR

SEQ ID NO: 59476 - RNA, 30 nt, Artificial Sequence; identical to SEQ ID NO: 21266
  derived and/or modified sequence opt11 from anti-HIV_CDR

SEQ ID NO: 59477 - RNA, 30 nt, Artificial Sequence
  derived and/or modified sequence opt11 from anti-HIV_CDR
acgggcgggcucuugcgcuuuccagagguc

SEQ ID NO: 59478 - RNA, 30 nt, Artificial Sequence
  derived and/or modified sequence opt11 from anti-HIV_CDR
ugcucguacgcgggcucguacacguacgug

SEQ ID NO: 59479 - RNA, 30 nt, Artificial Sequence
  derived and/or modified sequence opt11 from anti-HIV_CDR
caacaacgcuacuccuggcccucccucacc

SEQ ID NO: 59480 - RNA, 30 nt, Artificial Sequence
  derived and/or modified sequence opt11 from anti-HIV_CDR
cuccaaugcggcuccuccccccccuacacc

SEQ ID NO: 59481 - RNA, 30 nt, Artificial Sequence
  derived and/or modified sequence opt11 from anti-HIV_CDR
uccucauacgccggcacaaaccacuggguc

SEQ ID NO: 59482 - RNA, 30 nt, Artificial Sequence
  derived and/or modified sequence opt11 from anti-HIV_CDR
uccucauacgccgccacaaaccacuggguc

SEQ ID NO: 59483 - RNA, 30 nt, Artificial Sequence
  derived and/or modified sequence opt11 from anti-HIV_CDR
caauacuacggcaccuccccccccuccacc

SEQ ID NO: 59484 - RNA, 30 nt, Artificial Sequence
  derived and/or modified sequence opt11 from anti-HIV_CDR
caauacuacggcuccuccccccccuccacc

SEQ ID NO: 59485 - RNA, 30 nt, Artificial Sequence
  derived and/or modified sequence opt11 from anti-HIV_CDR
caagaauucggccgcgcacccccauaccca

SEQ ID NO: 59486 - RNA, 30 nt, Artificial Sequence
  derived and/or modified sequence opt11 from anti-HIV_CDR
caagaauacggccgcucaccacccuacccc

SEQ ID NO: 59487 - RNA, 30 nt, Artificial Sequence
  derived and/or modified sequence opt11 from anti-HIV_CDR
caagaauacggccgcgcacccccauaccca

SEQ ID NO: 59488 - RNA, 30 nt, Artificial Sequence
  derived and/or modified sequence opt11 from anti-HIV_CDR
cauauagcggucgggggaucggaggaacac

SEQ ID NO: 59489 - RNA, 30 nt, Artificial Sequence
  derived and/or modified sequence opt11 from anti-HIV_CDR
cacauagcagucggcggaucagaagaccac

SEQ ID NO: 59490 - RNA, 30 nt, Artificial Sequence
  derived and/or modified sequence opt11 from anti-HIV_CDR
cacauagcagugggcgggagagaggaagag

SEQ ID NO: 59491 - RNA, 33 nt, Artificial Sequence
  derived and/or modified sequence opt11 from anti-HIV_CDR
ggggagaagaguagggggaguagggcggugcag

SEQ ID NO: 59492 - RNA, 33 nt, Artificial Sequence
  derived and/or modified sequence opt11 from anti-HIV_CDR
ggcgagaaaucguucgcgagcagggccgugcaa

SEQ ID NO: 59493 - RNA, 33 nt, Artificial Sequence
  derived and/or modified sequence opt11 from anti-HIV_CDR
ggacgacaggccuugggcucgagagcaguccag

SEQ ID NO: 59494 - RNA, 33 nt, Artificial Sequence
  derived and/or modified sequence opt11 from anti-HIV_CDR
ggcgaggaaucgcucgggagcaggagcgugaua

SEQ ID NO: 59495 - RNA, 33 nt, Artificial Sequence
  derived and/or modified sequence opt11 from anti-HIV_CDR
ggggagaagaguuuggggaguagggcggugcag

SEQ ID NO: 59496 - RNA, 33 nt, Artificial Sequence
  derived and/or modified sequence opt11 from anti-HIV_CDR
gggaaagagagcauaggcucgcgcgcgguccag

SEQ ID NO: 59497 - RNA, 33 nt, Artificial Sequence
  derived and/or modified sequence opt11 from anti-HIV_CDR
ggcgggaacaauaucgggagcaagagcgugcac

SEQ ID NO: 59498 - RNA, 33 nt, Artificial Sequence
  derived and/or modified sequence opt11 from anti-HIV_CDR
ggagagaagaguauagggagcagggcggugcag

SEQ ID NO: 59499 - RNA, 33 nt, Artificial Sequence
  derived and/or modified sequence opt11 from anti-HIV_CDR
aaagcgagccaggacgugagcacggccguggcc

SEQ ID NO: 59500 - RNA, 33 nt, Artificial Sequence
  derived and/or modified sequence opt11 from anti-HIV_CDR
ggcucccgcaaccucucccaccgccuccucuca

SEQ ID NO: 59501 - RNA, 33 nt, Artificial Sequence
  derived and/or modified sequence opt11 from anti-HIV_CDR
ggcacauacgacagccagggcucgaccagacuc

SEQ ID NO: 59502 - RNA, 33 nt, Artificial Sequence
  derived and/or modified sequence opt11 from anti-HIV_CDR
caacaacgaaccaucuggccccccggcugcucc

SEQ ID NO: 59503 - RNA, 33 nt, Artificial Sequence
  derived and/or modified sequence opt11 from anti-HIV_CDR
ggcacgugggauagcucgcucucggccgugcua

SEQ ID NO: 59504 - RNA, 33 nt, Artificial Sequence
  derived and/or modified sequence opt11 from anti-HIV_CDR
gcgagcugggacaauagcuugagcgggcccgug

SEQ ID NO: 59505 - RNA, 33 nt, Artificial Sequence
  derived and/or modified sequence opt11 from anti-HIV_CDR
gcgagcugggacgauagcuugagcgggugggug

SEQ ID NO: 59506 - RNA, 33 nt, Artificial Sequence; identical to SEQ ID NO: 21296
  derived and/or modified sequence opt11 from anti-HIV_CDR

SEQ ID NO: 59507 - RNA, 33 nt, Artificial Sequence
  derived and/or modified sequence opt11 from anti-HIV_CDR
caacaccgcaccaacuggccccccuccaucacc

SEQ ID NO: 59508 - RNA, 33 nt, Artificial Sequence
  derived and/or modified sequence opt11 from anti-HIV_CDR
caaucguacgaccgcucgcucaggggcucgguc

SEQ ID NO: 59509 - RNA, 33 nt, Artificial Sequence
  derived and/or modified sequence opt11 from anti-HIV_CDR
agcucgggcaauuacgauuucgcguucgauauc

SEQ ID NO: 59510 - RNA, 33 nt, Artificial Sequence
  derived and/or modified sequence opt11 from anti-HIV_CDR
agcucgggcaauuacgauuucgcguacgauauc

SEQ ID NO: 59511 - RNA, 33 nt, Artificial Sequence
  derived and/or modified sequence opt11 from anti-HIV_CDR
agcucgggcaauuucgaguucgcguucgagauc

SEQ ID NO: 59512 - RNA, 33 nt, Artificial Sequence
  derived and/or modified sequence opt11 from anti-HIV_CDR
gccaccuacgacucacacggcucaauccgccuc

SEQ ID NO: 59513 - RNA, 33 nt, Artificial Sequence
  derived and/or modified sequence opt11 from anti-HIV_CDR
ggcacguacgacaccucgcucucgcucaggcuc

SEQ ID NO: 59514 - RNA, 33 nt, Artificial Sequence
  derived and/or modified sequence opt11 from anti-HIV_CDR
gccgccuucgacuccgcccucucucucccucuc

SEQ ID NO: 59515 - RNA, 33 nt, Artificial Sequence
  derived and/or modified sequence opt11 from anti-HIV_CDR
gccacauacgacagcgacggcucaaucagacua

SEQ ID NO: 59516 - RNA, 33 nt, Artificial Sequence
  derived and/or modified sequence opt11 from anti-HIV_CDR
gccaccuacgacuccggcuggucaauccgccua

SEQ ID NO: 59517 - RNA, 33 nt, Artificial Sequence
  derived and/or modified sequence opt11 from anti-HIV_CDR
gccaccuacgacaccggccuaucccuccgccua

SEQ ID NO: 59518 - RNA, 33 nt, Artificial Sequence; identical to SEQ ID NO: 21308
  derived and/or modified sequence opt11 from anti-HIV_CDR

SEQ ID NO: 59519 - RNA, 33 nt, Artificial Sequence
  derived and/or modified sequence opt11 from anti-HIV_CDR
gccgcguacgauagcgcggucucgcucccgguc

SEQ ID NO: 59520 - RNA, 33 nt, Artificial Sequence; identical to SEQ ID NO: 21310
  derived and/or modified sequence opt11 from anti-HIV_CDR

SEQ ID NO: 59521 - RNA, 33 nt, Artificial Sequence; identical to SEQ ID NO: 21311
  derived and/or modified sequence opt11 from anti-HIV_CDR

SEQ ID NO: 59522 - RNA, 33 nt, Artificial Sequence; identical to SEQ ID NO: 21312
  derived and/or modified sequence opt11 from anti-HIV_CDR

SEQ ID NO: 59523 - RNA, 33 nt, Artificial Sequence
  derived and/or modified sequence opt11 from anti-HIV_CDR
gccaccuacgacucacaaggcucaacccgccuc

SEQ ID NO: 59524 - RNA, 33 nt, Artificial Sequence
  derived and/or modified sequence opt11 from anti-HIV_CDR
gccaccuacgacucccaacgcucaauccgccuc

SEQ ID NO: 59525 - RNA, 33 nt, Artificial Sequence; identical to SEQ ID NO: 21315
  derived and/or modified sequence opt11 from anti-HIV_CDR

SEQ ID NO: 59526 - RNA, 33 nt, Artificial Sequence
  derived and/or modified sequence opt11 from anti-HIV_CDR
cagcacaggagcauauggccgcucaugugcaca

SEQ ID NO: 59527 - RNA, 33 nt, Artificial Sequence
  derived and/or modified sequence opt11 from anti-HIV_CDR
cuccagcccguguacauauucaggggcacgugg

SEQ ID NO: 59528 - RNA, 33 nt, Artificial Sequence
  derived and/or modified sequence opt11 from anti-HIV_CDR
ugcgagguagaugcagaugagacggugacgugc

SEQ ID NO: 59529 - RNA, 33 nt, Artificial Sequence
  derived and/or modified sequence opt11 from anti-HIV_CDR
ugugagguggaugcggaggugacgaugacggug

SEQ ID NO: 59530 - RNA, 33 nt, Artificial Sequence
  derived and/or modified sequence opt11 from anti-HIV_CDR
agcucguacgcggacacgaacgauuucgggguc

SEQ ID NO: 59531 - RNA, 33 nt, Artificial Sequence; identical to SEQ ID NO: 21321
  derived and/or modified sequence opt11 from anti-HIV_CDR

SEQ ID NO: 59532 - RNA, 33 nt, Artificial Sequence
  derived and/or modified sequence opt11 from anti-HIV_CDR
gggacgugggacgggaguuugacgacgggggug

SEQ ID NO: 59533 - RNA, 33 nt, Artificial Sequence
  derived and/or modified sequence opt11 from anti-HIV_CDR
caauccuacgacaacucccucuccggcuggguc

SEQ ID NO: 59534 - RNA, 33 nt, Artificial Sequence
  derived and/or modified sequence opt11 from anti-HIV_CDR
caacaauacuacuccaucccccccuggaccuuc

SEQ ID NO: 59535 - RNA, 33 nt, Artificial Sequence
  derived and/or modified sequence opt11 from anti-HIV_CDR
augcaaggcaccuacuggccccccucaaucacc

SEQ ID NO: 59536 - RNA, 33 nt, Artificial Sequence
  derived and/or modified sequence opt11 from anti-HIV_CDR
caaucguacgauagcucgcucggggucgagguc

SEQ ID NO: 59537 - RNA, 33 nt, Artificial Sequence
  derived and/or modified sequence opt11 from anti-HIV_CDR
caagugugggauagcgggcgagauagcuggguc

SEQ ID NO: 59538 - RNA, 33 nt, Artificial Sequence
  derived and/or modified sequence opt11 from anti-HIV_CDR
cagagcuaugacucgagcuugagcgggugggug

SEQ ID NO: 59539 - RNA, 33 nt, Artificial Sequence
  derived and/or modified sequence opt11 from anti-HIV_CDR
gggaguugggacgggaguuugaaugcgggggug

SEQ ID NO: 59540 - RNA, 33 nt, Artificial Sequence
  derived and/or modified sequence opt11 from anti-HIV_CDR
cucuccgccgacuccuccuccaccuaccaaguc

SEQ ID NO: 59541 - RNA, 33 nt, Artificial Sequence
  derived and/or modified sequence opt11 from anti-HIV_CDR
uguucguacgcgggcagggacacgagcuggguc

SEQ ID NO: 59542 - RNA, 33 nt, Artificial Sequence
  derived and/or modified sequence opt11 from anti-HIV_CDR
caacaacgcuccaacuggccccccggccucacc

SEQ ID NO: 59543 - RNA, 33 nt, Artificial Sequence
  derived and/or modified sequence opt11 from anti-HIV_CDR
aaagggcgcggguacggguacugguucgauagc

SEQ ID NO: 59544 - RNA, 33 nt, Artificial Sequence
  derived and/or modified sequence opt11 from anti-HIV_CDR
gagauggcggcgacgagugacgcguuugacaua

SEQ ID NO: 59545 - RNA, 33 nt, Artificial Sequence
  derived and/or modified sequence opt11 from anti-HIV_CDR
uccauauacucaaccggccccgcccccgucuac

SEQ ID NO: 59546 - RNA, 33 nt, Artificial Sequence
  derived and/or modified sequence opt11 from anti-HIV_CDR
cgcgggagccugcucauaaaauauuucgauuac

SEQ ID NO: 59547 - RNA, 33 nt, Artificial Sequence
  derived and/or modified sequence opt11 from anti-HIV_CDR
caacaauacgacaaccuacccccacgcgucacc

SEQ ID NO: 59548 - RNA, 33 nt, Artificial Sequence
  derived and/or modified sequence opt11 from anti-HIV_CDR
gaugugagguugguggcggugccgggggcggau

SEQ ID NO: 59549 - RNA, 33 nt, Artificial Sequence
  derived and/or modified sequence opt11 from anti-HIV_CDR
caacaacgaaccaccuggccccccgaauacacc

SEQ ID NO: 59550 - RNA, 33 nt, Artificial Sequence
  derived and/or modified sequence opt11 from anti-HIV_CDR
gcggccugggacgauagcuugaacgggugggug

SEQ ID NO: 59551 - RNA, 33 nt, Artificial Sequence
  derived and/or modified sequence opt11 from anti-HIV_CDR
cgcagacgcucagccuggagcccguucgacagc

SEQ ID NO: 59552 - RNA, 33 nt, Artificial Sequence
  derived and/or modified sequence opt11 from anti-HIV_CDR
gccacaugggacagcucacucaggaccgcacua

SEQ ID NO: 59553 - RNA, 33 nt, Artificial Sequence
  derived and/or modified sequence opt11 from anti-HIV_CDR
gggacgugggacaguaguuugagggcggcguug

SEQ ID NO: 59554 - RNA, 33 nt, Artificial Sequence
  derived and/or modified sequence opt11 from anti-HIV_CDR
caacaacgcuccaucuggccccccucccucacc

SEQ ID NO: 59555 - RNA, 33 nt, Artificial Sequence
  derived and/or modified sequence opt11 from anti-HIV_CDR
gaguuucagacgagugggguggugagggagggg

SEQ ID NO: 59556 - RNA, 33 nt, Artificial Sequence
  derived and/or modified sequence opt11 from anti-HIV_CDR
cacauaggcgcgggcgggccauauagcgaguac

SEQ ID NO: 59557 - RNA, 33 nt, Artificial Sequence
  derived and/or modified sequence opt11 from anti-HIV_CDR
cgcgggcacucguucacgagcccguucgauagc

SEQ ID NO: 59558 - RNA, 33 nt, Artificial Sequence
  derived and/or modified sequence opt11 from anti-HIV_CDR
caacaccucaacucauacccccgcauguacacc

SEQ ID NO: 59559 - RNA, 33 nt, Artificial Sequence
  derived and/or modified sequence opt11 from anti-HIV_CDR
caacaacgcuccaacuggccccccaaaaucacc

SEQ ID NO: 59560 - RNA, 33 nt, Artificial Sequence
  derived and/or modified sequence opt11 from anti-HIV_CDR
gcggcgugggaugauaguuugggggggguggug

SEQ ID NO: 59561 - RNA, 33 nt, Artificial Sequence
  derived and/or modified sequence opt11 from anti-HIV_CDR
gggacaugggacucgagcuugagcgcggucgug

SEQ ID NO: 59562 - RNA, 33 nt, Artificial Sequence
  derived and/or modified sequence opt11 from anti-HIV_CDR
caacaaagagcaaacuggccaccaggcggaacc

SEQ ID NO: 59563 - RNA, 33 nt, Artificial Sequence
  derived and/or modified sequence opt11 from anti-HIV_CDR
ggggggggguauccgagggggaauauggaugug

SEQ ID NO: 59564 - RNA, 33 nt, Artificial Sequence; identical to SEQ ID NO: 21354
  derived and/or modified sequence opt11 from anti-HIV_CDR

SEQ ID NO: 59565 - RNA, 33 nt, Artificial Sequence
  derived and/or modified sequence opt11 from anti-HIV_CDR
caacaacgcggcaucuggccccuacaaaucacc

SEQ ID NO: 59566 - RNA, 33 nt, Artificial Sequence
  derived and/or modified sequence opt11 from anti-HIV_CDR
cgcucgcccgggggcggguacgcguucgauauc

SEQ ID NO: 59567 - RNA, 33 nt, Artificial Sequence
  derived and/or modified sequence opt11 from anti-HIV_CDR
agcgggcccgggcucuugcgcggguucgauuac

SEQ ID NO: 59568 - RNA, 33 nt, Artificial Sequence
  derived and/or modified sequence opt11 from anti-HIV_CDR
caacaacgaaccacccgcccccccgaauacacc

SEQ ID NO: 59569 - RNA, 33 nt, Artificial Sequence
  derived and/or modified sequence opt11 from anti-HIV_CDR
caacaacgaaccacccgcccccccgacuacacc

SEQ ID NO: 59570 - RNA, 33 nt, Artificial Sequence
  derived and/or modified sequence opt11 from anti-HIV_CDR
caaggccgaaccacccgcccacccgacuacaca

SEQ ID NO: 59571 - RNA, 33 nt, Artificial Sequence
  derived and/or modified sequence opt11 from anti-HIV_CDR
caacaacgcuccaccaccccccccgaauacacc

SEQ ID NO: 59572 - RNA, 33 nt, Artificial Sequence
  derived and/or modified sequence opt11 from anti-HIV_CDR
caacaacgcaccuccuggccccucgcccucucc

SEQ ID NO: 59573 - RNA, 33 nt, Artificial Sequence; identical to SEQ ID NO: 21363
  derived and/or modified sequence opt11 from anti-HIV_CDR

SEQ ID NO: 59574 - RNA, 36 nt, Artificial Sequence
  derived and/or modified sequence opt11 from anti-HIV_CDR
cacuauugggauagcaggagcccgaucucgugggug

SEQ ID NO: 59575 - RNA, 36 nt, Artificial Sequence
  derived and/or modified sequence opt11 from anti-HIV_CDR
cacaagugggauagcaggagcccgcucucgugggug

SEQ ID NO: 59576 - RNA, 36 nt, Artificial Sequence
  derived and/or modified sequence opt11 from anti-HIV_CDR
cacaugugggauagcaggagcggguucucguggucg

SEQ ID NO: 59577 - RNA, 36 nt, Artificial Sequence
  derived and/or modified sequence opt11 from anti-HIV_CDR
cacaucugggacuccagaguccccaccaaauggguc

SEQ ID NO: 59578 - RNA, 36 nt, Artificial Sequence
  derived and/or modified sequence opt11 from anti-HIV_CDR
caagugugggauagcucgagcgaucacccgugggug

SEQ ID NO: 59579 - RNA, 36 nt, Artificial Sequence
  derived and/or modified sequence opt11 from anti-HIV_CDR
cacauauacgacgccagacgcccaaccaacuggguc

SEQ ID NO: 59580 - RNA, 36 nt, Artificial Sequence
  derived and/or modified sequence opt11 from anti-HIV_CDR
cucgacggcgaagccuuccgcuacuaccuagaccuc

SEQ ID NO: 59581 - RNA, 36 nt, Artificial Sequence
  derived and/or modified sequence opt11 from anti-HIV_CDR
ccccaauacaaccucggccgcgacccccuagacguc

SEQ ID NO: 59582 - RNA, 36 nt, Artificial Sequence
  derived and/or modified sequence opt11 from anti-HIV_CDR
cccgaacccuccuccaucgucgccccccucuacuac

SEQ ID NO: 59583 - RNA, 36 nt, Artificial Sequence
  derived and/or modified sequence opt11 from anti-HIV_CDR
ggcgggggagauggcaggaacuggcauuugcauccg

SEQ ID NO: 59584 - RNA, 36 nt, Artificial Sequence
  derived and/or modified sequence opt11 from anti-HIV_CDR
cccaagagcgggcgcgauuacuggagcuuugacuug

SEQ ID NO: 59585 - RNA, 36 nt, Artificial Sequence
  derived and/or modified sequence opt11 from anti-HIV_CDR
cccaggggcgggcgcgauaacuggagcuuucacgug

SEQ ID NO: 59586 - RNA, 36 nt, Artificial Sequence
  derived and/or modified sequence opt11 from anti-HIV_CDR
ccgcacucgcccgaugacgcguggucacucgacguc

SEQ ID NO: 59587 - RNA, 36 nt, Artificial Sequence
  derived and/or modified sequence opt11 from anti-HIV_CDR
ccccuccgcggcggcgacaccuggcacuaccacuca

SEQ ID NO: 59588 - RNA, 36 nt, Artificial Sequence
  derived and/or modified sequence opt11 from anti-HIV_CDR
cuccaacccgucuacauccuccgcuccaucugccac

SEQ ID NO: 59589 - RNA, 36 nt, Artificial Sequence
  derived and/or modified sequence opt11 from anti-HIV_CDR
cuccaacccgucuacauccucaaaugcaacuggugc

SEQ ID NO: 59590 - RNA, 36 nt, Artificial Sequence
  derived and/or modified sequence opt11 from anti-HIV_CDR
gaauacagauucgacgacuggggcccgcucgaccac

SEQ ID NO: 59591 - RNA, 36 nt, Artificial Sequence
  derived and/or modified sequence opt11 from anti-HIV_CDR
gcggcaugggacgauagcuugaacgggcacggggua

SEQ ID NO: 59592 - RNA, 36 nt, Artificial Sequence; identical to SEQ ID NO: 21382
  derived and/or modified sequence opt11 from anti-HIV_CDR

SEQ ID NO: 59593 - RNA, 36 nt, Artificial Sequence
  derived and/or modified sequence opt11 from anti-HIV_CDR
ggccuauacgacuccuccggcuacuacuucggcuac

SEQ ID NO: 59594 - RNA, 36 nt, Artificial Sequence
  derived and/or modified sequence opt11 from anti-HIV_CDR
cucgggugcucgggcgggagcuguuacgaggacucg

SEQ ID NO: 59595 - RNA, 36 nt, Artificial Sequence
  derived and/or modified sequence opt11 from anti-HIV_CDR
gcgagcgggagcuauauauugggcacgauggaugua

SEQ ID NO: 59596 - RNA, 36 nt, Artificial Sequence
  derived and/or modified sequence opt11 from anti-HIV_CDR
uacucaaccgacaacuccggcaaacaacacuggguc

SEQ ID NO: 59597 - RNA, 36 nt, Artificial Sequence
  derived and/or modified sequence opt11 from anti-HIV_CDR
gucaagcaauuccucgaguggcuguaccuggacuau

SEQ ID NO: 59598 - RNA, 36 nt, Artificial Sequence
  derived and/or modified sequence opt11 from anti-HIV_CDR
ggcgugcgcucgaucgugggcgcgcacuuugacuau

SEQ ID NO: 59599 - RNA, 36 nt, Artificial Sequence
  derived and/or modified sequence opt11 from anti-HIV_CDR
ggcgugggcacgcgcuauuacguguacuuugacucg

SEQ ID NO: 59600 - RNA, 36 nt, Artificial Sequence; identical to SEQ ID NO: 21390
  derived and/or modified sequence opt11 from anti-HIV_CDR

SEQ ID NO: 59601 - RNA, 36 nt, Artificial Sequence
  derived and/or modified sequence opt11 from anti-HIV_CDR
cgcggcaucgccgccgccggcuuuuacuuccaacac

SEQ ID NO: 59602 - RNA, 36 nt, Artificial Sequence
  derived and/or modified sequence opt11 from anti-HIV_CDR
cgcgggaucgcggccgcggccuuuuacuuucaaacg

SEQ ID NO: 59603 - RNA, 36 nt, Artificial Sequence
  derived and/or modified sequence opt11 from anti-HIV_CDR
cgcggcaucgccgccgccggcuuuuacuuccaaaac

SEQ ID NO: 59604 - RNA, 36 nt, Artificial Sequence
  derived and/or modified sequence opt11 from anti-HIV_CDR
caaucguacgauaccucgcucacggacacgggcgug

SEQ ID NO: 59605 - RNA, 36 nt, Artificial Sequence
  derived and/or modified sequence opt11 from anti-HIV_CDR
caauccuacgacaccucccucuccgacaccggcguc

SEQ ID NO: 59606 - RNA, 36 nt, Artificial Sequence; identical to SEQ ID NO: 21396
  derived and/or modified sequence opt11 from anti-HIV_CDR

SEQ ID NO: 59607 - RNA, 36 nt, Artificial Sequence; identical to SEQ ID NO: 21397
  derived and/or modified sequence opt11 from anti-HIV_CDR

SEQ ID NO: 59608 - RNA, 36 nt, Artificial Sequence; identical to SEQ ID NO: 21398
  derived and/or modified sequence opt11 from anti-HIV_CDR

SEQ ID NO: 59609 - RNA, 36 nt, Artificial Sequence
  derived and/or modified sequence opt11 from anti-HIV_CDR
gcggcgugggaugauaguuuggauggguuuugggug

SEQ ID NO: 59610 - RNA, 36 nt, Artificial Sequence
  derived and/or modified sequence opt11 from anti-HIV_CDR
uugcggaggggauauuacgauagcggggaagauuac

SEQ ID NO: 59611 - RNA, 36 nt, Artificial Sequence
  derived and/or modified sequence opt11 from anti-HIV_CDR
cuaaggagaggguacuuugacucgggaggggaccau

SEQ ID NO: 59612 - RNA, 36 nt, Artificial Sequence; identical to SEQ ID NO: 21402
  derived and/or modified sequence opt11 from anti-HIV_CDR

SEQ ID NO: 59613 - RNA, 36 nt, Artificial Sequence
  derived and/or modified sequence opt11 from anti-HIV_CDR
cucgacggcgaagccuuccgcuacuacuucgacucc

SEQ ID NO: 59614 - RNA, 36 nt, Artificial Sequence
  derived and/or modified sequence opt11 from anti-HIV_CDR
cgccgaggccaacgacuacucgccuacuucgacuac

SEQ ID NO: 59615 - RNA, 36 nt, Artificial Sequence
  derived and/or modified sequence opt11 from anti-HIV_CDR
ccccaauacaaccucggccgcgaaccccuaaacguc

SEQ ID NO: 59616 - RNA, 36 nt, Artificial Sequence
  derived and/or modified sequence opt11 from anti-HIV_CDR
gcccaucacgacuucuggcgcgcgccaguagacgua

SEQ ID NO: 59617 - RNA, 36 nt, Artificial Sequence
  derived and/or modified sequence opt11 from anti-HIV_CDR
ggccggcgcgaaggccugaacuuucuacuggacuau

SEQ ID NO: 59618 - RNA, 36 nt, Artificial Sequence
  derived and/or modified sequence opt11 from anti-HIV_CDR
cccgaacccuccuccaucgucggcgcccucuacuac

SEQ ID NO: 59619 - RNA, 36 nt, Artificial Sequence
  derived and/or modified sequence opt11 from anti-HIV_CDR
ggccccgacgacuucugguccggcuacccaaaauac

SEQ ID NO: 59620 - RNA, 36 nt, Artificial Sequence
  derived and/or modified sequence opt11 from anti-HIV_CDR
gacuacucagccgccggccgacaccuauucgacuca

SEQ ID NO: 59621 - RNA, 36 nt, Artificial Sequence
  derived and/or modified sequence opt11 from anti-HIV_CDR
gacuacaccgcccgcggccgacacuucuucgacuau

SEQ ID NO: 59622 - RNA, 36 nt, Artificial Sequence
  derived and/or modified sequence opt11 from anti-HIV_CDR
gacuacaccgccuccggccgacacuucuucgacuac

SEQ ID NO: 59623 - RNA, 36 nt, Artificial Sequence
  derived and/or modified sequence opt11 from anti-HIV_CDR
cagagcuaugacucgagcuugagcgggagcuggguc

SEQ ID NO: 59624 - RNA, 36 nt, Artificial Sequence
  derived and/or modified sequence opt11 from anti-HIV_CDR
cccgcgcaagcgggcgugggcccgcgauuugacuau

SEQ ID NO: 59625 - RNA, 36 nt, Artificial Sequence; identical to SEQ ID NO: 21415
  derived and/or modified sequence opt11 from anti-HIV_CDR

SEQ ID NO: 59626 - RNA, 36 nt, Artificial Sequence; identical to SEQ ID NO: 21416
  derived and/or modified sequence opt11 from anti-HIV_CDR

SEQ ID NO: 59627 - RNA, 36 nt, Artificial Sequence; identical to SEQ ID NO: 21417
  derived and/or modified sequence opt11 from anti-HIV_CDR

SEQ ID NO: 59628 - RNA, 36 nt, Artificial Sequence
  derived and/or modified sequence opt11 from anti-HIV_CDR
ugggucgugaccgcggccgaggaauauuucgauuac

SEQ ID NO: 59629 - RNA, 39 nt, Artificial Sequence
  derived and/or modified sequence opt11 from anti-HIV_CDR
gacccgcaaguggaagugcgcgggaacgcguucgauauc

SEQ ID NO: 59630 - RNA, 39 nt, Artificial Sequence
  derived and/or modified sequence opt11 from anti-HIV_CDR
gaccacggcgacccccgaaccggcuacuacuucgacuac

SEQ ID NO: 59631 - RNA, 39 nt, Artificial Sequence
  derived and/or modified sequence opt11 from anti-HIV_CDR
gacgaaagcggauacgaccucaacuggcaucucgacagc

SEQ ID NO: 59632 - RNA, 39 nt, Artificial Sequence
  derived and/or modified sequence opt11 from anti-HIV_CDR
gacggaagcggagacgacagaaacuggcaucuagaccca

SEQ ID NO: 59633 - RNA, 39 nt, Artificial Sequence
  derived and/or modified sequence opt11 from anti-HIV_CDR
gacagacgagacgacggacuagacuggcuacuagaccca

SEQ ID NO: 59634 - RNA, 39 nt, Artificial Sequence
  derived and/or modified sequence opt11 from anti-HIV_CDR
gauggggggggggaugauaggacgugguuguuggaugcg

SEQ ID NO: 59635 - RNA, 39 nt, Artificial Sequence
  derived and/or modified sequence opt11 from anti-HIV_CDR
gacggaagcggagacgcaagagacuggcaccuacaccca

SEQ ID NO: 59636 - RNA, 39 nt, Artificial Sequence
  derived and/or modified sequence opt11 from anti-HIV_CDR
gacggaucaggcgacgacacaagcugguaccuggacccg

SEQ ID NO: 59637 - RNA, 39 nt, Artificial Sequence
  derived and/or modified sequence opt11 from anti-HIV_CDR
gauggaucgggcgaugacacgagcuggcacuuggacccg

SEQ ID NO: 59638 - RNA, 39 nt, Artificial Sequence
  derived and/or modified sequence opt11 from anti-HIV_CDR
gacaggcgcgaugacgaucgcgcgugguugcucgaucca

SEQ ID NO: 59639 - RNA, 39 nt, Artificial Sequence
  derived and/or modified sequence opt11 from anti-HIV_CDR
gacgggagcggggacgcgagagauuggcaucuagaucca

SEQ ID NO: 59640 - RNA, 39 nt, Artificial Sequence
  derived and/or modified sequence opt11 from anti-HIV_CDR
gauggcucgggcgaugccacgagcuggcacuugcacccg

SEQ ID NO: 59641 - RNA, 39 nt, Artificial Sequence
  derived and/or modified sequence opt11 from anti-HIV_CDR
gacgaauccggcgacgaccucaaauggcaccuccaccca

SEQ ID NO: 59642 - RNA, 39 nt, Artificial Sequence
  derived and/or modified sequence opt11 from anti-HIV_CDR
gauggcucgggcgaugacacgagcuggcacuugcacccg

SEQ ID NO: 59643 - RNA, 39 nt, Artificial Sequence
  derived and/or modified sequence opt11 from anti-HIV_CDR
gcccaaggcgacauccuaaccgaaggcuacuucgacuac

SEQ ID NO: 59644 - RNA, 39 nt, Artificial Sequence
  derived and/or modified sequence opt11 from anti-HIV_CDR
gaccgcauguucuggcaacagcucgcgaaauaugacucg

SEQ ID NO: 59645 - RNA, 39 nt, Artificial Sequence
  derived and/or modified sequence opt11 from anti-HIV_CDR
ucaaccugggacuacucccucuccgcccacgaagacguc

SEQ ID NO: 59646 - RNA, 39 nt, Artificial Sequence
  derived and/or modified sequence opt11 from anti-HIV_CDR
gcggccugggacgauagcuugagcgggcuaaauugggug

SEQ ID NO: 59647 - RNA, 39 nt, Artificial Sequence
  derived and/or modified sequence opt11 from anti-HIV_CDR
cucucgagcgaucgcauagucguggucgggcccgauuac

SEQ ID NO: 59648 - RNA, 39 nt, Artificial Sequence
  derived and/or modified sequence opt11 from anti-HIV_CDR
gaagccggcucaguaaccgccaccggacccuucgacuca

SEQ ID NO: 59649 - RNA, 39 nt, Artificial Sequence
  derived and/or modified sequence opt11 from anti-HIV_CDR
gauuucgggcgcgcguacgcgaucggguacuuugaauau

SEQ ID NO: 59650 - RNA, 39 nt, Artificial Sequence
  derived and/or modified sequence opt11 from anti-HIV_CDR
gaucgcgcgcccuauggcgcguucgagcccuuugacuuu

SEQ ID NO: 59651 - RNA, 39 nt, Artificial Sequence
  derived and/or modified sequence opt11 from anti-HIV_CDR
aacgggcacucgagcuugggcgggggcuauuucccgcac

SEQ ID NO: 59652 - RNA, 39 nt, Artificial Sequence
  derived and/or modified sequence opt11 from anti-HIV_CDR
aacggccacuccgcacucggcggcgaauacuuccaacac

SEQ ID NO: 59653 - RNA, 39 nt, Artificial Sequence
  derived and/or modified sequence opt11 from anti-HIV_CDR
gcggccaggcgcgcguucuauuacuauuacauggacgug

SEQ ID NO: 59654 - RNA, 39 nt, Artificial Sequence
  derived and/or modified sequence opt11 from anti-HIV_CDR
gccaacuacuacgacagcuccggcuacggccuagacaua

SEQ ID NO: 59655 - RNA, 39 nt, Artificial Sequence
  derived and/or modified sequence opt11 from anti-HIV_CDR
cacucacgccccggcgccccaccccacuacuucgacuac

SEQ ID NO: 59656 - RNA, 39 nt, Artificial Sequence
  derived and/or modified sequence opt11 from anti-HIV_CDR
ggccuaaccgucgccacccucuacgacgccuucgacguc

SEQ ID NO: 59657 - RNA, 39 nt, Artificial Sequence
  derived and/or modified sequence opt11 from anti-HIV_CDR
cgcgaccgcuacaacuggaaauacuacuaccucgacguc

SEQ ID NO: 59658 - RNA, 39 nt, Artificial Sequence
  derived and/or modified sequence opt11 from anti-HIV_CDR
gauagagggagcucgggcugguacgggugguuggacccg

SEQ ID NO: 59659 - RNA, 39 nt, Artificial Sequence
  derived and/or modified sequence opt11 from anti-HIV_CDR
gaucgauugagcucguucuggagcgggggcauagaccag

SEQ ID NO: 59660 - RNA, 39 nt, Artificial Sequence
  derived and/or modified sequence opt11 from anti-HIV_CDR
gacgugaucgugggcgcgcucuugggcgcguucgauauc

SEQ ID NO: 59661 - RNA, 39 nt, Artificial Sequence; identical to SEQ ID NO: 21451
  derived and/or modified sequence opt11 from anti-HIV_CDR

SEQ ID NO: 59662 - RNA, 39 nt, Artificial Sequence
  derived and/or modified sequence opt11 from anti-HIV_CDR
gacucgcgcccgcaagcgcucguggccgcgcucgauguc

SEQ ID NO: 59663 - RNA, 39 nt, Artificial Sequence
  derived and/or modified sequence opt11 from anti-HIV_CDR
gacgagaucgugggcgcgcucuugggcgcguucgauauc

SEQ ID NO: 59664 - RNA, 39 nt, Artificial Sequence
  derived and/or modified sequence opt11 from anti-HIV_CDR
agcgaucccgcgaucgcggccgcgggcucgcucgaucuc

SEQ ID NO: 59665 - RNA, 39 nt, Artificial Sequence
  derived and/or modified sequence opt11 from anti-HIV_CDR
cccuacguccaaaccgucgccaccaccaccuucgacuuc

SEQ ID NO: 59666 - RNA, 39 nt, Artificial Sequence
  derived and/or modified sequence opt11 from anti-HIV_CDR
ggccccaaauccgucgccucccucuccuacuucgacaaa

SEQ ID NO: 59667 - RNA, 39 nt, Artificial Sequence
  derived and/or modified sequence opt11 from anti-HIV_CDR
ggcgcgcucugguucgggcaauugcgcgggcucgaucca

SEQ ID NO: 59668 - RNA, 39 nt, Artificial Sequence
  derived and/or modified sequence opt11 from anti-HIV_CDR
gaucucaggccaaugcgcgggaacugggccaugcacgug

SEQ ID NO: 59669 - RNA, 39 nt, Artificial Sequence
  derived and/or modified sequence opt11 from anti-HIV_CDR
gacccgcaagugaacaggcgcgggaacuguuucgaccac

SEQ ID NO: 59670 - RNA, 39 nt, Artificial Sequence
  derived and/or modified sequence opt11 from anti-HIV_CDR
gacccacaaauagaaauccgcggcaacgccuucgacauc

SEQ ID NO: 59671 - RNA, 39 nt, Artificial Sequence
  derived and/or modified sequence opt11 from anti-HIV_CDR
gucccgcgcacgaccgcgaccagaaacgcauucgacauc

SEQ ID NO: 59672 - RNA, 39 nt, Artificial Sequence; identical to SEQ ID NO: 52030
  derived and/or modified sequence opt11 from anti-HIV_CDR

SEQ ID NO: 59673 - RNA, 39 nt, Artificial Sequence
  derived and/or modified sequence opt11 from anti-HIV_CDR
gacuccgaagacuacgucgacuacuacuacauggacgua

SEQ ID NO: 59674 - RNA, 39 nt, Artificial Sequence
  derived and/or modified sequence opt11 from anti-HIV_CDR
cucccgcgcacgaccggaaucagaaacgcauucgacauc

SEQ ID NO: 59675 - RNA, 39 nt, Artificial Sequence
  derived and/or modified sequence opt11 from anti-HIV_CDR
cucccccgcacaaccggcaucagaaacgccuucgacuuc

SEQ ID NO: 59676 - RNA, 42 nt, Artificial Sequence
  derived and/or modified sequence opt11 from anti-HIV_CDR
gggacauugugguuuggcgagagcgggcucaggcucgaucac

SEQ ID NO: 59677 - RNA, 42 nt, Artificial Sequence
  derived and/or modified sequence opt11 from anti-HIV_CDR
gucgccuacguccacgucgucaccacccgcucacucgacaac

SEQ ID NO: 59678 - RNA, 42 nt, Artificial Sequence; identical to SEQ ID NO: 21468
  derived and/or modified sequence opt11 from anti-HIV_CDR

SEQ ID NO: 59679 - RNA, 42 nt, Artificial Sequence; identical to SEQ ID NO: 21469
  derived and/or modified sequence opt11 from anti-HIV_CDR

SEQ ID NO: 59680 - RNA, 42 nt, Artificial Sequence
  derived and/or modified sequence opt11 from anti-HIV_CDR
ggcgggcucuauugcucgagcauaagcuguaucauggacgug

SEQ ID NO: 59681 - RNA, 42 nt, Artificial Sequence
  derived and/or modified sequence opt11 from anti-HIV_CDR
aacgaaccccaauaccacucccuccccggcauguucgacuac

SEQ ID NO: 59682 - RNA, 42 nt, Artificial Sequence
  derived and/or modified sequence opt11 from anti-HIV_CDR
gagcccagggaaaugggcacgcucacggccggguucgaguac

SEQ ID NO: 59683 - RNA, 42 nt, Artificial Sequence
  derived and/or modified sequence opt11 from anti-HIV_CDR
gcgaccggguacucguacggguacuuggacgcguucgauauc

SEQ ID NO: 59684 - RNA, 42 nt, Artificial Sequence
  derived and/or modified sequence opt11 from anti-HIV_CDR
ggcucgcucugguucggggaaucgggauugagauuggaccau

SEQ ID NO: 59685 - RNA, 42 nt, Artificial Sequence
  derived and/or modified sequence opt11 from anti-HIV_CDR
gauaacacgaucucgggcguggucccgcgcugguucgauuac

SEQ ID NO: 59686 - RNA, 42 nt, Artificial Sequence; identical to SEQ ID NO: 21476
  derived and/or modified sequence opt11 from anti-HIV_CDR

SEQ ID NO: 59687 - RNA, 42 nt, Artificial Sequence
  derived and/or modified sequence opt11 from anti-HIV_CDR
gaccgcuuuaacuggaacgauggcggguacuuuuucgauagc

SEQ ID NO: 59688 - RNA, 42 nt, Artificial Sequence
  derived and/or modified sequence opt11 from anti-HIV_CDR
ggccacuccuccuccuggaccaaauucaacugguucggcccc

SEQ ID NO: 59689 - RNA, 42 nt, Artificial Sequence
  derived and/or modified sequence opt11 from anti-HIV_CDR
uccauagccgccgacgacuacuacuacuacuacauggacguc

SEQ ID NO: 59690 - RNA, 42 nt, Artificial Sequence; identical to SEQ ID NO: 21480
  derived and/or modified sequence opt11 from anti-HIV_CDR

SEQ ID NO: 59691 - RNA, 42 nt, Artificial Sequence
  derived and/or modified sequence opt11 from anti-HIV_CDR
gacaaagacgccuccaucuacggcuaccgcauacucaaccac

SEQ ID NO: 59692 - RNA, 42 nt, Artificial Sequence
  derived and/or modified sequence opt11 from anti-HIV_CDR
guccugaccgaccucgaccaaggaaacccacgcauggacgua

SEQ ID NO: 59693 - RNA, 42 nt, Artificial Sequence
  derived and/or modified sequence opt11 from anti-HIV_CDR
cgcgagaucaaguucggggaauugagcuuuuacuuugacucg

SEQ ID NO: 59694 - RNA, 42 nt, Artificial Sequence
  derived and/or modified sequence opt11 from anti-HIV_CDR
cgcgaaauccgcuucggcgaacucuccuucuacuucgacuac

SEQ ID NO: 59695 - RNA, 42 nt, Artificial Sequence; identical to SEQ ID NO: 21485
  derived and/or modified sequence opt11 from anti-HIV_CDR

SEQ ID NO: 59696 - RNA, 42 nt, Artificial Sequence
  derived and/or modified sequence opt11 from anti-HIV_CDR
ggcgacuacgacauccucaccuccuccuaccaauucgacuac

SEQ ID NO: 59697 - RNA, 42 nt, Artificial Sequence
  derived and/or modified sequence opt11 from anti-HIV_CDR
ucaaccccacucgucuggccccccgccaacggccucgacguc

SEQ ID NO: 59698 - RNA, 42 nt, Artificial Sequence; identical to SEQ ID NO: 21488
  derived and/or modified sequence opt11 from anti-HIV_CDR

SEQ ID NO: 59699 - RNA, 45 nt, Artificial Sequence
  derived and/or modified sequence opt11 from anti-HIV_CDR
gaaaaaggccaauggcucaccgucccccccuacuacuucgacucc

SEQ ID NO: 59700 - RNA, 45 nt, Artificial Sequence
  derived and/or modified sequence opt11 from anti-HIV_CDR
gggagcgggcgcuggaccauaggcgcgcgcauauacuuugacaau

SEQ ID NO: 59701 - RNA, 45 nt, Artificial Sequence
  derived and/or modified sequence opt11 from anti-HIV_CDR
cucgaggccgacggcgcagacuauagcccgaaaauguucgauuuc

SEQ ID NO: 59702 - RNA, 45 nt, Artificial Sequence
  derived and/or modified sequence opt11 from anti-HIV_CDR
cucgaggccgacggcggagacuacagcccgaaaauguucgauuac

SEQ ID NO: 59703 - RNA, 45 nt, Artificial Sequence
  derived and/or modified sequence opt11 from anti-HIV_CDR
cucgaagccgacggcgacaacuacagcccaaaaauggucgacuac

SEQ ID NO: 59704 - RNA, 45 nt, Artificial Sequence
  derived and/or modified sequence opt11 from anti-HIV_CDR
cucgaagccgacggcgacgacuacagcccaaaaauguucgacuac

SEQ ID NO: 59705 - RNA, 45 nt, Artificial Sequence
  derived and/or modified sequence opt11 from anti-HIV_CDR
cucgaggccgacggcucagacuacagcccgaaaauguucgacuuc

SEQ ID NO: 59706 - RNA, 45 nt, Artificial Sequence
  derived and/or modified sequence opt11 from anti-HIV_CDR
cucgaggccgacggcgaugacuauagcccgaaaauguucgaucac

SEQ ID NO: 59707 - RNA, 45 nt, Artificial Sequence
  derived and/or modified sequence opt11 from anti-HIV_CDR
cucgaggccgacggcgaugacuauagcccgaaaauggucgauuac

SEQ ID NO: 59708 - RNA, 45 nt, Artificial Sequence
  derived and/or modified sequence opt11 from anti-HIV_CDR
gcgcccaggcucgaucucggggaauugagcucgggcuuucacuuu

SEQ ID NO: 59709 - RNA, 45 nt, Artificial Sequence
  derived and/or modified sequence opt11 from anti-HIV_CDR
gccccccgccucgaacucggcgaacucuccuccggcuuccacuac

SEQ ID NO: 59710 - RNA, 45 nt, Artificial Sequence
  derived and/or modified sequence opt11 from anti-HIV_CDR
gggcgauugcuaaugcaauggcccccgcgcgggggcuuugacccg

SEQ ID NO: 59711 - RNA, 45 nt, Artificial Sequence
  derived and/or modified sequence opt11 from anti-HIV_CDR
ggccgacuauucaugcaauggcccccacgcggcggcuucgaccca

SEQ ID NO: 59712 - RNA, 45 nt, Artificial Sequence
  derived and/or modified sequence opt11 from anti-HIV_CDR
ggccgacuauucguacaauggccaccccaaggcggcuucgacccc

SEQ ID NO: 59713 - RNA, 45 nt, Artificial Sequence
  derived and/or modified sequence opt11 from anti-HIV_CDR
ggccgacuauucaugcaauggccaccccaaggcggcuucgacccc

SEQ ID NO: 59714 - RNA, 45 nt, Artificial Sequence
  derived and/or modified sequence opt11 from anti-HIV_CDR
ggccgacuauucguacaauggcccccccaaggcggcuucgacaca

SEQ ID NO: 59715 - RNA, 45 nt, Artificial Sequence
  derived and/or modified sequence opt11 from anti-HIV_CDR
aacaacaacacccgaaaaucaaucaacaucggccccggccgcgcc

SEQ ID NO: 59716 - RNA, 45 nt, Artificial Sequence
  derived and/or modified sequence opt11 from anti-HIV_CDR
cccggauacugcaacaacaacaucugcacacacugguucgacacc

SEQ ID NO: 59717 - RNA, 45 nt, Artificial Sequence
  derived and/or modified sequence opt11 from anti-HIV_CDR
gaccuccuccccgacuaccccgucuccuccgcccccgaagacuuc

SEQ ID NO: 59718 - RNA, 45 nt, Artificial Sequence
  derived and/or modified sequence opt11 from anti-HIV_CDR
gagagcuggcucuauagcaauggcgauuacuauuacauggacgug

SEQ ID NO: 59719 - RNA, 45 nt, Artificial Sequence; identical to SEQ ID NO: 21509
  derived and/or modified sequence opt11 from anti-HIV_CDR

SEQ ID NO: 59720 - RNA, 45 nt, Artificial Sequence
  derived and/or modified sequence opt11 from anti-HIV_CDR
caaacaaccgacgaaggccgccaauggcuagucggauuccaacac

SEQ ID NO: 59721 - RNA, 45 nt, Artificial Sequence
  derived and/or modified sequence opt11 from anti-HIV_CDR
cccucguacgggggcuaugacgaucaagggugguauuucgaguac

SEQ ID NO: 59722 - RNA, 45 nt, Artificial Sequence
  derived and/or modified sequence opt11 from anti-HIV_CDR
gccgccauccccaucggcgacuccaaauacuccuacuucgacucc

SEQ ID NO: 59723 - RNA, 45 nt, Artificial Sequence
  derived and/or modified sequence opt11 from anti-HIV_CDR
gccccaccccccggcucaaccgaaugggccuacuacuucgacuac

SEQ ID NO: 59724 - RNA, 45 nt, Artificial Sequence
  derived and/or modified sequence opt11 from anti-HIV_CDR
gcccaauuccacaacuccggcuacuacuacuccggccucgacuac

SEQ ID NO: 59725 - RNA, 45 nt, Artificial Sequence
  derived and/or modified sequence opt11 from anti-HIV_CDR
ggcggcuacgacuacggcgaccacuacuacuacuacauggacgua

SEQ ID NO: 59726 - RNA, 45 nt, Artificial Sequence
  derived and/or modified sequence opt11 from anti-HIV_CDR
ggcacacaauccuacuccgccgucgcccccggcugguucgaccca

SEQ ID NO: 59727 - RNA, 45 nt, Artificial Sequence
  derived and/or modified sequence opt11 from anti-HIV_CDR
aucaagggcccgcccaggggcaauuucggggucgcguucuauuuc

SEQ ID NO: 59728 - RNA, 45 nt, Artificial Sequence
  derived and/or modified sequence opt11 from anti-HIV_CDR
aaaguguacucggacggguggucgcccccgaccggguucguguac

SEQ ID NO: 59729 - RNA, 45 nt, Artificial Sequence
  derived and/or modified sequence opt11 from anti-HIV_CDR
cgcuacaaauaccuccccggcgaccaacacaugcccugggacaac

SEQ ID NO: 59730 - RNA, 45 nt, Artificial Sequence
  derived and/or modified sequence opt11 from anti-HIV_CDR
cgcuacaaauaccuccccggcgaccaacacaugcccugggacuac

SEQ ID NO: 59731 - RNA, 45 nt, Artificial Sequence
  derived and/or modified sequence opt11 from anti-HIV_CDR
ggggggggguaugcggugguggggccgaaguauggguuggaugug

SEQ ID NO: 59732 - RNA, 45 nt, Artificial Sequence
  derived and/or modified sequence opt11 from anti-HIV_CDR
cucgauagcucgagcgggugggaggaagugggcuauuucgaucgc

SEQ ID NO: 59733 - RNA, 45 nt, Artificial Sequence
  derived and/or modified sequence opt11 from anti-HIV_CDR
gagaacuauagcgauggaugggaagagguagggcacuuugacuau

SEQ ID NO: 59734 - RNA, 45 nt, Artificial Sequence
  derived and/or modified sequence opt11 from anti-HIV_CDR
gagaacuauagcgauggaugggaagagguagggcacuuugacucg

SEQ ID NO: 59735 - RNA, 45 nt, Artificial Sequence
  derived and/or modified sequence opt11 from anti-HIV_CDR
gagaacuauagcgauggcuggaacgaggucgggcacuuugacuuu

SEQ ID NO: 59736 - RNA, 45 nt, Artificial Sequence
  derived and/or modified sequence opt11 from anti-HIV_CDR
gaaaacuacagcgacggcugguacgaagucggacacuucgaccug

SEQ ID NO: 59737 - RNA, 45 nt, Artificial Sequence
  derived and/or modified sequence opt11 from anti-HIV_CDR
gaucgcaggcgcuuucucgaguggucgcucuauggcauggacgug

SEQ ID NO: 59738 - RNA, 45 nt, Artificial Sequence
  derived and/or modified sequence opt11 from anti-HIV_CDR
gggcccagggucuuuuucgagagcucgggcuauuacuuucgcgau

SEQ ID NO: 59739 - RNA, 45 nt, Artificial Sequence
  derived and/or modified sequence opt11 from anti-HIV_CDR
ggcccccgcguccucuucgaauccuccggccacuaccuccgcgac

SEQ ID NO: 59740 - RNA, 45 nt, Artificial Sequence
  derived and/or modified sequence opt11 from anti-HIV_CDR
ggcccccgcgucuucuucgaauccuccggcuacuacuuccgcaac

SEQ ID NO: 59741 - RNA, 45 nt, Artificial Sequence
  derived and/or modified sequence opt11 from anti-HIV_CDR
gagggggggaguuugugguuugggggggcgaauugguuggauccg

SEQ ID NO: 59742 - RNA, 45 nt, Artificial Sequence
  derived and/or modified sequence opt11 from anti-HIV_CDR
gccgauuacgauaacauaugggacagcaggggcggguucgaucua

SEQ ID NO: 59743 - RNA, 45 nt, Artificial Sequence
  derived and/or modified sequence opt11 from anti-HIV_CDR
gugggcgggaccguguggucgggcuauagcaauuacuuggacuau

SEQ ID NO: 59744 - RNA, 45 nt, Artificial Sequence
  derived and/or modified sequence opt11 from anti-HIV_CDR
gacaaucgcgaucaauggcucgugcucaggagcugguucgaccca

SEQ ID NO: 59745 - RNA, 45 nt, Artificial Sequence
  derived and/or modified sequence opt11 from anti-HIV_CDR
gaaaaaggccaaugggucacccucccacccuacuacuucgacucc

SEQ ID NO: 59746 - RNA, 48 nt, Artificial Sequence
  derived and/or modified sequence opt11 from anti-HIV_CDR
uacuucuccgacaccgaccgcuccgaauacucccccucccuccgcucc

SEQ ID NO: 59747 - RNA, 48 nt, Artificial Sequence
  derived and/or modified sequence opt11 from anti-HIV_CDR
uacauaagcgaucgcgagagcgcgaccuauaacccgagcuugaacucg

SEQ ID NO: 59748 - RNA, 48 nt, Artificial Sequence
  derived and/or modified sequence opt11 from anti-HIV_CDR
uacuucuccgacaccgaaaaauccaacuacaaccccucccuccgcucc

SEQ ID NO: 59749 - RNA, 48 nt, Artificial Sequence
  derived and/or modified sequence opt11 from anti-HIV_CDR
uacauauccgaccgcgccuccgccaccuacaacccaucccuaaacuca

SEQ ID NO: 59750 - RNA, 48 nt, Artificial Sequence
  derived and/or modified sequence opt11 from anti-HIV_CDR
uacguccaccacuccggcgacaccaacuacaaccccucccucaaacgc

SEQ ID NO: 59751 - RNA, 48 nt, Artificial Sequence
  derived and/or modified sequence opt11 from anti-HIV_CDR
uacguccacaaauccggcgacaccaacuacucccccucccucaaaucc

SEQ ID NO: 59752 - RNA, 48 nt, Artificial Sequence
  derived and/or modified sequence opt11 from anti-HIV_CDR
uacguccacgacuccggcgacaccaacuacaaccccucccucaaaucc

SEQ ID NO: 59753 - RNA, 48 nt, Artificial Sequence
  derived and/or modified sequence opt11 from anti-HIV_CDR
uacaucuccaaauccgaauccgccaacuacaaccccucccucaacucc

SEQ ID NO: 59754 - RNA, 48 nt, Artificial Sequence
  derived and/or modified sequence opt11 from anti-HIV_CDR
uacaucuacuacuccggcuccaccaacuacaaccccucccucaaaucc

SEQ ID NO: 59755 - RNA, 48 nt, Artificial Sequence
  derived and/or modified sequence opt11 from anti-HIV_CDR
uacguccacgacuccggcgacaucaacuacaaccccucccucaaaaac

SEQ ID NO: 59756 - RNA, 48 nt, Artificial Sequence
  derived and/or modified sequence opt11 from anti-HIV_CDR
ucauacuacgacuucuccaucggcgacggcaacgacgccuucgacguc

SEQ ID NO: 59757 - RNA, 48 nt, Artificial Sequence; identical to SEQ ID NO: 21547
  derived and/or modified sequence opt11 from anti-HIV_CDR

SEQ ID NO: 59758 - RNA, 48 nt, Artificial Sequence; identical to SEQ ID NO: 21548
  derived and/or modified sequence opt11 from anti-HIV_CDR

SEQ ID NO: 59759 - RNA, 48 nt, Artificial Sequence
  derived and/or modified sequence opt11 from anti-HIV_CDR
gauggguugggggagguggcgccggauuauagguaugggauagaugug

SEQ ID NO: 59760 - RNA, 48 nt, Artificial Sequence
  derived and/or modified sequence opt11 from anti-HIV_CDR
gauggcuugggcgagcucgcgcccgcguaccaguacgggaucgauguc

SEQ ID NO: 59761 - RNA, 48 nt, Artificial Sequence
  derived and/or modified sequence opt11 from anti-HIV_CDR
gauggcuugggcgagcucgcgcccgcguaccauuacgggaucgauguc

SEQ ID NO: 59762 - RNA, 48 nt, Artificial Sequence
  derived and/or modified sequence opt11 from anti-HIV_CDR
gauggcuugggcgaggucgcgcccgcguacuuguacgggaucgaugcc

SEQ ID NO: 59763 - RNA, 48 nt, Artificial Sequence
  derived and/or modified sequence opt11 from anti-HIV_CDR
gcggugaagggguuuugguuugaugagguguauaauugguuugggccg

SEQ ID NO: 59764 - RNA, 48 nt, Artificial Sequence
  derived and/or modified sequence opt11 from anti-HIV_CDR
gccgucaaaggcuucugguucgacgaccccuacaccugguucggcccc

SEQ ID NO: 59765 - RNA, 48 nt, Artificial Sequence
  derived and/or modified sequence opt11 from anti-HIV_CDR
gcaguaaagggauucugguuugacgagccgaguacaugguucgggccg

SEQ ID NO: 59766 - RNA, 48 nt, Artificial Sequence
  derived and/or modified sequence opt11 from anti-HIV_CDR
gccgugaaagggcucugguucgacgaaacguacacaugguucggcccg

SEQ ID NO: 59767 - RNA, 48 nt, Artificial Sequence
  derived and/or modified sequence opt11 from anti-HIV_CDR
gccguagccggccucugguucgaagacgccuacaacugguucggacca

SEQ ID NO: 59768 - RNA, 48 nt, Artificial Sequence
  derived and/or modified sequence opt11 from anti-HIV_CDR
gcggaagcggaaucgcaaucgcacucgcgcccgaucauguucgauuac

SEQ ID NO: 59769 - RNA, 48 nt, Artificial Sequence
  derived and/or modified sequence opt11 from anti-HIV_CDR
gcggaagcggccucggacucgcacucgcgcccgaucauguucgaucac

SEQ ID NO: 59770 - RNA, 48 nt, Artificial Sequence
  derived and/or modified sequence opt11 from anti-HIV_CDR
cucgaagccgaauccgacucccacucccgccccaucauguucgaccac

SEQ ID NO: 59771 - RNA, 48 nt, Artificial Sequence
  derived and/or modified sequence opt11 from anti-HIV_CDR
gcggaagcggaaucgcaaucgcacucgcgcccgaucauguucgauagc

SEQ ID NO: 59772 - RNA, 48 nt, Artificial Sequence
  derived and/or modified sequence opt11 from anti-HIV_CDR
gcggaagcggaaucgcaaucgcacucgcgcccgaucauguucgauuuc

SEQ ID NO: 59773 - RNA, 48 nt, Artificial Sequence
  derived and/or modified sequence opt11 from anti-HIV_CDR
gacaacccccuccuccaauccggcgaauucuccuccucccucgaaaac

SEQ ID NO: 59774 - RNA, 48 nt, Artificial Sequence
  derived and/or modified sequence opt11 from anti-HIV_CDR
gauaacccgcucuugcaaucgggcgaguucucgagcucgcucgauaac

SEQ ID NO: 59775 - RNA, 48 nt, Artificial Sequence
  derived and/or modified sequence opt11 from anti-HIV_CDR
gggcgcgauuacaauuucuggggcgggggcgggaaaauaaacuuucca

SEQ ID NO: 59776 - RNA, 48 nt, Artificial Sequence; identical to SEQ ID NO: 21566
  derived and/or modified sequence opt11 from anti-HIV_CDR

SEQ ID NO: 59777 - RNA, 48 nt, Artificial Sequence; identical to SEQ ID NO: 21567
  derived and/or modified sequence opt11 from anti-HIV_CDR

SEQ ID NO: 59778 - RNA, 48 nt, Artificial Sequence
  derived and/or modified sequence opt11 from anti-HIV_CDR
caagucuccuccuacuccuccuccggcuaccgccgcgaauucgacuac

SEQ ID NO: 59779 - RNA, 48 nt, Artificial Sequence
  derived and/or modified sequence opt11 from anti-HIV_CDR
cgcauggccacacucaccggcggcuacuacuacuacuacauggacguc

SEQ ID NO: 59780 - RNA, 48 nt, Artificial Sequence
  derived and/or modified sequence opt11 from anti-HIV_CDR
gagggcggguacucggacuuuuggucgggcuauagcggguucgauuac

SEQ ID NO: 59781 - RNA, 48 nt, Artificial Sequence; identical to SEQ ID NO: 21571
  derived and/or modified sequence opt11 from anti-HIV_CDR

SEQ ID NO: 59782 - RNA, 48 nt, Artificial Sequence
  derived and/or modified sequence opt11 from anti-HIV_CDR
gcgagggagggccgaugguuuagcgauaacuauuacgcgauggauguc

SEQ ID NO: 59783 - RNA, 48 nt, Artificial Sequence
  derived and/or modified sequence opt11 from anti-HIV_CDR
gaucgagugggcaggcgcuugggcgagcucucggccggguucgauuac

SEQ ID NO: 59784 - RNA, 48 nt, Artificial Sequence
  derived and/or modified sequence opt11 from anti-HIV_CDR
gcgagaccgagaucgccaugggacucgaccggguggucggucggguac

SEQ ID NO: 59785 - RNA, 48 nt, Artificial Sequence; identical to SEQ ID NO: 21575
  derived and/or modified sequence opt11 from anti-HIV_CDR

SEQ ID NO: 59786 - RNA, 48 nt, Artificial Sequence
  derived and/or modified sequence opt11 from anti-HIV_CDR
uccuacuacgacuuccaaaccgacuccggcaacgacgccuucgacguc

SEQ ID NO: 59787 - RNA, 48 nt, Artificial Sequence
  derived and/or modified sequence opt11 from anti-HIV_CDR
gacaaccccguccuccaacucggcgaacucuccuccucccucgacuac

SEQ ID NO: 59788 - RNA, 48 nt, Artificial Sequence
  derived and/or modified sequence opt11 from anti-HIV_CDR
ggcuuccgcggcucccccuucuccuccggcuccauguacuucgacuca

SEQ ID NO: 59789 - RNA, 48 nt, Artificial Sequence; identical to SEQ ID NO: 21579
  derived and/or modified sequence opt11 from anti-HIV_CDR

SEQ ID NO: 59790 - RNA, 48 nt, Artificial Sequence; identical to SEQ ID NO: 21580
  derived and/or modified sequence opt11 from anti-HIV_CDR

SEQ ID NO: 59791 - RNA, 48 nt, Artificial Sequence
  derived and/or modified sequence opt11 from anti-HIV_CDR
gaucgcuugagcuuuagcgugcaaguggaacagggcgugcucgauuac

SEQ ID NO: 59792 - RNA, 48 nt, Artificial Sequence
  derived and/or modified sequence opt11 from anti-HIV_CDR
gaucgcuugagcuuuagcgugcaaguggaacagggcgugcuccaguuc

SEQ ID NO: 59793 - RNA, 48 nt, Artificial Sequence; identical to SEQ ID NO: 21583
  derived and/or modified sequence opt11 from anti-HIV_CDR

SEQ ID NO: 59794 - RNA, 51 nt, Artificial Sequence
  derived and/or modified sequence opt11 from anti-HIV_CDR
uacaucuccuccggcuccuccacccuccacuacgccgacaccgucaaaggc

SEQ ID NO: 59795 - RNA, 51 nt, Artificial Sequence
  derived and/or modified sequence opt11 from anti-HIV_CDR
agauaccuagacuggucaccaaucggccgcgacaccuacggcacagacguc

SEQ ID NO: 59796 - RNA, 51 nt, Artificial Sequence
  derived and/or modified sequence opt11 from anti-HIV_CDR
cgcuacuucgacugguccccauuccgccgcgacaccuacggcaccgacguc

SEQ ID NO: 59797 - RNA, 51 nt, Artificial Sequence
  derived and/or modified sequence opt11 from anti-HIV_CDR
gggcgagauuacaauuucuggagcgggggcgggcgcuauuacuuugacuuu

SEQ ID NO: 59798 - RNA, 51 nt, Artificial Sequence
  derived and/or modified sequence opt11 from anti-HIV_CDR
ggcauacaagaggacuacgacuucuggagggaauaccgagagcucgacuac

SEQ ID NO: 59799 - RNA, 51 nt, Artificial Sequence
  derived and/or modified sequence opt11 from anti-HIV_CDR
guccucaacaacaacacccgcaaaucaaucaacaucggccccggccgcgcc

SEQ ID NO: 59800 - RNA, 51 nt, Artificial Sequence; identical to SEQ ID NO: 21590
  derived and/or modified sequence opt11 from anti-HIV_CDR

SEQ ID NO: 59801 - RNA, 51 nt, Artificial Sequence
  derived and/or modified sequence opt11 from anti-HIV_CDR
cauggcaggaccguguucggggucgugcgcaauuacuauuacauggacgug

SEQ ID NO: 59802 - RNA, 51 nt, Artificial Sequence
  derived and/or modified sequence opt11 from anti-HIV_CDR
cacuacuacggcuccggccucaccaaagacuacuacgaauacaucgacguc

SEQ ID NO: 59803 - RNA, 51 nt, Artificial Sequence
  derived and/or modified sequence opt11 from anti-HIV_CDR
accuacuacaacuucugguccgaccaaucacaaggccucgacuucgacuac

SEQ ID NO: 59804 - RNA, 51 nt, Artificial Sequence
  derived and/or modified sequence opt11 from anti-HIV_CDR
ggagugugggaggccccggacgggagcucguacuauuacuauauggcggac

SEQ ID NO: 59805 - RNA, 51 nt, Artificial Sequence
  derived and/or modified sequence opt11 from anti-HIV_CDR
gaccaaggcggcuaccccgucucaccagucggccccaaaugguucgaccca

SEQ ID NO: 59806 - RNA, 51 nt, Artificial Sequence
  derived and/or modified sequence opt11 from anti-HIV_CDR
cgcgauaaauaucaauauaucgauagcucgggcgauuacccguucgaucgc

SEQ ID NO: 59807 - RNA, 51 nt, Artificial Sequence
  derived and/or modified sequence opt11 from anti-HIV_CDR
caacuccgcgcccccacaacccgcuuccgccacggcggcuacuucgaaaac

SEQ ID NO: 59808 - RNA, 51 nt, Artificial Sequence
  derived and/or modified sequence opt11 from anti-HIV_CDR
caagugcgcgcgcccacgcucagguucaggcacgggggcuauuucgagacc

SEQ ID NO: 59809 - RNA, 51 nt, Artificial Sequence
  derived and/or modified sequence opt11 from anti-HIV_CDR
gucucgaucacguacgcgggcuugaucguggucccgggcgcguucgauguc

SEQ ID NO: 59810 - RNA, 51 nt, Artificial Sequence; identical to SEQ ID NO: 21600
  derived and/or modified sequence opt11 from anti-HIV_CDR

SEQ ID NO: 59811 - RNA, 51 nt, Artificial Sequence
  derived and/or modified sequence opt11 from anti-HIV_CDR
agcuugaccgggcgcuugcacuugggcgagcucucgagcgggaucgggccc

SEQ ID NO: 59812 - RNA, 51 nt, Artificial Sequence
  derived and/or modified sequence opt11 from anti-HIV_CDR
ggcggcuccgcccucauaaccauauucggcgucgaccccaaauucgacccc

SEQ ID NO: 59813 - RNA, 51 nt, Artificial Sequence
  derived and/or modified sequence opt11 from anti-HIV_CDR
auggcgcucacgagcgggcccuaugacgugagcggguacuauuucgauuac

SEQ ID NO: 59814 - RNA, 51 nt, Artificial Sequence
  derived and/or modified sequence opt11 from anti-HIV_CDR
auggcgcucgcgagcgggcccuaugacgugagcggguacuauuucgauuac

SEQ ID NO: 59815 - RNA, 51 nt, Artificial Sequence
  derived and/or modified sequence opt11 from anti-HIV_CDR
auggcgcuaccgagcgggccauuggacaggagcggguacuauuucgaugac

SEQ ID NO: 59816 - RNA, 54 nt, Artificial Sequence
  derived and/or modified sequence opt11 from anti-HIV_CDR
gucguccccauguucuccaucuucggcgucgucaaagccaacuacuucgacuac

SEQ ID NO: 59817 - RNA, 54 nt, Artificial Sequence
  derived and/or modified sequence opt11 from anti-HIV_CDR
aacagacgcguggccaugcccgaggccaugauccuaagcuucuacauggacgua

SEQ ID NO: 59818 - RNA, 54 nt, Artificial Sequence
  derived and/or modified sequence opt11 from anti-HIV_CDR
ggguuguguaggggggggaauuguagguuggggccgagugggugguuggauccg

SEQ ID NO: 59819 - RNA, 54 nt, Artificial Sequence
  derived and/or modified sequence opt11 from anti-HIV_CDR
acccccccccacuacgacguccucaccggcuaccccuccuccguccucgaauuc

SEQ ID NO: 59820 - RNA, 54 nt, Artificial Sequence
  derived and/or modified sequence opt11 from anti-HIV_CDR
auccccuaccacuccgaauccuacuacaaagucgucaucggcggcuucgacguc

SEQ ID NO: 59821 - RNA, 54 nt, Artificial Sequence
  derived and/or modified sequence opt11 from anti-HIV_CDR
gccgaccccuucaaagucgcccaagacgaaggccucuucgucaucuucgacuac

SEQ ID NO: 59822 - RNA, 54 nt, Artificial Sequence
  derived and/or modified sequence opt11 from anti-HIV_CDR
gccgaccccuucaaagucgcccaagacgaaggccucuacgucaucuucgacuac

SEQ ID NO: 59823 - RNA, 54 nt, Artificial Sequence
  derived and/or modified sequence opt11 from anti-HIV_CDR
gccgaccgcuucaaagucgcccaagacgaaggccuauucgucaucuucgacuac

SEQ ID NO: 59824 - RNA, 54 nt, Artificial Sequence
  derived and/or modified sequence opt11 from anti-HIV_CDR
gggcgccagaccuuucgcgcaaucuggagcgggcccccggccguguucgauauc

SEQ ID NO: 59825 - RNA, 54 nt, Artificial Sequence
  derived and/or modified sequence opt11 from anti-HIV_CDR
ggccgccaaaccuuccgcgcaaucugguccggcccacccgucguauucgacauc

SEQ ID NO: 59826 - RNA, 54 nt, Artificial Sequence
  derived and/or modified sequence opt11 from anti-HIV_CDR
ucccgcggcgacuacaacuucugguccggcuaccccgaauaccacuucgaccgc

SEQ ID NO: 59827 - RNA, 54 nt, Artificial Sequence
  derived and/or modified sequence opt11 from anti-HIV_CDR
cuccccaaaucccgcauggucggcggcgaccaccuccccuucuaccccgacuuc

SEQ ID NO: 59828 - RNA, 54 nt, Artificial Sequence
  derived and/or modified sequence opt11 from anti-HIV_CDR
cucaccggccccuccggcuacugcgacuccuccggcuguuacugguucgacccc

SEQ ID NO: 59829 - RNA, 54 nt, Artificial Sequence
  derived and/or modified sequence opt11 from anti-HIV_CDR
ggcgggagcaugaucaggggcgugcccucgcccuuuuacuauggcauggacgug

SEQ ID NO: 59830 - RNA, 54 nt, Artificial Sequence
  derived and/or modified sequence opt11 from anti-HIV_CDR
cuauuuggcgcgaaaaggcucggggucgcgccaucgggcuauuacauggacgug

SEQ ID NO: 59831 - RNA, 54 nt, Artificial Sequence
  derived and/or modified sequence opt11 from anti-HIV_CDR
gauagguaugaggcggcgugguuuggggcggauaagguguaugggauggaugug

SEQ ID NO: 59832 - RNA, 54 nt, Artificial Sequence
  derived and/or modified sequence opt11 from anti-HIV_CDR
gaacaccgccuccccccccccaccggccgccgcacccgcaacugguucgaccca

SEQ ID NO: 59833 - RNA, 54 nt, Artificial Sequence
  derived and/or modified sequence opt11 from anti-HIV_CDR
ggcaggggcucguuccagggcuuucaacaguacgaguacuauggcauggacgug

SEQ ID NO: 59834 - RNA, 54 nt, Artificial Sequence
  derived and/or modified sequence opt11 from anti-HIV_CDR
ggccgaggcuacagccacggcuuccaacaauacaacuacuacggcauggacgua

SEQ ID NO: 59835 - RNA, 54 nt, Artificial Sequence
  derived and/or modified sequence opt11 from anti-HIV_CDR
ggccgcggcagcuucaccggauucgaccaauaccacuacuacggaauggacguc

SEQ ID NO: 59836 - RNA, 54 nt, Artificial Sequence
  derived and/or modified sequence opt11 from anti-HIV_CDR
ggccgcggcuccaccuuccccuccgcccaauucuccuacuucggccucgacguc

SEQ ID NO: 59837 - RNA, 54 nt, Artificial Sequence
  derived and/or modified sequence opt11 from anti-HIV_CDR
gaucucgcgcgcuauggcgugaccucgaucgugcccgaguucggguucgauuuc

SEQ ID NO: 59838 - RNA, 54 nt, Artificial Sequence; identical to SEQ ID NO: 21628
  derived and/or modified sequence opt11 from anti-HIV_CDR

SEQ ID NO: 59839 - RNA, 54 nt, Artificial Sequence
  derived and/or modified sequence opt11 from anti-HIV_CDR
ggaccgggcucgauggugagagggcuaauaguaacgagcuauggcauggacgug

SEQ ID NO: 59840 - RNA, 54 nt, Artificial Sequence
  derived and/or modified sequence opt11 from anti-HIV_CDR
aagcgcgugaccauauucggggucguggacacgcccaggggcuauuucgauuac

SEQ ID NO: 59841 - RNA, 54 nt, Artificial Sequence
  derived and/or modified sequence opt11 from anti-HIV_CDR
ggccaacgcaacguccuccacuuccucgaacgcaaaaacgacgccuucgacauc

SEQ ID NO: 59842 - RNA, 54 nt, Artificial Sequence
  derived and/or modified sequence opt11 from anti-HIV_CDR
gaacaaaaagacuacgacuucuggaacggccucuacaaauacggcauggacgua

SEQ ID NO: 59843 - RNA, 57 nt, Artificial Sequence
  derived and/or modified sequence opt11 from anti-HIV_CDR
gacacaaccacauucacaaccuucggcggcggcccaaacaugggcggauucgaccca

SEQ ID NO: 59844 - RNA, 57 nt, Artificial Sequence
  derived and/or modified sequence opt11 from anti-HIV_CDR
gccgggcuagauuacaauuucuggaacgggaaagggcgaaagggcgcguucgaugua

SEQ ID NO: 59845 - RNA, 57 nt, Artificial Sequence
  derived and/or modified sequence opt11 from anti-HIV_CDR
aacgaggccgacuaccacgacgggaacgggcacucgcucagaggcauguucgacuac

SEQ ID NO: 59846 - RNA, 57 nt, Artificial Sequence
  derived and/or modified sequence opt11 from anti-HIV_CDR
aacgaaccccaauaccacgacggcaacggacacucacucccaggcauguucgacagc

SEQ ID NO: 59847 - RNA, 57 nt, Artificial Sequence
  derived and/or modified sequence opt11 from anti-HIV_CDR
aacgaaccccaauaccacgacgacaacggccacucacuccccggcaugaucgacuac

SEQ ID NO: 59848 - RNA, 57 nt, Artificial Sequence
  derived and/or modified sequence opt11 from anti-HIV_CDR
aacgaaccccaauaccacgacggcaacggccacucacuccccggcauguucgacuuc

SEQ ID NO: 59849 - RNA, 57 nt, Artificial Sequence
  derived and/or modified sequence opt11 from anti-HIV_CDR
aacgaaccccaauacuucgacggcuccggccacucacuccccggcauguucgacuac

SEQ ID NO: 59850 - RNA, 57 nt, Artificial Sequence
  derived and/or modified sequence opt11 from anti-HIV_CDR
cgcgaggccgauuaccaugacgggaacgggcacacgcucccgggcauguucgauuuc

SEQ ID NO: 59851 - RNA, 57 nt, Artificial Sequence
  derived and/or modified sequence opt11 from anti-HIV_CDR
aacgagccccaguacuacgacggaagcggacacucacucccgggcauguucgacuac

SEQ ID NO: 59852 - RNA, 57 nt, Artificial Sequence
  derived and/or modified sequence opt11 from anti-HIV_CDR
aacgaaccccaauaccacgacggcaacggccacucacuccccggcauguucgacuac

SEQ ID NO: 59853 - RNA, 57 nt, Artificial Sequence
  derived and/or modified sequence opt11 from anti-HIV_CDR
caagauagcgauuuccaugacgggcacgggcacacgcucaggggcauguucgauagc

SEQ ID NO: 59854 - RNA, 57 nt, Artificial Sequence
  derived and/or modified sequence opt11 from anti-HIV_CDR
cucgauugggugcgcggggucaugaacuuggucgagaaccauuacgcgauggauguc

SEQ ID NO: 59855 - RNA, 57 nt, Artificial Sequence
  derived and/or modified sequence opt11 from anti-HIV_CDR
acgaacgggacggagauauuuaggccgggggggggggauaugagggacaauuggagg

SEQ ID NO: 59856 - RNA, 57 nt, Artificial Sequence
  derived and/or modified sequence opt11 from anti-HIV_CDR
gacggccgcuacuccggcgacgaccaauacuacuaccacuacuacuacauggacguc

SEQ ID NO: 59857 - RNA, 57 nt, Artificial Sequence
  derived and/or modified sequence opt11 from anti-HIV_CDR
cucacgaaaaaccccucacaagacuucuggggcucguaccuguacuacuucgaggac

SEQ ID NO: 59858 - RNA, 57 nt, Artificial Sequence
  derived and/or modified sequence opt11 from anti-HIV_CDR
ggcgcgaccuauuacuaugacucgagcgggcaccagagcaggcgcgcguucgauauc

SEQ ID NO: 59859 - RNA, 57 nt, Artificial Sequence
  derived and/or modified sequence opt11 from anti-HIV_CDR
gcguuccaggccucgauggugcgcggggucauagucgaucccuauggcauggacgug

SEQ ID NO: 59860 - RNA, 57 nt, Artificial Sequence
  derived and/or modified sequence opt11 from anti-HIV_CDR
caccgagccgacuacgacuucuggaacggcuccaaccuccgcggcuacuucgacccc

SEQ ID NO: 59861 - RNA, 57 nt, Artificial Sequence
  derived and/or modified sequence opt11 from anti-HIV_CDR
caccgcgccaacuacgacuucuggggcggcucaaaccuccgcggcuacuucgaccca

SEQ ID NO: 59862 - RNA, 57 nt, Artificial Sequence
  derived and/or modified sequence opt11 from anti-HIV_CDR
ggcuuucacuuuuggucgggcacgggcacgcgcccgcgcaauugguauuucgaucuc

SEQ ID NO: 59863 - RNA, 57 nt, Artificial Sequence
  derived and/or modified sequence opt11 from anti-HIV_CDR
aacuaccucaucgaaucccgcuacgacgaaaaagacuacuacuacgccauggacguc

SEQ ID NO: 59864 - RNA, 57 nt, Artificial Sequence
  derived and/or modified sequence opt11 from anti-HIV_CDR
ucacgcggcuacgccuacgacuccggcggccacuacuuccccacaugguucgaccca

SEQ ID NO: 59865 - RNA, 57 nt, Artificial Sequence
  derived and/or modified sequence opt11 from anti-HIV_CDR
gacacgacaacguucggggccuuuggcgggagcccgaacaugggcgggcuagaucca

SEQ ID NO: 59866 - RNA, 57 nt, Artificial Sequence
  derived and/or modified sequence opt11 from anti-HIV_CDR
caucucguggucgcggucgcggccgggcccgauuacuuuagcuauggcauggacgug

SEQ ID NO: 59867 - RNA, 57 nt, Artificial Sequence; identical to SEQ ID NO: 21657
  derived and/or modified sequence opt11 from anti-HIV_CDR

SEQ ID NO: 59868 - RNA, 57 nt, Artificial Sequence
  derived and/or modified sequence opt11 from anti-HIV_CDR
gacacgacaacguucggggcauuuggagggggagcgaacaugggcgggcuagaucca

SEQ ID NO: 59869 - RNA, 57 nt, Artificial Sequence
  derived and/or modified sequence opt11 from anti-HIV_CDR
gacacaaccacauucaccuccuucggcucacccccccgcaugggcggccucgacccc

SEQ ID NO: 59870 - RNA, 57 nt, Artificial Sequence; identical to SEQ ID NO: 21660
  derived and/or modified sequence opt11 from anti-HIV_CDR

SEQ ID NO: 59871 - RNA, 57 nt, Artificial Sequence
  derived and/or modified sequence opt11 from anti-HIV_CDR
gaucgagugagcgauuacgauuucuggagcgggaaaaggggcuauggcauggacgug

SEQ ID NO: 59872 - RNA, 57 nt, Artificial Sequence
  derived and/or modified sequence opt11 from anti-HIV_CDR
gagcucucgggcgaguaccauuucuggagcgggaccuaucgcuauggcguggacgug

SEQ ID NO: 59873 - RNA, 57 nt, Artificial Sequence
  derived and/or modified sequence opt11 from anti-HIV_CDR
cacggcgccuccgaaaacuacggccccggcuccuacuccgccgaacacuuccaacac

SEQ ID NO: 59874 - RNA, 57 nt, Artificial Sequence
  derived and/or modified sequence opt11 from anti-HIV_CDR
cacggcgccuccgccaacuacggccccggcuccuacuccgccgaacacuuccaacac

SEQ ID NO: 59875 - RNA, 60 nt, Artificial Sequence
  derived and/or modified sequence opt11 from anti-HIV_CDR
cacgaagccccccgcuacuccuacgccuuccgccgcuacuaccacuacggccucgacguc

SEQ ID NO: 59876 - RNA, 60 nt, Artificial Sequence
  derived and/or modified sequence opt11 from anti-HIV_CDR
accuccaccuacgaccaaugguccggccuccaccacgacggcgucauggccuucuccucc

SEQ ID NO: 59877 - RNA, 60 nt, Artificial Sequence
  derived and/or modified sequence opt11 from anti-HIV_CDR
ggggaauuugacucgagcggguucgauuacgagagcugguacccguacuauauggauguc

SEQ ID NO: 59878 - RNA, 60 nt, Artificial Sequence
  derived and/or modified sequence opt11 from anti-HIV_CDR
ggccaaaccgaccucaacgacgacuucugguccgaauacuccacccccggcuucgacuac

SEQ ID NO: 59879 - RNA, 60 nt, Artificial Sequence
  derived and/or modified sequence opt11 from anti-HIV_CDR
ggccaaaccgaccucaacgacgaccucugguccgacuacucaacccccggcuucgacuac

SEQ ID NO: 59880 - RNA, 60 nt, Artificial Sequence
  derived and/or modified sequence opt11 from anti-HIV_CDR
aaccucaucgaagaaucccaaacccaacaagaaaucaacgaacgcgaccuccucgcccuc

SEQ ID NO: 59881 - RNA, 60 nt, Artificial Sequence
  derived and/or modified sequence opt11 from anti-HIV_CDR
aaccugaucgaggaaucgcaaauacaacaggaaaagaacgagaaagagcuccuggaacug

SEQ ID NO: 59882 - RNA, 60 nt, Artificial Sequence
  derived and/or modified sequence opt11 from anti-HIV_CDR
agccugaucgaaaacucacaaauacaacaggaaaaaaacgaacaagaccuccugcaacug

SEQ ID NO: 59883 - RNA, 60 nt, Artificial Sequence
  derived and/or modified sequence opt11 from anti-HIV_CDR
agccugaucgaggaaucgcaaauacaacaggaaaagaacgagaaagagcuccuggaacug

SEQ ID NO: 59884 - RNA, 60 nt, Artificial Sequence
  derived and/or modified sequence opt11 from anti-HIV_CDR
cgccugaucgaggaaucgcaaacgcaacaggaaaagaacgagcaagagcucuuggaauug

SEQ ID NO: 59885 - RNA, 60 nt, Artificial Sequence
  derived and/or modified sequence opt11 from anti-HIV_CDR
agccugaucgaggaaucgcaaacgcaacaggaaaagaacgagaaagagcucuuggaauug

SEQ ID NO: 59886 - RNA, 60 nt, Artificial Sequence
  derived and/or modified sequence opt11 from anti-HIV_CDR
aaccugcucgaagaaucacaaaaccaacaggagaaaaacgaacaagaacuccuggaacug

SEQ ID NO: 59887 - RNA, 60 nt, Artificial Sequence
  derived and/or modified sequence opt11 from anti-HIV_CDR
acacucauagaagaaagccagaaccagcaagagaaaaacgaacuggaacugcucgaacuc

SEQ ID NO: 59888 - RNA, 60 nt, Artificial Sequence
  derived and/or modified sequence opt11 from anti-HIV_CDR
acccuccaagaagaaagccaaaaccaacaagaaaaaaacgaacaagaacuccucgaacuc

SEQ ID NO: 59889 - RNA, 60 nt, Artificial Sequence
  derived and/or modified sequence opt11 from anti-HIV_CDR
agccugcucgaagaaucacaaaaccaacaggagaaaaacgaacaagaacuccuggaacug

SEQ ID NO: 59890 - RNA, 60 nt, Artificial Sequence
  derived and/or modified sequence opt11 from anti-HIV_CDR
acccucaucgaagaaucccaaaaccaacaagaaaaaaaccaacaagaacuccuccaacuc

SEQ ID NO: 59891 - RNA, 60 nt, Artificial Sequence
  derived and/or modified sequence opt11 from anti-HIV_CDR
acccucaucgaagaaucccaaaaccaacaagaaaaaaacgaacaagaacuccucggccuc

SEQ ID NO: 59892 - RNA, 60 nt, Artificial Sequence
  derived and/or modified sequence opt11 from anti-HIV_CDR
acccucaucgaagaaucccaaaaccaacaagaaaaaaacgaacaagaacuccucgaacuc

SEQ ID NO: 59893 - RNA, 60 nt, Artificial Sequence
  derived and/or modified sequence opt11 from anti-HIV_CDR
agccugaucgaggacucgcaaauacaacaggaaaagaacgagaaagagcuccuggaacug

SEQ ID NO: 59894 - RNA, 60 nt, Artificial Sequence
  derived and/or modified sequence opt11 from anti-HIV_CDR
ucccuccucgaaaaaucccaaacccaacaagaaaaaaacgaacaagaacuccucgaacuc

SEQ ID NO: 59895 - RNA, 60 nt, Artificial Sequence
  derived and/or modified sequence opt11 from anti-HIV_CDR
agccugaucgaagaaucacaaaaccaacaggagaaaaacgaacaagaacuccuggaacug

SEQ ID NO: 59896 - RNA, 60 nt, Artificial Sequence
  derived and/or modified sequence opt11 from anti-HIV_CDR
ggcgaucucuugggcuauaccgacagcugguacgaguucgauuacuauuacauggacgug

SEQ ID NO: 59897 - RNA, 60 nt, Artificial Sequence
  derived and/or modified sequence opt11 from anti-HIV_CDR
gacacgaaugggacggagauauuuaggccgggggggggggauaugagggauaauuggagg

SEQ ID NO: 59898 - RNA, 60 nt, Artificial Sequence
  derived and/or modified sequence opt11 from anti-HIV_CDR
gaugugguggagaggccgggguuuggggauuuuagguaugauuauuaugggauggaugug

SEQ ID NO: 59899 - RNA, 60 nt, Artificial Sequence
  derived and/or modified sequence opt11 from anti-HIV_CDR
gaucaaagggacugcagcacgaacaggugcuucggcguguucggguacuauauggacgua

SEQ ID NO: 59900 - RNA, 60 nt, Artificial Sequence
  derived and/or modified sequence opt11 from anti-HIV_CDR
gaccgcugggucaggccccaguucccgagcauggacuuucaauauaacgggcucgacguc

SEQ ID NO: 59901 - RNA, 60 nt, Artificial Sequence
  derived and/or modified sequence opt11 from anti-HIV_CDR
gacuccggcuucgaccucgacuacuacgacacaaacgaacucuacuucggcuucgacuac

SEQ ID NO: 59902 - RNA, 60 nt, Artificial Sequence
  derived and/or modified sequence opt11 from anti-HIV_CDR
aaauaccccgccuacuacgacauccucaccgccaacuaccgcuccuacuacuucgacuac

SEQ ID NO: 59903 - RNA, 60 nt, Artificial Sequence
  derived and/or modified sequence opt11 from anti-HIV_CDR
aaauaccccgccuacuacgacauccucaccggcuacuaccgcaacuacuacuucgacuac

SEQ ID NO: 59904 - RNA, 60 nt, Artificial Sequence
  derived and/or modified sequence opt11 from anti-HIV_CDR
cgcguaaaauucccccucugguucggcgaaaccacauacuacuacuacggcauggacguc

SEQ ID NO: 59905 - RNA, 60 nt, Artificial Sequence
  derived and/or modified sequence opt11 from anti-HIV_CDR
gagcgcucgaccaaguacucguucuggagcgcggucaugcgcccggacgcguucgaucuc

SEQ ID NO: 59906 - RNA, 60 nt, Artificial Sequence
  derived and/or modified sequence opt11 from anti-HIV_CDR
cacgaagccccccgcuacuccuacgccuuccgcaacuacuaccacuacggccucgacguc

SEQ ID NO: 59907 - RNA, 60 nt, Artificial Sequence
  derived and/or modified sequence opt11 from anti-HIV_CDR
gaaaacguccucauggaauccgacgacuacaacgacuacuacuacuacuacauggacguc

SEQ ID NO: 59908 - RNA, 60 nt, Artificial Sequence
  derived and/or modified sequence opt11 from anti-HIV_CDR
gagcgcgugcucguguucccggaccaggacgcggacuauuacuauuacuuuuucgauguc

SEQ ID NO: 59909 - RNA, 60 nt, Artificial Sequence
  derived and/or modified sequence opt11 from anti-HIV_CDR
gaacgcguccucgucguccccgaccaagacgccgacuacuacuacuacuucuucgacguc

SEQ ID NO: 59910 - RNA, 63 nt, Artificial Sequence
  derived and/or modified sequence opt11 from anti-HIV_CDR
gaccgcuccuccgccaucggcuacugcuccuccaucuccugcuacaaaggcuccuucgacauc

SEQ ID NO: 59911 - RNA, 63 nt, Artificial Sequence
  derived and/or modified sequence opt11 from anti-HIV_CDR
gucgugaaaauagaaccgcucggggucgcgcccacgaaagcgaaaagggucgcgcgcgagaaa

SEQ ID NO: 59912 - RNA, 63 nt, Artificial Sequence
  derived and/or modified sequence opt11 from anti-HIV_CDR
guggugaggauagagccguuggggguggcgccgacgaaggcgaagaggguggagagggagaag

SEQ ID NO: 59913 - RNA, 63 nt, Artificial Sequence
  derived and/or modified sequence opt11 from anti-HIV_CDR
gucgugcgcauagaaccgcucgggaucgcgcccacgcgcgcgaaaagggucgagcgcgagaaa

SEQ ID NO: 59914 - RNA, 63 nt, Artificial Sequence
  derived and/or modified sequence opt11 from anti-HIV_CDR
guggugaagauagagccgauagggguggcgccgacgaaggcgaggaggguggagagggagaag

SEQ ID NO: 59915 - RNA, 63 nt, Artificial Sequence
  derived and/or modified sequence opt11 from anti-HIV_CDR
gucgugaaaauagaaccgcucggggucgcgcccacgcgcgcgaaaagggucgagcgcgagaaa

SEQ ID NO: 59916 - RNA, 63 nt, Artificial Sequence
  derived and/or modified sequence opt11 from anti-HIV_CDR
gucgugcaaauagaaccgcucggggucgcgcccacgcgcgcgaaaagggucgagcgcgagaaa

SEQ ID NO: 59917 - RNA, 63 nt, Artificial Sequence
  derived and/or modified sequence opt11 from anti-HIV_CDR
guggugaggauagagccguuggggguggcgccgacgaaggcgaagagggugcagagggagaag

SEQ ID NO: 59918 - RNA, 63 nt, Artificial Sequence
  derived and/or modified sequence opt11 from anti-HIV_CDR
gucgucaaaaucgaaccccucggcgucgcccccaccaaagccaaacgcguccaacgcaaaaaa

SEQ ID NO: 59919 - RNA, 63 nt, Artificial Sequence
  derived and/or modified sequence opt11 from anti-HIV_CDR
gucaucaaaaucgaaccccucaucgucgcccccaccaaagccaaacgcguccaacgcgaaaaa

SEQ ID NO: 59920 - RNA, 63 nt, Artificial Sequence
  derived and/or modified sequence opt11 from anti-HIV_CDR
gucgugaaaauagaaccgcucggggucgcgcccacgaaagcgcgcaggguccagcgcgagaaa

SEQ ID NO: 59921 - RNA, 63 nt, Artificial Sequence
  derived and/or modified sequence opt11 from anti-HIV_CDR
guggugaagauagaguuguuggggguggcgccgacgaaggcgaagagggugcagagggagaag

SEQ ID NO: 59922 - RNA, 63 nt, Artificial Sequence
  derived and/or modified sequence opt11 from anti-HIV_CDR
guggugacgauagagccguuggggguggcgccgacgaaggcgaagagggugcagagggagaag

SEQ ID NO: 59923 - RNA, 63 nt, Artificial Sequence
  derived and/or modified sequence opt11 from anti-HIV_CDR
guagugaaaauagagccgcuggggguggcgccgacgaaggcgaaaaggguacagagagagaaa

SEQ ID NO: 59924 - RNA, 63 nt, Artificial Sequence
  derived and/or modified sequence opt11 from anti-HIV_CDR
gaccucgucuccgucuccccacccuacggcaacuacggccccgacaacaacugguucgacuuc

SEQ ID NO: 59925 - RNA, 63 nt, Artificial Sequence
  derived and/or modified sequence opt11 from anti-HIV_CDR
augaacccacccugguuccgcggcggcuccaacaaccccuacuccuacuacuacauggacguc

SEQ ID NO: 59926 - RNA, 63 nt, Artificial Sequence
  derived and/or modified sequence opt11 from anti-HIV_CDR
gacuggaucggguacgauuacgauggcucgggcucgcacuugcgcgaugaaucguucgauauc

SEQ ID NO: 59927 - RNA, 63 nt, Artificial Sequence
  derived and/or modified sequence opt11 from anti-HIV_CDR
ugcucgaucgugggcaauggcgauuucuuggaagaggacucgcacuaucccgcgauggauguc

SEQ ID NO: 59928 - RNA, 63 nt, Artificial Sequence
  derived and/or modified sequence opt11 from anti-HIV_CDR
gauuucgugagcauauacggggucgcguacuuuaccgggggcgggcccucgagcccggacaua

SEQ ID NO: 59929 - RNA, 66 nt, Artificial Sequence
  derived and/or modified sequence opt11 from anti-HIV_CDR
aaagccaaagacuacuacuacgaauccuccgacuacucccccuacuacuacuacuacauggacguc

SEQ ID NO: 59930 - RNA, 66 nt, Artificial Sequence
  derived and/or modified sequence opt11 from anti-HIV_CDR
gaccacggcaucaaacccgacaacuacuacgacaucuccggcuacaaccucgacuacuucgacuac

SEQ ID NO: 59931 - RNA, 66 nt, Artificial Sequence
  derived and/or modified sequence opt11 from anti-HIV_CDR
ggcucccucuacgacuaccgcgacaacgccgaccucaaacccuccuacuacuacgccauggacguc

SEQ ID NO: 59932 - RNA, 66 nt, Artificial Sequence
  derived and/or modified sequence opt11 from anti-HIV_CDR
gaugaggcgaguuggguggaggcggcggaugagugggaugagcauuuguuuagggagauggcggug

SEQ ID NO: 59933 - RNA, 66 nt, Artificial Sequence
  derived and/or modified sequence opt11 from anti-HIV_CDR
gaugaggugaguuggguggaggcggcggaugagugggaugagcauuuguuuagggagauggcggug

SEQ ID NO: 59934 - RNA, 66 nt, Artificial Sequence
  derived and/or modified sequence opt11 from anti-HIV_CDR
gaugaggggaguuggguggaggcggcggaugagugggaugagcauuuguuuagggagauggcggug

SEQ ID NO: 59935 - RNA, 66 nt, Artificial Sequence
  derived and/or modified sequence opt11 from anti-HIV_CDR
gaucaaaggggcagguacucguucggguucgugaccgggcaaacgaaagugagcgcgaucucggac

SEQ ID NO: 59936 - RNA, 66 nt, Artificial Sequence
  derived and/or modified sequence opt11 from anti-HIV_CDR
gaucaauugggcagguacucguucggguucgugaccgggcaaaauaaagugagcgcgaucucggac

SEQ ID NO: 59937 - RNA, 66 nt, Artificial Sequence
  derived and/or modified sequence opt11 from anti-HIV_CDR
gaucaagugggcagguacucguucggguucgcgaccgggcaacagcgcgugagcgcgaucucggac

SEQ ID NO: 59938 - RNA, 69 nt, Artificial Sequence
  derived and/or modified sequence opt11 from anti-HIV_CDR
guggugaagauagagccguuggggguggcgccgacgaaggcgaagaggaggguggugcagagggagaag

SEQ ID NO: 59939 - RNA, 69 nt, Artificial Sequence; identical to SEQ ID NO: 21729
  derived and/or modified sequence opt11 from anti-HIV_CDR

SEQ ID NO: 59940 - RNA, 69 nt, Artificial Sequence
  derived and/or modified sequence opt11 from anti-HIV_CDR
gacaaacccgccuacgacgaauacgccgaagaaaccaucgccccccacaacuaccacgccauggaccuc

SEQ ID NO: 59941 - RNA, 69 nt, Artificial Sequence
  derived and/or modified sequence opt11 from anti-HIV_CDR
caaaacauagccgcccgcgcagccgaaaaacuauacgaaaacgacuacuacuucuacggcauggacgua

SEQ ID NO: 59942 - RNA, 69 nt, Artificial Sequence
  derived and/or modified sequence opt11 from anti-HIV_CDR
cagaacauagccgcacgcacggccgaacgccuguacgaaaacgacuacuacuucuacggcauggacgua

SEQ ID NO: 59943 - RNA, 72 nt, Artificial Sequence
  derived and/or modified sequence opt11 from anti-HIV_CDR
gcgcaacagggcaagcgcauauacgggaucgugagcuuuggcgaguucuuuuacuauuacuauauggaugcc

SEQ ID NO: 59944 - RNA, 72 nt, Artificial Sequence
  derived and/or modified sequence opt11 from anti-HIV_CDR
acccaacaaggcaaacgcaucuacggcgucgucuccuucggcgaauucuuccacuacuacuacauggacgcc

SEQ ID NO: 59945 - RNA, 72 nt, Artificial Sequence
  derived and/or modified sequence opt11 from anti-HIV_CDR
gcgcgcaggggccagcgcauauacggggucgugagcuuuggcgaguucuuuuacuauuacucgauggauguc

SEQ ID NO: 59946 - RNA, 72 nt, Artificial Sequence
  derived and/or modified sequence opt11 from anti-HIV_CDR
acccuccacggccgccgcaucuacggcaucgucgccuucaacgaaugguucaccuacuucuacauggacguc

SEQ ID NO: 59947 - RNA, 72 nt, Artificial Sequence
  derived and/or modified sequence opt11 from anti-HIV_CDR
accaaacacggccgccgcaucuacggcaucgucgccuucaacgaaugguucaccuacuucuacauggacguc

SEQ ID NO: 59948 - RNA, 72 nt, Artificial Sequence
  derived and/or modified sequence opt11 from anti-HIV_CDR
gcccgccacggccaacgcaucuacggcgucgucuccuucggcgaauucuucaccuacuacucaauggacguc

SEQ ID NO: 59949 - RNA, 72 nt, Artificial Sequence
  derived and/or modified sequence opt11 from anti-HIV_CDR
acgcaacagggcaagcgcauauacggggucgugagcuucggcgacuacuacuacuacuacuacauggacguc

SEQ ID NO: 59950 - RNA, 72 nt, Artificial Sequence
  derived and/or modified sequence opt11 from anti-HIV_CDR
accaagcacgggcgcaggaucuauggcguggucgcguucggggaaugguucacguacuuuuacauggacgug

SEQ ID NO: 59951 - RNA, 72 nt, Artificial Sequence
  derived and/or modified sequence opt11 from anti-HIV_CDR
gccgucaucaccgaccuccacaccuucggcgacuacgaacucgaagaccccuccuacuacuacauggacguc

SEQ ID NO: 59952 - RNA, 72 nt, Artificial Sequence
  derived and/or modified sequence opt11 from anti-HIV_CDR
gacagaggagacacaagacugcuggacuacggagacuacgaagacgaaagauacuacuacggaauggacgua

SEQ ID NO: 59953 - RNA, 72 nt, Artificial Sequence
  derived and/or modified sequence opt11 from anti-HIV_CDR
ggcaccagauacgacuucugguccggcuucucaaacagagacggccgcgcccucgccggcuacuucgacuac

SEQ ID NO: 59954 - RNA, 72 nt, Artificial Sequence
  derived and/or modified sequence opt11 from anti-HIV_CDR
gauggcaagggcaaggccuauuacgacuucuggagcggguacaggaaccagaaauauuacgggcucgauguc

SEQ ID NO: 59955 - RNA, 72 nt, Artificial Sequence
  derived and/or modified sequence opt11 from anti-HIV_CDR
gccgucaucaccgaccuccacaccuucgccgacuacgaacucggcgaccccuccuacuucuacauggacguc

SEQ ID NO: 59956 - RNA, 72 nt, Artificial Sequence
  derived and/or modified sequence opt11 from anti-HIV_CDR
uccgucaucaccgaccuccacaccuucggcgacuacgaauccggcgaccccuccuacuacuacauggacguc

SEQ ID NO: 59957 - RNA, 81 nt, Artificial Sequence
  derived and/or modified sequence opt11 from anti-HIV_CDR
gacuucccccgcuuccaccgccucgucggcaacuacgacuucuggcgcggcacccuagaccgcuucuccuacauggaccua

SEQ ID NO: 59958 - RNA, 105 nt, Artificial Sequence
  derived and/or modified sequence opt11 from anti-HIV_CDR
cgcauacucgcggucgagcgcuaucucaaggaccagcaauugcucgggaucuggggcuguagcgggaaaauaaucugucccacgauggugcccuggaacucgagc

SEQ ID NO: 59959 - RNA, 105 nt, Artificial Sequence
  derived and/or modified sequence opt11 from anti-HIV_CDR
cgcguccucgccgucgaacgcuaccuccaagaccaacgccuccucggcauguggggcugcuccggcaaacacaucugcaccaccuucguccccuggaacuccucc

SEQ ID NO: 59960 - RNA, 105 nt, Artificial Sequence
  derived and/or modified sequence opt11 from anti-HIV_CDR
cgcgugcucgcggucgagagcuaucucaaggaccagcaauugcucgggaucuggggcuguagcgggaaacauaucuguaccacgaccgugcccuggaacucgagc

SEQ ID NO: 59961 - RNA, 105 nt, Artificial Sequence
  derived and/or modified sequence opt11 from anti-HIV_CDR
cgcguccucgccgucgaacgcuaccuccgcgaccaacaacuccucggcaucuggggcugcuccggccgccacaucugcaccaccaacguccccuggaacuccucc

SEQ ID NO: 59962 - RNA, 105 nt, Artificial Sequence
  derived and/or modified sequence opt11 from anti-HIV_CDR
cgcauacucgcggucgagcgcuaucucaaggaccagcaauugcucgggaucuggggcuguagcgggaaauugaucuguaccacgaccgugcccuggaacucgagc

SEQ ID NO: 59963 - RNA, 105 nt, Artificial Sequence
  derived and/or modified sequence opt11 from anti-HIV_CDR
cgcauacucgcggucgagcgcuaucucaaggaccagcaauugcucgggaucuggggcuguagcgggaaacauaucuguaccacgaacgugcccuggaacucgagc

SEQ ID NO: 59964 - RNA, 105 nt, Artificial Sequence
  derived and/or modified sequence opt11 from anti-HIV_CDR
cgcguccuagccgucgaacgcuaccuccgcgaccaacaacuccucggcaucuggggcugcuccggcaaacucaucugcaccaccaccguccccuggaacgccucc

SEQ ID NO: 59965 - RNA, 105 nt, Artificial Sequence
  derived and/or modified sequence opt11 from anti-HIV_CDR
agggucuuggccguggaaagguacuugcgcgaucaacagcucuugggcauaugggggugcucgggcaagcucauaugcacgaccgcggucccguggaaugccucg

SEQ ID NO: 59966 - RNA, 105 nt, Artificial Sequence
  derived and/or modified sequence opt11 from anti-HIV_CDR
cgcgugcucgcggucgagcgcuaucucaaggaccagcaauugcucgggaucuggggcuguagcgggaaauugaucuguaccacgaccgugcccuggaacgcgagc

SEQ ID NO: 59967 - RNA, 105 nt, Artificial Sequence
  derived and/or modified sequence opt11 from anti-HIV_CDR
cgcauacucgcggucgagcgcuaucucaaggaccagcaauugcucggguucuggggcuguagcgggaaauugaucuguaccacggccgugcccuggaacgcgagc

SEQ ID NO: 59968 - RNA, 105 nt, Artificial Sequence
  derived and/or modified sequence opt11 from anti-HIV_CDR
cgcguccucgccgucgaacgcuaccuccgcgaccaacaacuccucggcaucuggggcugcuccggcaaacucaucugcaccaccaccguccccuggaacaccucc

SEQ ID NO: 59969 - RNA, 105 nt, Artificial Sequence
  derived and/or modified sequence opt11 from anti-HIV_CDR
cgcgugcucgcggucgagcgcuaucucaaggaccagcaauugcucgggaucuggggcuguagcgggaaauugaucuguaccacggccgugcccuggaacgcgagc

SEQ ID NO: 59970 - RNA, 105 nt, Artificial Sequence
  derived and/or modified sequence opt11 from anti-HIV_CDR
cgcgugcucgcggucgagcgcuaucucaaggaccagcaauugcucggguucuggggcuguagcgggaaauugaucuguaccacgaccgugcccuggaacgcgagc

SEQ ID NO: 59971 - RNA, 105 nt, Artificial Sequence
  derived and/or modified sequence opt11 from anti-HIV_CDR
cgcauacucgcggucgagcgcuaucucaaggaccagcaauugcucgggaucuggggcuguagcgggaaauugaucuguaccacggccgugcccuggaacgcgagc

SEQ ID NO: 59972-59997 - skipped (26 entries)

SEQ ID NO: 59998 - RNA, 12 nt, Artificial Sequence
  derived and/or modified sequence opt11 from anti-influenza_CDR
gacgugccagau

SEQ ID NO: 59999 - RNA, 12 nt, Artificial Sequence
  derived and/or modified sequence opt11 from anti-influenza_CDR
agauugagcggg

SEQ ID NO: 60000 - RNA, 12 nt, Artificial Sequence
  derived and/or modified sequence opt11 from anti-influenza_CDR
uucugggaccug

SEQ ID NO: 60001 - RNA, 15 nt, Artificial Sequence
  derived and/or modified sequence opt11 from anti-influenza_CDR
acaggccuaagaaac

SEQ ID NO: 60002 - RNA, 15 nt, Artificial Sequence
  derived and/or modified sequence opt11 from anti-influenza_CDR
caacaaucccgcacc

SEQ ID NO: 60003 - RNA, 15 nt, Artificial Sequence
  derived and/or modified sequence opt11 from anti-influenza_CDR
caacucucccgcacc

SEQ ID NO: 60004 - RNA, 15 nt, Artificial Sequence
  derived and/or modified sequence opt11 from anti-influenza_CDR
uccaacuacaucacc

SEQ ID NO: 60005 - RNA, 15 nt, Artificial Sequence
  derived and/or modified sequence opt11 from anti-influenza_CDR
gacuacagcuggaac

SEQ ID NO: 60006 - RNA, 15 nt, Artificial Sequence
  derived and/or modified sequence opt11 from anti-influenza_CDR
aacuacgccuucuca

SEQ ID NO: 60007 - RNA, 15 nt, Artificial Sequence
  derived and/or modified sequence opt11 from anti-influenza_CDR
aagaacgcgaucucg

SEQ ID NO: 60008 - RNA, 15 nt, Artificial Sequence
  derived and/or modified sequence opt11 from anti-influenza_CDR
ucgcacuggaugacg

SEQ ID NO: 60009 - RNA, 15 nt, Artificial Sequence
  derived and/or modified sequence opt11 from anti-influenza_CDR
aacuacgacaucaac

SEQ ID NO: 60010 - RNA, 15 nt, Artificial Sequence
  derived and/or modified sequence opt11 from anti-influenza_CDR
gauuauggggugacg

SEQ ID NO: 60011 - RNA, 15 nt, Artificial Sequence
  derived and/or modified sequence opt11 from anti-influenza_CDR
aacuacggcaucaac

SEQ ID NO: 60012 - RNA, 15 nt, Artificial Sequence
  derived and/or modified sequence opt11 from anti-influenza_CDR
ggguacacgaucacg

SEQ ID NO: 60013 - RNA, 15 nt, Artificial Sequence
  derived and/or modified sequence opt11 from anti-influenza_CDR
aacuacggcaucagc

SEQ ID NO: 60014 - RNA, 15 nt, Artificial Sequence
  derived and/or modified sequence opt11 from anti-influenza_CDR
gacgacuacuggaca

SEQ ID NO: 60015 - RNA, 15 nt, Artificial Sequence
  derived and/or modified sequence opt11 from anti-influenza_CDR
accuacgccaugcac

SEQ ID NO: 60016 - RNA, 15 nt, Artificial Sequence
  derived and/or modified sequence opt11 from anti-influenza_CDR
uccuacgccaugcac

SEQ ID NO: 60017 - RNA, 15 nt, Artificial Sequence
  derived and/or modified sequence opt11 from anti-influenza_CDR
agcuauuacuggaac

SEQ ID NO: 60018 - RNA, 15 nt, Artificial Sequence
  derived and/or modified sequence opt11 from anti-influenza_CDR
acguauccggucgcg

SEQ ID NO: 60019 - RNA, 15 nt, Artificial Sequence
  derived and/or modified sequence opt11 from anti-influenza_CDR
cacuacuucuggucc

SEQ ID NO: 60020 - RNA, 15 nt, Artificial Sequence
  derived and/or modified sequence opt11 from anti-influenza_CDR
gacuacuacuggaca

SEQ ID NO: 60021 - RNA, 15 nt, Artificial Sequence
  derived and/or modified sequence opt11 from anti-influenza_CDR
gacuacuacugguca

SEQ ID NO: 60022 - RNA, 15 nt, Artificial Sequence
  derived and/or modified sequence opt11 from anti-influenza_CDR
ggcuacuacaugcac

SEQ ID NO: 60023 - RNA, 15 nt, Artificial Sequence
  derived and/or modified sequence opt11 from anti-influenza_CDR
ucccacuacuggucc

SEQ ID NO: 60024 - RNA, 15 nt, Artificial Sequence
  derived and/or modified sequence opt11 from anti-influenza_CDR
aauuacuggaucggg

SEQ ID NO: 60025 - RNA, 15 nt, Artificial Sequence
  derived and/or modified sequence opt11 from anti-influenza_CDR
aacuacgccaucaua

SEQ ID NO: 60026 - RNA, 15 nt, Artificial Sequence
  derived and/or modified sequence opt11 from anti-influenza_CDR
gacuacuacauccau

SEQ ID NO: 60027 - RNA, 15 nt, Artificial Sequence
  derived and/or modified sequence opt11 from anti-influenza_CDR
ggcuacgacaugcau

SEQ ID NO: 60028 - RNA, 15 nt, Artificial Sequence
  derived and/or modified sequence opt11 from anti-influenza_CDR
ggcuacuacauccac

SEQ ID NO: 60029 - RNA, 15 nt, Artificial Sequence
  derived and/or modified sequence opt11 from anti-influenza_CDR
ggcuauuacgugcac

SEQ ID NO: 60030 - RNA, 15 nt, Artificial Sequence
  derived and/or modified sequence opt11 from anti-influenza_CDR
aacuacuggaugagc

SEQ ID NO: 60031 - RNA, 15 nt, Artificial Sequence
  derived and/or modified sequence opt11 from anti-influenza_CDR
ggcgagagcacgcua

SEQ ID NO: 60032 - RNA, 15 nt, Artificial Sequence
  derived and/or modified sequence opt11 from anti-influenza_CDR
aacuacuacuggucc

SEQ ID NO: 60033 - RNA, 15 nt, Artificial Sequence
  derived and/or modified sequence opt11 from anti-influenza_CDR
uccaacuacaugucc

SEQ ID NO: 60034 - RNA, 15 nt, Artificial Sequence
  derived and/or modified sequence opt11 from anti-influenza_CDR
agcgauuacuggagc

SEQ ID NO: 60035 - RNA, 15 nt, Artificial Sequence
  derived and/or modified sequence opt11 from anti-influenza_CDR
agcuauaacuggauc

SEQ ID NO: 60036 - RNA, 15 nt, Artificial Sequence
  derived and/or modified sequence opt11 from anti-influenza_CDR
agcacguacaugaac

SEQ ID NO: 60037 - RNA, 15 nt, Artificial Sequence
  derived and/or modified sequence opt11 from anti-influenza_CDR
aacuacgccaugucc

SEQ ID NO: 60038 - RNA, 15 nt, Artificial Sequence
  derived and/or modified sequence opt11 from anti-influenza_CDR
agcgauuucuggagc

SEQ ID NO: 60039 - RNA, 15 nt, Artificial Sequence
  derived and/or modified sequence opt11 from anti-influenza_CDR
uacuacgccaugucc

SEQ ID NO: 60040 - RNA, 15 nt, Artificial Sequence
  derived and/or modified sequence opt11 from anti-influenza_CDR
ggcuauuacguguac

SEQ ID NO: 60041 - RNA, 15 nt, Artificial Sequence
  derived and/or modified sequence opt11 from anti-influenza_CDR
uccuacgccaucucc

SEQ ID NO: 60042 - RNA, 15 nt, Artificial Sequence
  derived and/or modified sequence opt11 from anti-influenza_CDR
uccuacuccuggucc

SEQ ID NO: 60043 - RNA, 15 nt, Artificial Sequence
  derived and/or modified sequence opt11 from anti-influenza_CDR
aauucguucuggggc

SEQ ID NO: 60044 - RNA, 15 nt, Artificial Sequence
  derived and/or modified sequence opt11 from anti-influenza_CDR
gccuaccacugguca

SEQ ID NO: 60045 - RNA, 15 nt, Artificial Sequence
  derived and/or modified sequence opt11 from anti-influenza_CDR
gacaacuacaucaau

SEQ ID NO: 60046 - RNA, 15 nt, Artificial Sequence
  derived and/or modified sequence opt11 from anti-influenza_CDR
ucgggcuuuagcgug

SEQ ID NO: 60047 - RNA, 15 nt, Artificial Sequence
  derived and/or modified sequence opt11 from anti-influenza_CDR
gcguacgcguucacg

SEQ ID NO: 60048 - RNA, 15 nt, Artificial Sequence
  derived and/or modified sequence opt11 from anti-influenza_CDR
ggcucggccauuagu

SEQ ID NO: 60049 - RNA, 15 nt, Artificial Sequence
  derived and/or modified sequence opt11 from anti-influenza_CDR
ucguacgcgaucacg

SEQ ID NO: 60050 - RNA, 15 nt, Artificial Sequence
  derived and/or modified sequence opt11 from anti-influenza_CDR
uccuacuacaugcac

SEQ ID NO: 60051 - RNA, 15 nt, Artificial Sequence
  derived and/or modified sequence opt11 from anti-influenza_CDR
aucuacgccaugucc

SEQ ID NO: 60052 - RNA, 15 nt, Artificial Sequence
  derived and/or modified sequence opt11 from anti-influenza_CDR
uccuacuccaugaac

SEQ ID NO: 60053 - RNA, 15 nt, Artificial Sequence
  derived and/or modified sequence opt11 from anti-influenza_CDR
agcuacggcauuagc

SEQ ID NO: 60054 - RNA, 15 nt, Artificial Sequence
  derived and/or modified sequence opt11 from anti-influenza_CDR
uucuacuccaugucc

SEQ ID NO: 60055 - RNA, 15 nt, Artificial Sequence
  derived and/or modified sequence opt11 from anti-influenza_CDR
acccacgccaucuca

SEQ ID NO: 60056 - RNA, 15 nt, Artificial Sequence
  derived and/or modified sequence opt11 from anti-influenza_CDR
ggguacgcgaucucg

SEQ ID NO: 60057 - RNA, 15 nt, Artificial Sequence
  derived and/or modified sequence opt11 from anti-influenza_CDR
ucuaacucaaucucc

SEQ ID NO: 60058 - RNA, 15 nt, Artificial Sequence
  derived and/or modified sequence opt11 from anti-influenza_CDR
aacuucgccaucaac

SEQ ID NO: 60059 - RNA, 15 nt, Artificial Sequence
  derived and/or modified sequence opt11 from anti-influenza_CDR
uccaaugccgucucc

SEQ ID NO: 60060 - RNA, 15 nt, Artificial Sequence
  derived and/or modified sequence opt11 from anti-influenza_CDR
gauaacgcgaucucg

SEQ ID NO: 60061 - RNA, 15 nt, Artificial Sequence
  derived and/or modified sequence opt11 from anti-influenza_CDR
uuuagcgaggucgag

SEQ ID NO: 60062 - RNA, 15 nt, Artificial Sequence
  derived and/or modified sequence opt11 from anti-influenza_CDR
gcccaccacaugcau

SEQ ID NO: 60063 - RNA, 15 nt, Artificial Sequence
  derived and/or modified sequence opt11 from anti-influenza_CDR
agucaguggauaggg

SEQ ID NO: 60064 - RNA, 15 nt, Artificial Sequence
  derived and/or modified sequence opt11 from anti-influenza_CDR
gacuacgccaugaau

SEQ ID NO: 60065 - RNA, 15 nt, Artificial Sequence
  derived and/or modified sequence opt11 from anti-influenza_CDR
aacgcguggaugagc

SEQ ID NO: 60066 - RNA, 15 nt, Artificial Sequence
  derived and/or modified sequence opt11 from anti-influenza_CDR
gacuacgccaucaau

SEQ ID NO: 60067 - RNA, 15 nt, Artificial Sequence
  derived and/or modified sequence opt11 from anti-influenza_CDR
cgccacggcauaagc

SEQ ID NO: 60068 - RNA, 15 nt, Artificial Sequence
  derived and/or modified sequence opt11 from anti-influenza_CDR
gaacucuccauccac

SEQ ID NO: 60069 - RNA, 15 nt, Artificial Sequence
  derived and/or modified sequence opt11 from anti-influenza_CDR
uccuccaacuacuac

SEQ ID NO: 60070 - RNA, 15 nt, Artificial Sequence
  derived and/or modified sequence opt11 from anti-influenza_CDR
accuacgccaugucc

SEQ ID NO: 60071 - RNA, 15 nt, Artificial Sequence
  derived and/or modified sequence opt11 from anti-influenza_CDR
aacuacgccaucuca

SEQ ID NO: 60072 - RNA, 18 nt, Artificial Sequence
  derived and/or modified sequence opt11 from anti-influenza_CDR
uuuggcgcgauagcgggc

SEQ ID NO: 60073 - RNA, 18 nt, Artificial Sequence
  derived and/or modified sequence opt11 from anti-influenza_CDR
caagacaucucccgcuac

SEQ ID NO: 60074 - RNA, 18 nt, Artificial Sequence
  derived and/or modified sequence opt11 from anti-influenza_CDR
cagaauauagggccgugg

SEQ ID NO: 60075 - RNA, 18 nt, Artificial Sequence
  derived and/or modified sequence opt11 from anti-influenza_CDR
cagagcgugaacaggcgc

SEQ ID NO: 60076 - RNA, 18 nt, Artificial Sequence
  derived and/or modified sequence opt11 from anti-influenza_CDR
caauccaucuccaccuac

SEQ ID NO: 60077 - RNA, 18 nt, Artificial Sequence
  derived and/or modified sequence opt11 from anti-influenza_CDR
cagggcauaaucacguac

SEQ ID NO: 60078 - RNA, 18 nt, Artificial Sequence
  derived and/or modified sequence opt11 from anti-influenza_CDR
caaggcaucuccagcuac

SEQ ID NO: 60079 - RNA, 18 nt, Artificial Sequence
  derived and/or modified sequence opt11 from anti-influenza_CDR
caggacgugaguacgugg

SEQ ID NO: 60080 - RNA, 18 nt, Artificial Sequence
  derived and/or modified sequence opt11 from anti-influenza_CDR
caagacaucuacaucuac

SEQ ID NO: 60081 - RNA, 18 nt, Artificial Sequence
  derived and/or modified sequence opt11 from anti-influenza_CDR
gaaaacaucuggaacaac

SEQ ID NO: 60082 - RNA, 18 nt, Artificial Sequence
  derived and/or modified sequence opt11 from anti-influenza_CDR
ggguucacggucacgagu

SEQ ID NO: 60083 - RNA, 18 nt, Artificial Sequence
  derived and/or modified sequence opt11 from anti-influenza_CDR
caggacauaagcgggcac

SEQ ID NO: 60084 - RNA, 18 nt, Artificial Sequence
  derived and/or modified sequence opt11 from anti-influenza_CDR
ucacuacugaccgaaguc

SEQ ID NO: 60085 - RNA, 18 nt, Artificial Sequence
  derived and/or modified sequence opt11 from anti-influenza_CDR
ggcucgagcauaagcaau

SEQ ID NO: 60086 - RNA, 18 nt, Artificial Sequence
  derived and/or modified sequence opt11 from anti-influenza_CDR
ggcgggagcauaacaucg

SEQ ID NO: 60087 - RNA, 18 nt, Artificial Sequence
  derived and/or modified sequence opt11 from anti-influenza_CDR
ggcgggagcauaagcucg

SEQ ID NO: 60088 - RNA, 18 nt, Artificial Sequence
  derived and/or modified sequence opt11 from anti-influenza_CDR
ggccucuccgucuccuca

SEQ ID NO: 60089 - RNA, 18 nt, Artificial Sequence
  derived and/or modified sequence opt11 from anti-influenza_CDR
ggcgcgagcauaagcucg

SEQ ID NO: 60090 - RNA, 18 nt, Artificial Sequence
  derived and/or modified sequence opt11 from anti-influenza_CDR
ggcgacagcauaagcucg

SEQ ID NO: 60091 - RNA, 18 nt, Artificial Sequence
  derived and/or modified sequence opt11 from anti-influenza_CDR
ggcgggagcauaagcaau

SEQ ID NO: 60092 - RNA, 18 nt, Artificial Sequence
  derived and/or modified sequence opt11 from anti-influenza_CDR
ggcgggagcauaagcgcg

SEQ ID NO: 60093 - RNA, 18 nt, Artificial Sequence
  derived and/or modified sequence opt11 from anti-influenza_CDR
ggcuucagcguguccgau

SEQ ID NO: 60094 - RNA, 18 nt, Artificial Sequence
  derived and/or modified sequence opt11 from anti-influenza_CDR
ucgcgaucgcucgauguc

SEQ ID NO: 60095 - RNA, 18 nt, Artificial Sequence
  derived and/or modified sequence opt11 from anti-influenza_CDR
cgcucacaacagaccgua

SEQ ID NO: 60096 - RNA, 18 nt, Artificial Sequence
  derived and/or modified sequence opt11 from anti-influenza_CDR
caaaccaucaacaacuac

SEQ ID NO: 60097 - RNA, 18 nt, Artificial Sequence
  derived and/or modified sequence opt11 from anti-influenza_CDR
aacaugggcccgaccucg

SEQ ID NO: 60098 - RNA, 18 nt, Artificial Sequence
  derived and/or modified sequence opt11 from anti-influenza_CDR
cagguaguggggacgaac

SEQ ID NO: 60099 - RNA, 18 nt, Artificial Sequence
  derived and/or modified sequence opt11 from anti-influenza_CDR
cagggcauaaacacgcac

SEQ ID NO: 60100 - RNA, 18 nt, Artificial Sequence
  derived and/or modified sequence opt11 from anti-influenza_CDR
caagacauccgcaaccgc

SEQ ID NO: 60101 - RNA, 18 nt, Artificial Sequence
  derived and/or modified sequence opt11 from anti-influenza_CDR
caggggauagggaguaau

SEQ ID NO: 60102 - RNA, 18 nt, Artificial Sequence
  derived and/or modified sequence opt11 from anti-influenza_CDR
caaaccaucuaccgcugg

SEQ ID NO: 60103 - RNA, 18 nt, Artificial Sequence
  derived and/or modified sequence opt11 from anti-influenza_CDR
caaaccaucacccgcuuc

SEQ ID NO: 60104 - RNA, 18 nt, Artificial Sequence
  derived and/or modified sequence opt11 from anti-influenza_CDR
cgccugggcgagaaauuu

SEQ ID NO: 60105 - RNA, 18 nt, Artificial Sequence
  derived and/or modified sequence opt11 from anti-influenza_CDR
aagcucggggacaaguuc

SEQ ID NO: 60106 - RNA, 18 nt, Artificial Sequence
  derived and/or modified sequence opt11 from anti-influenza_CDR
cagggguuggggaguaau

SEQ ID NO: 60107 - RNA, 18 nt, Artificial Sequence
  derived and/or modified sequence opt11 from anti-influenza_CDR
uacaucggcucaaaaucc

SEQ ID NO: 60108 - RNA, 18 nt, Artificial Sequence
  derived and/or modified sequence opt11 from anti-influenza_CDR
caacucaucuccuccuac

SEQ ID NO: 60109 - RNA, 18 nt, Artificial Sequence
  derived and/or modified sequence opt11 from anti-influenza_CDR
caauccgucuccuccaac

SEQ ID NO: 60110 - RNA, 18 nt, Artificial Sequence
  derived and/or modified sequence opt11 from anti-influenza_CDR
caagucaucuccuccuac

SEQ ID NO: 60111 - RNA, 18 nt, Artificial Sequence
  derived and/or modified sequence opt11 from anti-influenza_CDR
cagagcgugaacaggaac

SEQ ID NO: 60112 - RNA, 18 nt, Artificial Sequence
  derived and/or modified sequence opt11 from anti-influenza_CDR
gauaucgggagcaagagc

SEQ ID NO: 60113 - RNA, 18 nt, Artificial Sequence
  derived and/or modified sequence opt11 from anti-influenza_CDR
caauccgucuccaccaac

SEQ ID NO: 60114 - RNA, 18 nt, Artificial Sequence
  derived and/or modified sequence opt11 from anti-influenza_CDR
augauugcgggcuggcac

SEQ ID NO: 60115 - RNA, 18 nt, Artificial Sequence
  derived and/or modified sequence opt11 from anti-influenza_CDR
caggacauaagcacgugg

SEQ ID NO: 60116 - RNA, 18 nt, Artificial Sequence
  derived and/or modified sequence opt11 from anti-influenza_CDR
gagaaaauauacucgaac

SEQ ID NO: 60117 - RNA, 21 nt, Artificial Sequence
  derived and/or modified sequence opt11 from anti-influenza_CDR
aucuacuacaacuacaacauc

SEQ ID NO: 60118 - RNA, 21 nt, Artificial Sequence
  derived and/or modified sequence opt11 from anti-influenza_CDR
caaucgaucucgagcggguac

SEQ ID NO: 60119 - RNA, 21 nt, Artificial Sequence
  derived and/or modified sequence opt11 from anti-influenza_CDR
caaucggucucgagcucguac

SEQ ID NO: 60120 - RNA, 21 nt, Artificial Sequence
  derived and/or modified sequence opt11 from anti-influenza_CDR
caaaccgucuccucauccuac

SEQ ID NO: 60121 - RNA, 21 nt, Artificial Sequence
  derived and/or modified sequence opt11 from anti-influenza_CDR
agcaauaacgcggucuggaac

SEQ ID NO: 60122 - RNA, 21 nt, Artificial Sequence
  derived and/or modified sequence opt11 from anti-influenza_CDR
agcaauagcgcggucuggaac

SEQ ID NO: 60123 - RNA, 21 nt, Artificial Sequence
  derived and/or modified sequence opt11 from anti-influenza_CDR
gccgccaccacccuccaauca

SEQ ID NO: 60124 - RNA, 21 nt, Artificial Sequence
  derived and/or modified sequence opt11 from anti-influenza_CDR
agcaaucgcgcgaccuggaac

SEQ ID NO: 60125 - RNA, 21 nt, Artificial Sequence
  derived and/or modified sequence opt11 from anti-influenza_CDR
gccaccuccacccuccaauca

SEQ ID NO: 60126 - RNA, 21 nt, Artificial Sequence
  derived and/or modified sequence opt11 from anti-influenza_CDR
agcaauagcgcgaccuggaac

SEQ ID NO: 60127 - RNA, 21 nt, Artificial Sequence
  derived and/or modified sequence opt11 from anti-influenza_CDR
gccuccuccacccuccaaucc

SEQ ID NO: 60128 - RNA, 21 nt, Artificial Sequence
  derived and/or modified sequence opt11 from anti-influenza_CDR
agcuauaacgcggucuggaac

SEQ ID NO: 60129 - RNA, 21 nt, Artificial Sequence
  derived and/or modified sequence opt11 from anti-influenza_CDR
gccgcgagcucgcgcuugagc

SEQ ID NO: 60130 - RNA, 21 nt, Artificial Sequence
  derived and/or modified sequence opt11 from anti-influenza_CDR
gccgcgagcucgcgcgggagc

SEQ ID NO: 60131 - RNA, 21 nt, Artificial Sequence
  derived and/or modified sequence opt11 from anti-influenza_CDR
auauaccacuccggcuccgcc

SEQ ID NO: 60132 - RNA, 21 nt, Artificial Sequence
  derived and/or modified sequence opt11 from anti-influenza_CDR
aucuauuacuccggcgucacc

SEQ ID NO: 60133 - RNA, 21 nt, Artificial Sequence
  derived and/or modified sequence opt11 from anti-influenza_CDR
uccagcuaucucgccugguac

SEQ ID NO: 60134 - RNA, 21 nt, Artificial Sequence
  derived and/or modified sequence opt11 from anti-influenza_CDR
caaucccucuccuccuccucc

SEQ ID NO: 60135 - RNA, 21 nt, Artificial Sequence
  derived and/or modified sequence opt11 from anti-influenza_CDR
cagagcgugagcauaagcuau

SEQ ID NO: 60136 - RNA, 21 nt, Artificial Sequence
  derived and/or modified sequence opt11 from anti-influenza_CDR
gacguaaccgaacgcccgagc

SEQ ID NO: 60137 - RNA, 21 nt, Artificial Sequence
  derived and/or modified sequence opt11 from anti-influenza_CDR
gccgccucaacccuccuagac

SEQ ID NO: 60138 - RNA, 21 nt, Artificial Sequence
  derived and/or modified sequence opt11 from anti-influenza_CDR
gccgccuccacccuccacuca

SEQ ID NO: 60139 - RNA, 21 nt, Artificial Sequence
  derived and/or modified sequence opt11 from anti-influenza_CDR
ggagcaagcucgcuacaggga

SEQ ID NO: 60140 - RNA, 21 nt, Artificial Sequence
  derived and/or modified sequence opt11 from anti-influenza_CDR
acaaauggcgugaacgugggc

SEQ ID NO: 60141 - RNA, 21 nt, Artificial Sequence
  derived and/or modified sequence opt11 from anti-influenza_CDR
gacgcgagcacgcgcgcgaca

SEQ ID NO: 60142 - RNA, 21 nt, Artificial Sequence
  derived and/or modified sequence opt11 from anti-influenza_CDR
ucagagaccuauuacuggucc

SEQ ID NO: 60143 - RNA, 21 nt, Artificial Sequence
  derived and/or modified sequence opt11 from anti-influenza_CDR
gaagcggucaaucuagagagc

SEQ ID NO: 60144 - RNA, 21 nt, Artificial Sequence
  derived and/or modified sequence opt11 from anti-influenza_CDR
ggcgcgagcacgcgcgcgaca

SEQ ID NO: 60145 - RNA, 21 nt, Artificial Sequence
  derived and/or modified sequence opt11 from anti-influenza_CDR
gugagcggguacuauuggucg

SEQ ID NO: 60146 - RNA, 21 nt, Artificial Sequence
  derived and/or modified sequence opt11 from anti-influenza_CDR
auaacgggcgugcgagugggc

SEQ ID NO: 60147 - RNA, 21 nt, Artificial Sequence
  derived and/or modified sequence opt11 from anti-influenza_CDR
gacgcgagcaaucgcgcgaca

SEQ ID NO: 60148 - RNA, 21 nt, Artificial Sequence
  derived and/or modified sequence opt11 from anti-influenza_CDR
gaggucacgaacuggccaucg

SEQ ID NO: 60149 - RNA, 21 nt, Artificial Sequence
  derived and/or modified sequence opt11 from anti-influenza_CDR
aaagauagcgagcgcccgagc

SEQ ID NO: 60150 - RNA, 21 nt, Artificial Sequence
  derived and/or modified sequence opt11 from anti-influenza_CDR
agcgggaacuauuacuggaac

SEQ ID NO: 60151 - RNA, 21 nt, Artificial Sequence
  derived and/or modified sequence opt11 from anti-influenza_CDR
uccacaaccauccgccacucc

SEQ ID NO: 60152 - RNA, 21 nt, Artificial Sequence
  derived and/or modified sequence opt11 from anti-influenza_CDR
gacgauagcgggcgaccgagc

SEQ ID NO: 60153 - RNA, 21 nt, Artificial Sequence
  derived and/or modified sequence opt11 from anti-influenza_CDR
cgcaaugacuugcgaccgagc

SEQ ID NO: 60154 - RNA, 21 nt, Artificial Sequence
  derived and/or modified sequence opt11 from anti-influenza_CDR
uccgucgaccacuacuggucc

SEQ ID NO: 60155 - RNA, 21 nt, Artificial Sequence
  derived and/or modified sequence opt11 from anti-influenza_CDR
gccgucuccauccuccaaucc

SEQ ID NO: 60156 - RNA, 21 nt, Artificial Sequence
  derived and/or modified sequence opt11 from anti-influenza_CDR
gacgacaccgaccgcccauca

SEQ ID NO: 60157 - RNA, 21 nt, Artificial Sequence
  derived and/or modified sequence opt11 from anti-influenza_CDR
gaaaauaacaagcgcccgagc

SEQ ID NO: 60158 - RNA, 21 nt, Artificial Sequence
  derived and/or modified sequence opt11 from anti-influenza_CDR
gacucgagcaaucgcgcgcca

SEQ ID NO: 60159 - RNA, 21 nt, Artificial Sequence
  derived and/or modified sequence opt11 from anti-influenza_CDR
gaaguaaccaaacgcccgagc

SEQ ID NO: 60160 - RNA, 21 nt, Artificial Sequence
  derived and/or modified sequence opt11 from anti-influenza_CDR
gccaccuccaacacccacuca

SEQ ID NO: 60161 - RNA, 21 nt, Artificial Sequence
  derived and/or modified sequence opt11 from anti-influenza_CDR
gccgcaagcaaccucgaaaac

SEQ ID NO: 60162 - RNA, 21 nt, Artificial Sequence
  derived and/or modified sequence opt11 from anti-influenza_CDR
gccgccuccggccuccaauca

SEQ ID NO: 60163 - RNA, 21 nt, Artificial Sequence
  derived and/or modified sequence opt11 from anti-influenza_CDR
ggcuucaccgucuccuccaac

SEQ ID NO: 60164 - RNA, 21 nt, Artificial Sequence
  derived and/or modified sequence opt11 from anti-influenza_CDR
ggggggggguauaguuggaau

SEQ ID NO: 60165 - RNA, 21 nt, Artificial Sequence
  derived and/or modified sequence opt11 from anti-influenza_CDR
ggcgccuccaaccuccaauca

SEQ ID NO: 60166 - RNA, 21 nt, Artificial Sequence
  derived and/or modified sequence opt11 from anti-influenza_CDR
ggcgcaaccaaucuccagagc

SEQ ID NO: 60167 - RNA, 21 nt, Artificial Sequence
  derived and/or modified sequence opt11 from anti-influenza_CDR
ggcgccuccaaccuccacucc

SEQ ID NO: 60168 - RNA, 21 nt, Artificial Sequence
  derived and/or modified sequence opt11 from anti-influenza_CDR
ggcgcaagcacgcuccagagc

SEQ ID NO: 60169 - RNA, 21 nt, Artificial Sequence
  derived and/or modified sequence opt11 from anti-influenza_CDR
gacaacuccgaccgcccauca

SEQ ID NO: 60170 - RNA, 21 nt, Artificial Sequence
  derived and/or modified sequence opt11 from anti-influenza_CDR
ggcgcaagcucgcuccagagc

SEQ ID NO: 60171 - RNA, 21 nt, Artificial Sequence
  derived and/or modified sequence opt11 from anti-influenza_CDR
ggcaauagcaaucgcccgagc

SEQ ID NO: 60172 - RNA, 21 nt, Artificial Sequence
  derived and/or modified sequence opt11 from anti-influenza_CDR
gccgccuccucccuccaauca

SEQ ID NO: 60173 - RNA, 21 nt, Artificial Sequence
  derived and/or modified sequence opt11 from anti-influenza_CDR
gccgccuccucccuccacuca

SEQ ID NO: 60174 - RNA, 21 nt, Artificial Sequence
  derived and/or modified sequence opt11 from anti-influenza_CDR
ggcgcaagcacgcuccagaac

SEQ ID NO: 60175 - RNA, 21 nt, Artificial Sequence
  derived and/or modified sequence opt11 from anti-influenza_CDR
ggcgcaaccgaucuccagagc

SEQ ID NO: 60176 - RNA, 21 nt, Artificial Sequence
  derived and/or modified sequence opt11 from anti-influenza_CDR
uccggcgccuacuacuggacc

SEQ ID NO: 60177 - RNA, 21 nt, Artificial Sequence
  derived and/or modified sequence opt11 from anti-influenza_CDR
gucuccgacaacuacaucaac

SEQ ID NO: 60178 - RNA, 21 nt, Artificial Sequence
  derived and/or modified sequence opt11 from anti-influenza_CDR
ugggcgagcacgcgcgagagc

SEQ ID NO: 60179 - RNA, 21 nt, Artificial Sequence
  derived and/or modified sequence opt11 from anti-influenza_CDR
agcaauaaccagcgcccgagc

SEQ ID NO: 60180 - RNA, 21 nt, Artificial Sequence
  derived and/or modified sequence opt11 from anti-influenza_CDR
gaaguaagcaaucgcccgagc

SEQ ID NO: 60181 - RNA, 21 nt, Artificial Sequence
  derived and/or modified sequence opt11 from anti-influenza_CDR
aaaaacacccaacgccccucc

SEQ ID NO: 60182 - RNA, 21 nt, Artificial Sequence
  derived and/or modified sequence opt11 from anti-influenza_CDR
gacaacaacaaacgcccguca

SEQ ID NO: 60183 - RNA, 21 nt, Artificial Sequence
  derived and/or modified sequence opt11 from anti-influenza_CDR
gacgcgagcacgcucaggagc

SEQ ID NO: 60184 - RNA, 21 nt, Artificial Sequence
  derived and/or modified sequence opt11 from anti-influenza_CDR
caagauaacaggcgcccgagc

SEQ ID NO: 60185 - RNA, 21 nt, Artificial Sequence
  derived and/or modified sequence opt11 from anti-influenza_CDR
gacguaagcaagcgcccgagc

SEQ ID NO: 60186 - RNA, 21 nt, Artificial Sequence
  derived and/or modified sequence opt11 from anti-influenza_CDR
gacgcgagcucgcgcgcgaca

SEQ ID NO: 60187 - RNA, 21 nt, Artificial Sequence
  derived and/or modified sequence opt11 from anti-influenza_CDR
cucgggagcaaucgcgcgagc

SEQ ID NO: 60188 - RNA, 21 nt, Artificial Sequence
  derived and/or modified sequence opt11 from anti-influenza_CDR
ggagcgagcacgagagcggca

SEQ ID NO: 60189 - RNA, 21 nt, Artificial Sequence
  derived and/or modified sequence opt11 from anti-influenza_CDR
gacgacagcgaccgcccaagc

SEQ ID NO: 60190 - RNA, 21 nt, Artificial Sequence
  derived and/or modified sequence opt11 from anti-influenza_CDR
cgcgauggccagcgaccgagc

SEQ ID NO: 60191 - RNA, 21 nt, Artificial Sequence
  derived and/or modified sequence opt11 from anti-influenza_CDR
ggcgcgagcucgcgcgcgaca

SEQ ID NO: 60192 - RNA, 21 nt, Artificial Sequence
  derived and/or modified sequence opt11 from anti-influenza_CDR
ggcgcgagcucgcgcgcgagc

SEQ ID NO: 60193 - RNA, 21 nt, Artificial Sequence
  derived and/or modified sequence opt11 from anti-influenza_CDR
gccgccuccacccuccaauca

SEQ ID NO: 60194 - RNA, 21 nt, Artificial Sequence
  derived and/or modified sequence opt11 from anti-influenza_CDR
cucgugagcaagcgcgcgagc

SEQ ID NO: 60195 - RNA, 21 nt, Artificial Sequence
  derived and/or modified sequence opt11 from anti-influenza_CDR
gacgucaccuaccgcccauca

SEQ ID NO: 60196 - RNA, 21 nt, Artificial Sequence
  derived and/or modified sequence opt11 from anti-influenza_CDR
augcaagcacucgagaccccg

SEQ ID NO: 60197 - RNA, 21 nt, Artificial Sequence
  derived and/or modified sequence opt11 from anti-influenza_CDR
caaaacuacggcucccccuuc

SEQ ID NO: 60198 - RNA, 21 nt, Artificial Sequence
  derived and/or modified sequence opt11 from anti-influenza_CDR
caacaauacggcucccucccc

SEQ ID NO: 60199 - RNA, 21 nt, Artificial Sequence
  derived and/or modified sequence opt11 from anti-influenza_CDR
ugggggagcuaucucgagagc

SEQ ID NO: 60200 - RNA, 21 nt, Artificial Sequence
  derived and/or modified sequence opt11 from anti-influenza_CDR
agcgcgagcacgcgcgcgacc

SEQ ID NO: 60201 - RNA, 21 nt, Artificial Sequence
  derived and/or modified sequence opt11 from anti-influenza_CDR
ggcgcgagcacgcgcgcgagc

SEQ ID NO: 60202 - RNA, 21 nt, Artificial Sequence
  derived and/or modified sequence opt11 from anti-influenza_CDR
ggcgcgagcacgcgcgauaca

SEQ ID NO: 60203 - RNA, 21 nt, Artificial Sequence
  derived and/or modified sequence opt11 from anti-influenza_CDR
aaagugagcacgcucgagagc

SEQ ID NO: 60204 - RNA, 21 nt, Artificial Sequence
  derived and/or modified sequence opt11 from anti-influenza_CDR
agcaauaccgaacgcccgagc

SEQ ID NO: 60205 - RNA, 21 nt, Artificial Sequence
  derived and/or modified sequence opt11 from anti-influenza_CDR
aaaauaagcaaccgcgacagc

SEQ ID NO: 60206 - RNA, 21 nt, Artificial Sequence
  derived and/or modified sequence opt11 from anti-influenza_CDR
agcgcgagccaucgcuauagc

SEQ ID NO: 60207 - RNA, 21 nt, Artificial Sequence
  derived and/or modified sequence opt11 from anti-influenza_CDR
cagagcgugcgcucgaacaau

SEQ ID NO: 60208 - RNA, 21 nt, Artificial Sequence
  derived and/or modified sequence opt11 from anti-influenza_CDR
caaagcguccgcucaggcuac

SEQ ID NO: 60209 - RNA, 21 nt, Artificial Sequence
  derived and/or modified sequence opt11 from anti-influenza_CDR
auauacuaucgcgggagcacg

SEQ ID NO: 60210 - RNA, 21 nt, Artificial Sequence
  derived and/or modified sequence opt11 from anti-influenza_CDR
gucuacuacuccggcaucaca

SEQ ID NO: 60211 - RNA, 21 nt, Artificial Sequence
  derived and/or modified sequence opt11 from anti-influenza_CDR
ucccacuucgccaaccucaaa

SEQ ID NO: 60212 - RNA, 21 nt, Artificial Sequence
  derived and/or modified sequence opt11 from anti-influenza_CDR
cucaacaaauccaaacccuac

SEQ ID NO: 60213 - RNA, 21 nt, Artificial Sequence
  derived and/or modified sequence opt11 from anti-influenza_CDR
aagcuagcgaacacgggcacg

SEQ ID NO: 60214 - RNA, 21 nt, Artificial Sequence
  derived and/or modified sequence opt11 from anti-influenza_CDR
gccgccuccacccucacauca

SEQ ID NO: 60215 - RNA, 21 nt, Artificial Sequence
  derived and/or modified sequence opt11 from anti-influenza_CDR
gacgcgagcaagcucgcgagc

SEQ ID NO: 60216 - RNA, 21 nt, Artificial Sequence
  derived and/or modified sequence opt11 from anti-influenza_CDR
uucgcgagcaggcucgcgagc

SEQ ID NO: 60217 - RNA, 21 nt, Artificial Sequence
  derived and/or modified sequence opt11 from anti-influenza_CDR
agcgcgagcacgcucgcgagc

SEQ ID NO: 60218 - RNA, 21 nt, Artificial Sequence
  derived and/or modified sequence opt11 from anti-influenza_CDR
gaaguaagccagcgcccgagc

SEQ ID NO: 60219 - RNA, 21 nt, Artificial Sequence
  derived and/or modified sequence opt11 from anti-influenza_CDR
ggcgggacacugaacaauuac

SEQ ID NO: 60220 - RNA, 21 nt, Artificial Sequence
  derived and/or modified sequence opt11 from anti-influenza_CDR
gauaucgugaugacgcaaucg

SEQ ID NO: 60221 - RNA, 24 nt, Artificial Sequence
  derived and/or modified sequence opt11 from anti-influenza_CDR
ggcuucaccuucuccaacuacgcc

SEQ ID NO: 60222 - RNA, 24 nt, Artificial Sequence
  derived and/or modified sequence opt11 from anti-influenza_CDR
ggguucacguucucgaacuacggc

SEQ ID NO: 60223 - RNA, 24 nt, Artificial Sequence
  derived and/or modified sequence opt11 from anti-influenza_CDR
ggcuucaccuucuccuccuacgcc

SEQ ID NO: 60224 - RNA, 24 nt, Artificial Sequence
  derived and/or modified sequence opt11 from anti-influenza_CDR
ggcuucaccuucuccaccuacgcc

SEQ ID NO: 60225 - RNA, 24 nt, Artificial Sequence
  derived and/or modified sequence opt11 from anti-influenza_CDR
gggggcauauucauaagccaggcc

SEQ ID NO: 60226 - RNA, 24 nt, Artificial Sequence
  derived and/or modified sequence opt11 from anti-influenza_CDR
ggcgggaucuuuagcccguacgcg

SEQ ID NO: 60227 - RNA, 24 nt, Artificial Sequence
  derived and/or modified sequence opt11 from anti-influenza_CDR
ggcgggccauuuagcggguucgcg

SEQ ID NO: 60228 - RNA, 24 nt, Artificial Sequence
  derived and/or modified sequence opt11 from anti-influenza_CDR
ggcgggaccuuuaacucgcacgcg

SEQ ID NO: 60229 - RNA, 24 nt, Artificial Sequence
  derived and/or modified sequence opt11 from anti-influenza_CDR
ggcucgaacauaggcucgaacacg

SEQ ID NO: 60230 - RNA, 24 nt, Artificial Sequence
  derived and/or modified sequence opt11 from anti-influenza_CDR
ggcgugaccuuuagcauguacgcg

SEQ ID NO: 60231 - RNA, 24 nt, Artificial Sequence
  derived and/or modified sequence opt11 from anti-influenza_CDR
ggcgugaccuuuagcauguacacg

SEQ ID NO: 60232 - RNA, 24 nt, Artificial Sequence
  derived and/or modified sequence opt11 from anti-influenza_CDR
ggcgucaccucauccaacuaccca

SEQ ID NO: 60233 - RNA, 24 nt, Artificial Sequence
  derived and/or modified sequence opt11 from anti-influenza_CDR
aucaucgccaucuucggcaccacc

SEQ ID NO: 60234 - RNA, 24 nt, Artificial Sequence
  derived and/or modified sequence opt11 from anti-influenza_CDR
aucaucccccuauucggcaccgcc

SEQ ID NO: 60235 - RNA, 24 nt, Artificial Sequence
  derived and/or modified sequence opt11 from anti-influenza_CDR
aucaucccccucuucggcaccacc

SEQ ID NO: 60236 - RNA, 24 nt, Artificial Sequence
  derived and/or modified sequence opt11 from anti-influenza_CDR
aucauaccaauguucggcgccacc

SEQ ID NO: 60237 - RNA, 24 nt, Artificial Sequence
  derived and/or modified sequence opt11 from anti-influenza_CDR
aucauccccauguucggcaccacc

SEQ ID NO: 60238 - RNA, 24 nt, Artificial Sequence
  derived and/or modified sequence opt11 from anti-influenza_CDR
auaaacucgggcgggggcgcgaca

SEQ ID NO: 60239 - RNA, 24 nt, Artificial Sequence
  derived and/or modified sequence opt11 from anti-influenza_CDR
auaucggccguguucgggaccgcg

SEQ ID NO: 60240 - RNA, 24 nt, Artificial Sequence
  derived and/or modified sequence opt11 from anti-influenza_CDR
aucuccuacgacgccaacuacaaa

SEQ ID NO: 60241 - RNA, 24 nt, Artificial Sequence
  derived and/or modified sequence opt11 from anti-influenza_CDR
aucuccuacgacggcaacuacaaa

SEQ ID NO: 60242 - RNA, 24 nt, Artificial Sequence
  derived and/or modified sequence opt11 from anti-influenza_CDR
aucagcuacgacggcagcaacaaa

SEQ ID NO: 60243 - RNA, 24 nt, Artificial Sequence
  derived and/or modified sequence opt11 from anti-influenza_CDR
aucucauacgacggcucaaaccag

SEQ ID NO: 60244 - RNA, 24 nt, Artificial Sequence
  derived and/or modified sequence opt11 from anti-influenza_CDR
caacaauacuaccgcucccccucc

SEQ ID NO: 60245 - RNA, 24 nt, Artificial Sequence
  derived and/or modified sequence opt11 from anti-influenza_CDR
guccucccacucuucggcgucacc

SEQ ID NO: 60246 - RNA, 24 nt, Artificial Sequence
  derived and/or modified sequence opt11 from anti-influenza_CDR
ggcgggacauuuagcucggacgcg

SEQ ID NO: 60247 - RNA, 24 nt, Artificial Sequence
  derived and/or modified sequence opt11 from anti-influenza_CDR
aucauccccgucuuccaaaccgcc

SEQ ID NO: 60248 - RNA, 24 nt, Artificial Sequence
  derived and/or modified sequence opt11 from anti-influenza_CDR
acaucaaacaucggcucaaacgcc

SEQ ID NO: 60249 - RNA, 24 nt, Artificial Sequence
  derived and/or modified sequence opt11 from anti-influenza_CDR
ggguacagcuucacgucgaggugg

SEQ ID NO: 60250 - RNA, 24 nt, Artificial Sequence
  derived and/or modified sequence opt11 from anti-influenza_CDR
auauaccccuccgacuccgacguc

SEQ ID NO: 60251 - RNA, 24 nt, Artificial Sequence
  derived and/or modified sequence opt11 from anti-influenza_CDR
caacaauacgacaacuggcucucc

SEQ ID NO: 60252 - RNA, 24 nt, Artificial Sequence
  derived and/or modified sequence opt11 from anti-influenza_CDR
ggggggacguuuaguaauuauggg

SEQ ID NO: 60253 - RNA, 24 nt, Artificial Sequence
  derived and/or modified sequence opt11 from anti-influenza_CDR
ggcgccuccaucuccuccuccuac

SEQ ID NO: 60254 - RNA, 24 nt, Artificial Sequence
  derived and/or modified sequence opt11 from anti-influenza_CDR
ggcgggaccuuuagcucguacgau

SEQ ID NO: 60255 - RNA, 24 nt, Artificial Sequence
  derived and/or modified sequence opt11 from anti-influenza_CDR
aucauacccauauacggcaccgcc

SEQ ID NO: 60256 - RNA, 24 nt, Artificial Sequence
  derived and/or modified sequence opt11 from anti-influenza_CDR
ggcuacaccuccaccaccuacggc

SEQ ID NO: 60257 - RNA, 24 nt, Artificial Sequence
  derived and/or modified sequence opt11 from anti-influenza_CDR
aucaacccauacaacggcaacccc

SEQ ID NO: 60258 - RNA, 24 nt, Artificial Sequence
  derived and/or modified sequence opt11 from anti-influenza_CDR
aucugguacgacggcgauaacaag

SEQ ID NO: 60259 - RNA, 24 nt, Artificial Sequence
  derived and/or modified sequence opt11 from anti-influenza_CDR
ggcuucaccuucuccgacuucugg

SEQ ID NO: 60260 - RNA, 24 nt, Artificial Sequence
  derived and/or modified sequence opt11 from anti-influenza_CDR
auagaccaggacgggaacgagaga

SEQ ID NO: 60261 - RNA, 24 nt, Artificial Sequence
  derived and/or modified sequence opt11 from anti-influenza_CDR
agcucgaacauaggcaagaacuac

SEQ ID NO: 60262 - RNA, 24 nt, Artificial Sequence
  derived and/or modified sequence opt11 from anti-influenza_CDR
ggcuacaccuucaccaacuacugg

SEQ ID NO: 60263 - RNA, 24 nt, Artificial Sequence
  derived and/or modified sequence opt11 from anti-influenza_CDR
aucuucccccccgacucccaaacc

SEQ ID NO: 60264 - RNA, 24 nt, Artificial Sequence
  derived and/or modified sequence opt11 from anti-influenza_CDR
ggcuacucauucuccgacuacugg

SEQ ID NO: 60265 - RNA, 24 nt, Artificial Sequence
  derived and/or modified sequence opt11 from anti-influenza_CDR
aucuaccccgccuccuccgaaauc

SEQ ID NO: 60266 - RNA, 24 nt, Artificial Sequence
  derived and/or modified sequence opt11 from anti-influenza_CDR
aguggggacagugggacguggaau

SEQ ID NO: 60267 - RNA, 24 nt, Artificial Sequence
  derived and/or modified sequence opt11 from anti-influenza_CDR
ggcggcacccuaaacaacuacgca

SEQ ID NO: 60268 - RNA, 24 nt, Artificial Sequence
  derived and/or modified sequence opt11 from anti-influenza_CDR
aucucccccaucuucggcacccuc

SEQ ID NO: 60269 - RNA, 24 nt, Artificial Sequence
  derived and/or modified sequence opt11 from anti-influenza_CDR
ggcguguucuuuagcucgcacgcg

SEQ ID NO: 60270 - RNA, 24 nt, Artificial Sequence
  derived and/or modified sequence opt11 from anti-influenza_CDR
aucucccccauguucggcaccacc

SEQ ID NO: 60271 - RNA, 24 nt, Artificial Sequence
  derived and/or modified sequence opt11 from anti-influenza_CDR
ggcuucaccuucucccgcuucggc

SEQ ID NO: 60272 - RNA, 24 nt, Artificial Sequence
  derived and/or modified sequence opt11 from anti-influenza_CDR
aucugguacgacggcucgaacaag

SEQ ID NO: 60273 - RNA, 24 nt, Artificial Sequence
  derived and/or modified sequence opt11 from anti-influenza_CDR
caaacguacgggggcgugagcacg

SEQ ID NO: 60274 - RNA, 24 nt, Artificial Sequence
  derived and/or modified sequence opt11 from anti-influenza_CDR
gacucggccgggaauaggcauucg

SEQ ID NO: 60275 - RNA, 24 nt, Artificial Sequence
  derived and/or modified sequence opt11 from anti-influenza_CDR
uuucgcgggggcaauagcuugagc

SEQ ID NO: 60276 - RNA, 24 nt, Artificial Sequence
  derived and/or modified sequence opt11 from anti-influenza_CDR
ggcuacaccuucaccaccuacugg

SEQ ID NO: 60277 - RNA, 24 nt, Artificial Sequence
  derived and/or modified sequence opt11 from anti-influenza_CDR
auagaccccuacgacuccgaaacc

SEQ ID NO: 60278 - RNA, 24 nt, Artificial Sequence
  derived and/or modified sequence opt11 from anti-influenza_CDR
auccgcaaauuccugaacugguac

SEQ ID NO: 60279 - RNA, 24 nt, Artificial Sequence
  derived and/or modified sequence opt11 from anti-influenza_CDR
caacaauacgacggccuccccuuc

SEQ ID NO: 60280 - RNA, 24 nt, Artificial Sequence
  derived and/or modified sequence opt11 from anti-influenza_CDR
auacgcaacagccugaacugguac

SEQ ID NO: 60281 - RNA, 24 nt, Artificial Sequence
  derived and/or modified sequence opt11 from anti-influenza_CDR
caacaagccaacuccuucccccuc

SEQ ID NO: 60282 - RNA, 24 nt, Artificial Sequence
  derived and/or modified sequence opt11 from anti-influenza_CDR
ucacuccugaccgaagucgaaacc

SEQ ID NO: 60283 - RNA, 24 nt, Artificial Sequence
  derived and/or modified sequence opt11 from anti-influenza_CDR
caacaauccuacuccaugcccgcc

SEQ ID NO: 60284 - RNA, 24 nt, Artificial Sequence
  derived and/or modified sequence opt11 from anti-influenza_CDR
ggggggccggugaguggggggggg

SEQ ID NO: 60285 - RNA, 24 nt, Artificial Sequence
  derived and/or modified sequence opt11 from anti-influenza_CDR
caacaauccuucuccguccccgcc

SEQ ID NO: 60286 - RNA, 24 nt, Artificial Sequence
  derived and/or modified sequence opt11 from anti-influenza_CDR
caacaaaccuacuccaucccccuc

SEQ ID NO: 60287 - RNA, 24 nt, Artificial Sequence
  derived and/or modified sequence opt11 from anti-influenza_CDR
caacaauccuacuccguccccgcc

SEQ ID NO: 60288 - RNA, 24 nt, Artificial Sequence
  derived and/or modified sequence opt11 from anti-influenza_CDR
caacaaaccuucuccaucccccuc

SEQ ID NO: 60289 - RNA, 24 nt, Artificial Sequence
  derived and/or modified sequence opt11 from anti-influenza_CDR
ggcgauagcauaaccucgggcgcg

SEQ ID NO: 60290 - RNA, 24 nt, Artificial Sequence
  derived and/or modified sequence opt11 from anti-influenza_CDR
caagcgugggauagcucgaccgcg

SEQ ID NO: 60291 - RNA, 24 nt, Artificial Sequence
  derived and/or modified sequence opt11 from anti-influenza_CDR
caacaguacgggagcucgcucugg

SEQ ID NO: 60292 - RNA, 24 nt, Artificial Sequence
  derived and/or modified sequence opt11 from anti-influenza_CDR
gcauacggcuacacauucgacccc

SEQ ID NO: 60293 - RNA, 24 nt, Artificial Sequence
  derived and/or modified sequence opt11 from anti-influenza_CDR
augcaagcccuccaaaccccccuc

SEQ ID NO: 60294 - RNA, 24 nt, Artificial Sequence
  derived and/or modified sequence opt11 from anti-influenza_CDR
caacaauacggcuccucccucacc

SEQ ID NO: 60295 - RNA, 24 nt, Artificial Sequence
  derived and/or modified sequence opt11 from anti-influenza_CDR
caaaaauacaacuccgcccccucc

SEQ ID NO: 60296 - RNA, 24 nt, Artificial Sequence
  derived and/or modified sequence opt11 from anti-influenza_CDR
caacagcgcucgaacuggcucaaa

SEQ ID NO: 60297 - RNA, 24 nt, Artificial Sequence
  derived and/or modified sequence opt11 from anti-influenza_CDR
agcucgcaaucgcgcucgagcacg

SEQ ID NO: 60298 - RNA, 24 nt, Artificial Sequence
  derived and/or modified sequence opt11 from anti-influenza_CDR
cccuacgacguccccgacuacgaa

SEQ ID NO: 60299 - RNA, 24 nt, Artificial Sequence
  derived and/or modified sequence opt11 from anti-influenza_CDR
cccuacgacguccccgacuacgcc

SEQ ID NO: 60300 - RNA, 24 nt, Artificial Sequence
  derived and/or modified sequence opt11 from anti-influenza_CDR
cccggcgacuucaacgacuacgaa

SEQ ID NO: 60301 - RNA, 24 nt, Artificial Sequence
  derived and/or modified sequence opt11 from anti-influenza_CDR
ccgaaaguacgcgaucaagagagc

SEQ ID NO: 60302 - RNA, 24 nt, Artificial Sequence
  derived and/or modified sequence opt11 from anti-influenza_CDR
accuccuacaccuccuccaacacc

SEQ ID NO: 60303 - RNA, 24 nt, Artificial Sequence
  derived and/or modified sequence opt11 from anti-influenza_CDR
ggcgggaacuuuaacaauuacgcg

SEQ ID NO: 60304 - RNA, 24 nt, Artificial Sequence
  derived and/or modified sequence opt11 from anti-influenza_CDR
aucucccccaucuucggcuccacc

SEQ ID NO: 60305 - RNA, 24 nt, Artificial Sequence
  derived and/or modified sequence opt11 from anti-influenza_CDR
uccuccuacaccuccuccaacacc

SEQ ID NO: 60306 - RNA, 24 nt, Artificial Sequence
  derived and/or modified sequence opt11 from anti-influenza_CDR
ggcgggaccuuuaacaauuacgcg

SEQ ID NO: 60307 - RNA, 24 nt, Artificial Sequence
  derived and/or modified sequence opt11 from anti-influenza_CDR
aucucccccaucuucggcuccguc

SEQ ID NO: 60308 - RNA, 24 nt, Artificial Sequence
  derived and/or modified sequence opt11 from anti-influenza_CDR
uccuccaacaucggccacaacuuc

SEQ ID NO: 60309 - RNA, 24 nt, Artificial Sequence
  derived and/or modified sequence opt11 from anti-influenza_CDR
ggcacgugggauagcucgcucucg

SEQ ID NO: 60310 - RNA, 24 nt, Artificial Sequence
  derived and/or modified sequence opt11 from anti-influenza_CDR
ggcgggaucauacgcaaguacgcg

SEQ ID NO: 60311 - RNA, 24 nt, Artificial Sequence
  derived and/or modified sequence opt11 from anti-influenza_CDR
auaaucgccaucuucaacaccgcc

SEQ ID NO: 60312 - RNA, 24 nt, Artificial Sequence
  derived and/or modified sequence opt11 from anti-influenza_CDR
ggcuacaccuucaccgccuacaca

SEQ ID NO: 60313 - RNA, 24 nt, Artificial Sequence
  derived and/or modified sequence opt11 from anti-influenza_CDR
auaaacgcaggcaacggccacacc

SEQ ID NO: 60314 - RNA, 24 nt, Artificial Sequence
  derived and/or modified sequence opt11 from anti-influenza_CDR
ggcggcaccuucaucaacuacgca

SEQ ID NO: 60315 - RNA, 24 nt, Artificial Sequence
  derived and/or modified sequence opt11 from anti-influenza_CDR
aucauccccgucuacggcaccucc

SEQ ID NO: 60316 - RNA, 24 nt, Artificial Sequence
  derived and/or modified sequence opt11 from anti-influenza_CDR
ggcuucaccuuccgcucacacgca

SEQ ID NO: 60317 - RNA, 24 nt, Artificial Sequence
  derived and/or modified sequence opt11 from anti-influenza_CDR
aucucguacgacgaagugaacaag

SEQ ID NO: 60318 - RNA, 24 nt, Artificial Sequence
  derived and/or modified sequence opt11 from anti-influenza_CDR
ggcuacaacuucgccgccuacuau

SEQ ID NO: 60319 - RNA, 24 nt, Artificial Sequence
  derived and/or modified sequence opt11 from anti-influenza_CDR
ucaaauccaaacaccggcggcgcc

SEQ ID NO: 60320 - RNA, 24 nt, Artificial Sequence
  derived and/or modified sequence opt11 from anti-influenza_CDR
ggcuacacccucaucgacuacuau

SEQ ID NO: 60321 - RNA, 24 nt, Artificial Sequence
  derived and/or modified sequence opt11 from anti-influenza_CDR
aucaacccaaucaacggcggcacc

SEQ ID NO: 60322 - RNA, 24 nt, Artificial Sequence
  derived and/or modified sequence opt11 from anti-influenza_CDR
ggcuucaccuucuccgccuacgca

SEQ ID NO: 60323 - RNA, 24 nt, Artificial Sequence
  derived and/or modified sequence opt11 from anti-influenza_CDR
acgagcuaugacgggcgcgauagc

SEQ ID NO: 60324 - RNA, 24 nt, Artificial Sequence
  derived and/or modified sequence opt11 from anti-influenza_CDR
ggcuucaccuucaccaacuacgcc

SEQ ID NO: 60325 - RNA, 24 nt, Artificial Sequence
  derived and/or modified sequence opt11 from anti-influenza_CDR
aucagcuucgacgaagacaacaaa

SEQ ID NO: 60326 - RNA, 24 nt, Artificial Sequence
  derived and/or modified sequence opt11 from anti-influenza_CDR
ggcuuuaacuuuagcucguacggg

SEQ ID NO: 60327 - RNA, 24 nt, Artificial Sequence
  derived and/or modified sequence opt11 from anti-influenza_CDR
auauggagcgggggaucgaacaag

SEQ ID NO: 60328 - RNA, 24 nt, Artificial Sequence
  derived and/or modified sequence opt11 from anti-influenza_CDR
ggcuuuaucuuuggcgacuucgcg

SEQ ID NO: 60329 - RNA, 24 nt, Artificial Sequence
  derived and/or modified sequence opt11 from anti-influenza_CDR
ggcuuuaacuuugacgaguacgug

SEQ ID NO: 60330 - RNA, 24 nt, Artificial Sequence
  derived and/or modified sequence opt11 from anti-influenza_CDR
auaggggcggaugggagggggacg

SEQ ID NO: 60331 - RNA, 24 nt, Artificial Sequence
  derived and/or modified sequence opt11 from anti-influenza_CDR
ggcgggagcgugagcaauuacuau

SEQ ID NO: 60332 - RNA, 24 nt, Artificial Sequence
  derived and/or modified sequence opt11 from anti-influenza_CDR
ggcgggaccuuuagcuauuacgcg

SEQ ID NO: 60333 - RNA, 24 nt, Artificial Sequence
  derived and/or modified sequence opt11 from anti-influenza_CDR
auaaucccaaucgucggcaccgcc

SEQ ID NO: 60334 - RNA, 24 nt, Artificial Sequence
  derived and/or modified sequence opt11 from anti-influenza_CDR
accuccaacaucggcuccaacacc

SEQ ID NO: 60335 - RNA, 24 nt, Artificial Sequence
  derived and/or modified sequence opt11 from anti-influenza_CDR
ggcuacaacuuccccaaauacugg

SEQ ID NO: 60336 - RNA, 24 nt, Artificial Sequence
  derived and/or modified sequence opt11 from anti-influenza_CDR
auauaccccggcgacuccgacguc

SEQ ID NO: 60337 - RNA, 24 nt, Artificial Sequence
  derived and/or modified sequence opt11 from anti-influenza_CDR
ggccacaccuucaucuccuacgcc

SEQ ID NO: 60338 - RNA, 24 nt, Artificial Sequence
  derived and/or modified sequence opt11 from anti-influenza_CDR
aucguccccauauucggcaccguc

SEQ ID NO: 60339 - RNA, 24 nt, Artificial Sequence
  derived and/or modified sequence opt11 from anti-influenza_CDR
ggcuucaccuuccgcacauacgga

SEQ ID NO: 60340 - RNA, 24 nt, Artificial Sequence
  derived and/or modified sequence opt11 from anti-influenza_CDR
aucucguacgacggcacgaacaag

SEQ ID NO: 60341 - RNA, 24 nt, Artificial Sequence
  derived and/or modified sequence opt11 from anti-influenza_CDR
ggcuucaccuucuccuccuacggc

SEQ ID NO: 60342 - RNA, 24 nt, Artificial Sequence
  derived and/or modified sequence opt11 from anti-influenza_CDR
aucagcuacgacgaaaucaacaaa

SEQ ID NO: 60343 - RNA, 24 nt, Artificial Sequence
  derived and/or modified sequence opt11 from anti-influenza_CDR
ggguucucgcucuggacaucggga

SEQ ID NO: 60344 - RNA, 24 nt, Artificial Sequence
  derived and/or modified sequence opt11 from anti-influenza_CDR
augagcuacgacgagaccaaaaaa

SEQ ID NO: 60345 - RNA, 24 nt, Artificial Sequence
  derived and/or modified sequence opt11 from anti-influenza_CDR
ggcuucaccuucucccgcuacucc

SEQ ID NO: 60346 - RNA, 24 nt, Artificial Sequence
  derived and/or modified sequence opt11 from anti-influenza_CDR
auauccgacaccucccgcacaauc

SEQ ID NO: 60347 - RNA, 24 nt, Artificial Sequence
  derived and/or modified sequence opt11 from anti-influenza_CDR
ggcuucaccuucaacuccuacgcc

SEQ ID NO: 60348 - RNA, 24 nt, Artificial Sequence
  derived and/or modified sequence opt11 from anti-influenza_CDR
auaagggggucgggggagaauacg

SEQ ID NO: 60349 - RNA, 24 nt, Artificial Sequence
  derived and/or modified sequence opt11 from anti-influenza_CDR
ggcuucaccuucucccgcuucucc

SEQ ID NO: 60350 - RNA, 24 nt, Artificial Sequence
  derived and/or modified sequence opt11 from anti-influenza_CDR
auauccgacaccggccgcacaauc

SEQ ID NO: 60351 - RNA, 24 nt, Artificial Sequence
  derived and/or modified sequence opt11 from anti-influenza_CDR
ggggacucguucacgagcuauugg

SEQ ID NO: 60352 - RNA, 24 nt, Artificial Sequence
  derived and/or modified sequence opt11 from anti-influenza_CDR
auauacccacgcgacuccgaaacc

SEQ ID NO: 60353 - RNA, 24 nt, Artificial Sequence
  derived and/or modified sequence opt11 from anti-influenza_CDR
ggcuacacauucaccgccuaccau

SEQ ID NO: 60354 - RNA, 24 nt, Artificial Sequence
  derived and/or modified sequence opt11 from anti-influenza_CDR
auaaacccaaacuccggcgccacc

SEQ ID NO: 60355 - RNA, 24 nt, Artificial Sequence
  derived and/or modified sequence opt11 from anti-influenza_CDR
ggcuucaccuucuccgacuacugg

SEQ ID NO: 60356 - RNA, 24 nt, Artificial Sequence
  derived and/or modified sequence opt11 from anti-influenza_CDR
aucuccuccgacggcuccaccacc

SEQ ID NO: 60357 - RNA, 24 nt, Artificial Sequence
  derived and/or modified sequence opt11 from anti-influenza_CDR
ggguucucguucucgaacgcgugg

SEQ ID NO: 60358 - RNA, 24 nt, Artificial Sequence
  derived and/or modified sequence opt11 from anti-influenza_CDR
gggcuaacguucucgaacgcgugg

SEQ ID NO: 60359 - RNA, 24 nt, Artificial Sequence
  derived and/or modified sequence opt11 from anti-influenza_CDR
ggguucacguucucgaacgcgugg

SEQ ID NO: 60360 - RNA, 24 nt, Artificial Sequence
  derived and/or modified sequence opt11 from anti-influenza_CDR
ggccuaucauuccucaacgccugg

SEQ ID NO: 60361 - RNA, 24 nt, Artificial Sequence
  derived and/or modified sequence opt11 from anti-influenza_CDR
ggguucucguucuugaacgcgugg

SEQ ID NO: 60362 - RNA, 24 nt, Artificial Sequence
  derived and/or modified sequence opt11 from anti-influenza_CDR
gggcuaacguucuugaacgcgugg

SEQ ID NO: 60363 - RNA, 24 nt, Artificial Sequence
  derived and/or modified sequence opt11 from anti-influenza_CDR
ggguucacguucuugaacgcgugg

SEQ ID NO: 60364 - RNA, 24 nt, Artificial Sequence
  derived and/or modified sequence opt11 from anti-influenza_CDR
ggcuacacauucaccgacuacuau

SEQ ID NO: 60365 - RNA, 24 nt, Artificial Sequence
  derived and/or modified sequence opt11 from anti-influenza_CDR
gugaacccguacucgggcgggacc

SEQ ID NO: 60366 - RNA, 24 nt, Artificial Sequence
  derived and/or modified sequence opt11 from anti-influenza_CDR
ggcuacaccuucaccgacuacaac

SEQ ID NO: 60367 - RNA, 24 nt, Artificial Sequence
  derived and/or modified sequence opt11 from anti-influenza_CDR
auauacccaaacaacggcggcacc

SEQ ID NO: 60368 - RNA, 24 nt, Artificial Sequence
  derived and/or modified sequence opt11 from anti-influenza_CDR
ggcuacacauucaccggcuacaac

SEQ ID NO: 60369 - RNA, 24 nt, Artificial Sequence
  derived and/or modified sequence opt11 from anti-influenza_CDR
auauacccaaacaacggcgucacc

SEQ ID NO: 60370 - RNA, 24 nt, Artificial Sequence
  derived and/or modified sequence opt11 from anti-influenza_CDR
auggaaacggacacgcuccugcuc

SEQ ID NO: 60371 - RNA, 27 nt, Artificial Sequence
  derived and/or modified sequence opt11 from anti-influenza_CDR
gauggcgugaccaauaaagugaacucg

SEQ ID NO: 60372 - RNA, 27 nt, Artificial Sequence
  derived and/or modified sequence opt11 from anti-influenza_CDR
ggcucggacgugggcucgagcaaucua

SEQ ID NO: 60373 - RNA, 27 nt, Artificial Sequence
  derived and/or modified sequence opt11 from anti-influenza_CDR
augcaaaacauccuccucccccucacc

SEQ ID NO: 60374 - RNA, 27 nt, Artificial Sequence
  derived and/or modified sequence opt11 from anti-influenza_CDR
augcaaucccuccaacucccccucacc

SEQ ID NO: 60375 - RNA, 27 nt, Artificial Sequence
  derived and/or modified sequence opt11 from anti-influenza_CDR
caacaacacuaccgcaccccccccacc

SEQ ID NO: 60376 - RNA, 27 nt, Artificial Sequence
  derived and/or modified sequence opt11 from anti-influenza_CDR
caacaauacggcaacucccccuacacc

SEQ ID NO: 60377 - RNA, 27 nt, Artificial Sequence
  derived and/or modified sequence opt11 from anti-influenza_CDR
caacaauacggcuccucccccuacacc

SEQ ID NO: 60378 - RNA, 27 nt, Artificial Sequence
  derived and/or modified sequence opt11 from anti-influenza_CDR
caacaauacggcaccucaccccaaacc

SEQ ID NO: 60379 - RNA, 27 nt, Artificial Sequence
  derived and/or modified sequence opt11 from anti-influenza_CDR
caacaauacggcuaccuaccccucacc

SEQ ID NO: 60380 - RNA, 27 nt, Artificial Sequence
  derived and/or modified sequence opt11 from anti-influenza_CDR
caagcgugggauagcucgaccgcgguc

SEQ ID NO: 60381 - RNA, 27 nt, Artificial Sequence
  derived and/or modified sequence opt11 from anti-influenza_CDR
cagcacuauaacgcguacuggggcaca

SEQ ID NO: 60382 - RNA, 27 nt, Artificial Sequence
  derived and/or modified sequence opt11 from anti-influenza_CDR
caacaaaccuacuccuccccccccacc

SEQ ID NO: 60383 - RNA, 27 nt, Artificial Sequence
  derived and/or modified sequence opt11 from anti-influenza_CDR
caacaauacuacuccuuccccuacacc

SEQ ID NO: 60384 - RNA, 27 nt, Artificial Sequence
  derived and/or modified sequence opt11 from anti-influenza_CDR
augcaagcacuccagcucccgcucgcg

SEQ ID NO: 60385 - RNA, 27 nt, Artificial Sequence
  derived and/or modified sequence opt11 from anti-influenza_CDR
caacaagccaacuccuuccccuucacc

SEQ ID NO: 60386 - RNA, 27 nt, Artificial Sequence
  derived and/or modified sequence opt11 from anti-influenza_CDR
caacaacucaacggcuacccccucacc

SEQ ID NO: 60387 - RNA, 27 nt, Artificial Sequence
  derived and/or modified sequence opt11 from anti-influenza_CDR
augcaagcccuccaaaccccacucacc

SEQ ID NO: 60388 - RNA, 27 nt, Artificial Sequence
  derived and/or modified sequence opt11 from anti-influenza_CDR
caacaaaacuacaacuggccccucacc

SEQ ID NO: 60389 - RNA, 27 nt, Artificial Sequence
  derived and/or modified sequence opt11 from anti-influenza_CDR
caacaauacgacaccucauccggccuc

SEQ ID NO: 60390 - RNA, 27 nt, Artificial Sequence
  derived and/or modified sequence opt11 from anti-influenza_CDR
caacaauacaacuccuggccccgcacc

SEQ ID NO: 60391 - RNA, 27 nt, Artificial Sequence
  derived and/or modified sequence opt11 from anti-influenza_CDR
gucauauacucgcacgggcgcgcguac

SEQ ID NO: 60392 - RNA, 27 nt, Artificial Sequence
  derived and/or modified sequence opt11 from anti-influenza_CDR
caacaauacggcgacucccgcuacacc

SEQ ID NO: 60393 - RNA, 27 nt, Artificial Sequence
  derived and/or modified sequence opt11 from anti-influenza_CDR
cuccaacacaacuccuaccccuacacc

SEQ ID NO: 60394 - RNA, 27 nt, Artificial Sequence
  derived and/or modified sequence opt11 from anti-influenza_CDR
cgcaaaaugacgaccgcauucgacagc

SEQ ID NO: 60395 - RNA, 27 nt, Artificial Sequence
  derived and/or modified sequence opt11 from anti-influenza_CDR
cagcgcaaucacucgcccucauggaca

SEQ ID NO: 60396 - RNA, 27 nt, Artificial Sequence
  derived and/or modified sequence opt11 from anti-influenza_CDR
caacaauccuacgacaacccccaaacc

SEQ ID NO: 60397 - RNA, 27 nt, Artificial Sequence
  derived and/or modified sequence opt11 from anti-influenza_CDR
caacaaucccgccgccuccccuacacc

SEQ ID NO: 60398 - RNA, 27 nt, Artificial Sequence
  derived and/or modified sequence opt11 from anti-influenza_CDR
cgcaagaugacgaccgcgaucgauuac

SEQ ID NO: 60399 - RNA, 27 nt, Artificial Sequence
  derived and/or modified sequence opt11 from anti-influenza_CDR
auccgcuacaccggccaacaacuccuc

SEQ ID NO: 60400 - RNA, 27 nt, Artificial Sequence
  derived and/or modified sequence opt11 from anti-influenza_CDR
caacacuacggcaccauaucccaaacc

SEQ ID NO: 60401 - RNA, 27 nt, Artificial Sequence
  derived and/or modified sequence opt11 from anti-influenza_CDR
caacaauacuccaccuccccccccacc

SEQ ID NO: 60402 - RNA, 27 nt, Artificial Sequence
  derived and/or modified sequence opt11 from anti-influenza_CDR
caacaauacggcaacucacccaucacc

SEQ ID NO: 60403 - RNA, 27 nt, Artificial Sequence
  derived and/or modified sequence opt11 from anti-influenza_CDR
caacaauacuacucccgccccuacacc

SEQ ID NO: 60404 - RNA, 27 nt, Artificial Sequence
  derived and/or modified sequence opt11 from anti-influenza_CDR
caggugugggauaauuuuggcgggguc

SEQ ID NO: 60405 - RNA, 27 nt, Artificial Sequence
  derived and/or modified sequence opt11 from anti-influenza_CDR
caacaauccuacuccuccccccucacc

SEQ ID NO: 60406 - RNA, 27 nt, Artificial Sequence
  derived and/or modified sequence opt11 from anti-influenza_CDR
caacaauacuucgccaccccccgcacc

SEQ ID NO: 60407 - RNA, 27 nt, Artificial Sequence
  derived and/or modified sequence opt11 from anti-influenza_CDR
caacaauacuacuucuccccccucacc

SEQ ID NO: 60408 - RNA, 27 nt, Artificial Sequence
  derived and/or modified sequence opt11 from anti-influenza_CDR
caacacuucggcaccuccgucuucacc

SEQ ID NO: 60409 - RNA, 27 nt, Artificial Sequence
  derived and/or modified sequence opt11 from anti-influenza_CDR
caacaauacuacaacgccccccucacc

SEQ ID NO: 60410 - RNA, 27 nt, Artificial Sequence
  derived and/or modified sequence opt11 from anti-influenza_CDR
guccucuucaccucccccuucgacuuc

SEQ ID NO: 60411 - RNA, 27 nt, Artificial Sequence
  derived and/or modified sequence opt11 from anti-influenza_CDR
uugcucucguacucgggcgugugggug

SEQ ID NO: 60412 - RNA, 27 nt, Artificial Sequence
  derived and/or modified sequence opt11 from anti-influenza_CDR
uuucucucguacucgggcgcgugggug

SEQ ID NO: 60413 - RNA, 27 nt, Artificial Sequence
  derived and/or modified sequence opt11 from anti-influenza_CDR
caacaauccuucuccaaauccuggacc

SEQ ID NO: 60414 - RNA, 27 nt, Artificial Sequence
  derived and/or modified sequence opt11 from anti-influenza_CDR
guccaauacguccaauuccccuggacc

SEQ ID NO: 60415 - RNA, 27 nt, Artificial Sequence
  derived and/or modified sequence opt11 from anti-influenza_CDR
caacaauccuacucccccccccucacc

SEQ ID NO: 60416 - RNA, 27 nt, Artificial Sequence
  derived and/or modified sequence opt11 from anti-influenza_CDR
uucaucuacuacggcggcaacaccaaa

SEQ ID NO: 60417 - RNA, 27 nt, Artificial Sequence
  derived and/or modified sequence opt11 from anti-influenza_CDR
gugaucuauagcgggggcucgaccuau

SEQ ID NO: 60418 - RNA, 27 nt, Artificial Sequence
  derived and/or modified sequence opt11 from anti-influenza_CDR
uucauguuccauuccggcuccccccgc

SEQ ID NO: 60419 - RNA, 27 nt, Artificial Sequence
  derived and/or modified sequence opt11 from anti-influenza_CDR
caacaaaccuacuccacccccaucacc

SEQ ID NO: 60420 - RNA, 27 nt, Artificial Sequence
  derived and/or modified sequence opt11 from anti-influenza_CDR
uucuucuacaacggcggcuccaccaaa

SEQ ID NO: 60421 - RNA, 27 nt, Artificial Sequence
  derived and/or modified sequence opt11 from anti-influenza_CDR
caacaauccuacaacaccccccucauc

SEQ ID NO: 60422 - RNA, 27 nt, Artificial Sequence
  derived and/or modified sequence opt11 from anti-influenza_CDR
cacauauacgauuacgggcgcacguuc

SEQ ID NO: 60423 - RNA, 27 nt, Artificial Sequence
  derived and/or modified sequence opt11 from anti-influenza_CDR
gucuucuacuccgaaacccgcaccuac

SEQ ID NO: 60424 - RNA, 27 nt, Artificial Sequence
  derived and/or modified sequence opt11 from anti-influenza_CDR
caagugugggggagcucgagcgaucac

SEQ ID NO: 60425 - RNA, 27 nt, Artificial Sequence
  derived and/or modified sequence opt11 from anti-influenza_CDR
uacguguacaaucgcgggagcacgaaa

SEQ ID NO: 60426 - RNA, 27 nt, Artificial Sequence
  derived and/or modified sequence opt11 from anti-influenza_CDR
uacauauacaaccgcgggagcacgaaa

SEQ ID NO: 60427 - RNA, 27 nt, Artificial Sequence
  derived and/or modified sequence opt11 from anti-influenza_CDR
caacaauccuacaacacccccaucacc

SEQ ID NO: 60428 - RNA, 27 nt, Artificial Sequence
  derived and/or modified sequence opt11 from anti-influenza_CDR
caacaauacuacuccuccccccccacc

SEQ ID NO: 60429 - RNA, 27 nt, Artificial Sequence
  derived and/or modified sequence opt11 from anti-influenza_CDR
uaccucuacuacuccggcuccaccaaa

SEQ ID NO: 60430 - RNA, 27 nt, Artificial Sequence
  derived and/or modified sequence opt11 from anti-influenza_CDR
caacaauccuacuccccccccaucacc

SEQ ID NO: 60431 - RNA, 27 nt, Artificial Sequence
  derived and/or modified sequence opt11 from anti-influenza_CDR
uacguguacaauagcgggaacacgaaa

SEQ ID NO: 60432 - RNA, 27 nt, Artificial Sequence
  derived and/or modified sequence opt11 from anti-influenza_CDR
caacaauccuacaacaccccccucacc

SEQ ID NO: 60433 - RNA, 27 nt, Artificial Sequence
  derived and/or modified sequence opt11 from anti-influenza_CDR
cacauauucgacuccggauccacauac

SEQ ID NO: 60434 - RNA, 27 nt, Artificial Sequence
  derived and/or modified sequence opt11 from anti-influenza_CDR
gucuucuacucagccgaccgcaccuca

SEQ ID NO: 60435 - RNA, 27 nt, Artificial Sequence
  derived and/or modified sequence opt11 from anti-influenza_CDR
caacaauacuacuccaccccccucacc

SEQ ID NO: 60436 - RNA, 27 nt, Artificial Sequence
  derived and/or modified sequence opt11 from anti-influenza_CDR
uacaucuacuacuccggcaacaccuac

SEQ ID NO: 60437 - RNA, 27 nt, Artificial Sequence
  derived and/or modified sequence opt11 from anti-influenza_CDR
caacaauccuacuccaccccccucacc

SEQ ID NO: 60438 - RNA, 27 nt, Artificial Sequence
  derived and/or modified sequence opt11 from anti-influenza_CDR
caacaauacggcuccuccucccucacc

SEQ ID NO: 60439 - RNA, 27 nt, Artificial Sequence
  derived and/or modified sequence opt11 from anti-influenza_CDR
uccuccuacaccuccuccuccaccuac

SEQ ID NO: 60440 - RNA, 27 nt, Artificial Sequence
  derived and/or modified sequence opt11 from anti-influenza_CDR
caacgcuacaacuccgccccccccauc

SEQ ID NO: 60441 - RNA, 27 nt, Artificial Sequence
  derived and/or modified sequence opt11 from anti-influenza_CDR
caacaauacggccgcacaccccuaacc

SEQ ID NO: 60442 - RNA, 27 nt, Artificial Sequence
  derived and/or modified sequence opt11 from anti-influenza_CDR
caacaauacggcuccucaccccgcacc

SEQ ID NO: 60443 - RNA, 27 nt, Artificial Sequence
  derived and/or modified sequence opt11 from anti-influenza_CDR
caacaauacggcuccuccccccucacc

SEQ ID NO: 60444 - RNA, 27 nt, Artificial Sequence
  derived and/or modified sequence opt11 from anti-influenza_CDR
caagugugggauagcucgagcgaucac

SEQ ID NO: 60445 - RNA, 27 nt, Artificial Sequence
  derived and/or modified sequence opt11 from anti-influenza_CDR
aaggaguuuagugagguggaggggagg

SEQ ID NO: 60446 - RNA, 27 nt, Artificial Sequence
  derived and/or modified sequence opt11 from anti-influenza_CDR
aaggaguucaauaaccuggagaagagg

SEQ ID NO: 60447 - RNA, 27 nt, Artificial Sequence
  derived and/or modified sequence opt11 from anti-influenza_CDR
caacaacacuaccgcaccccccccucc

SEQ ID NO: 60448 - RNA, 27 nt, Artificial Sequence
  derived and/or modified sequence opt11 from anti-influenza_CDR
augcaagccacccacuggccacucaca

SEQ ID NO: 60449 - RNA, 27 nt, Artificial Sequence
  derived and/or modified sequence opt11 from anti-influenza_CDR
caacaauacuacuccuaccccuacacc

SEQ ID NO: 60450 - RNA, 27 nt, Artificial Sequence
  derived and/or modified sequence opt11 from anti-influenza_CDR
agcucggacgugggcggguauaauuac

SEQ ID NO: 60451 - RNA, 27 nt, Artificial Sequence
  derived and/or modified sequence opt11 from anti-influenza_CDR
agcucggacgugggcgauuacaauuac

SEQ ID NO: 60452 - RNA, 27 nt, Artificial Sequence
  derived and/or modified sequence opt11 from anti-influenza_CDR
caacaauacaacaacuggccccucucc

SEQ ID NO: 60453 - RNA, 27 nt, Artificial Sequence
  derived and/or modified sequence opt11 from anti-influenza_CDR
caacaauccuacaacuacccccgcacc

SEQ ID NO: 60454 - RNA, 27 nt, Artificial Sequence
  derived and/or modified sequence opt11 from anti-influenza_CDR
augcaaggccuccagaccccauacaca

SEQ ID NO: 60455 - RNA, 27 nt, Artificial Sequence
  derived and/or modified sequence opt11 from anti-influenza_CDR
caacaacacuacuccaucccccucacc

SEQ ID NO: 60456 - RNA, 27 nt, Artificial Sequence
  derived and/or modified sequence opt11 from anti-influenza_CDR
cuccaacacaacuccuaccccuggacc

SEQ ID NO: 60457 - RNA, 27 nt, Artificial Sequence
  derived and/or modified sequence opt11 from anti-influenza_CDR
caacaauacaacaccuggccccucacc

SEQ ID NO: 60458 - RNA, 27 nt, Artificial Sequence
  derived and/or modified sequence opt11 from anti-influenza_CDR
caacaauacaacuccuuccccuaccgc

SEQ ID NO: 60459 - RNA, 27 nt, Artificial Sequence
  derived and/or modified sequence opt11 from anti-influenza_CDR
caacaauccuacuccgcccccuucacc

SEQ ID NO: 60460 - RNA, 27 nt, Artificial Sequence
  derived and/or modified sequence opt11 from anti-influenza_CDR
caagcgugggauagcucgaccgugguc

SEQ ID NO: 60461 - RNA, 27 nt, Artificial Sequence
  derived and/or modified sequence opt11 from anti-influenza_CDR
caagcgugggauagcacgaccgugguc

SEQ ID NO: 60462 - RNA, 27 nt, Artificial Sequence
  derived and/or modified sequence opt11 from anti-influenza_CDR
cuccaauacggcuccuccccccgcacc

SEQ ID NO: 60463 - RNA, 27 nt, Artificial Sequence
  derived and/or modified sequence opt11 from anti-influenza_CDR
agcucggacgugggcggguaugauuac

SEQ ID NO: 60464 - RNA, 27 nt, Artificial Sequence
  derived and/or modified sequence opt11 from anti-influenza_CDR
caacaauacaccuacuggccccucacc

SEQ ID NO: 60465 - RNA, 27 nt, Artificial Sequence
  derived and/or modified sequence opt11 from anti-influenza_CDR
caacaauacgacaaauggccccccggc

SEQ ID NO: 60466 - RNA, 27 nt, Artificial Sequence
  derived and/or modified sequence opt11 from anti-influenza_CDR
augcaaucccuccaaaccuccaucacc

SEQ ID NO: 60467 - RNA, 27 nt, Artificial Sequence
  derived and/or modified sequence opt11 from anti-influenza_CDR
agccagaucgagcucgcggucuugcuc

SEQ ID NO: 60468 - RNA, 27 nt, Artificial Sequence
  derived and/or modified sequence opt11 from anti-influenza_CDR
augcaagcacuccagaccccauacaca

SEQ ID NO: 60469 - RNA, 27 nt, Artificial Sequence
  derived and/or modified sequence opt11 from anti-influenza_CDR
caacaacgcucccacuggccccccauc

SEQ ID NO: 60470 - RNA, 27 nt, Artificial Sequence
  derived and/or modified sequence opt11 from anti-influenza_CDR
caacacuucuggggcaccccccucacc

SEQ ID NO: 60471 - RNA, 27 nt, Artificial Sequence
  derived and/or modified sequence opt11 from anti-influenza_CDR
caacaaaacuacgaagaccccuggacc

SEQ ID NO: 60472 - RNA, 27 nt, Artificial Sequence
  derived and/or modified sequence opt11 from anti-influenza_CDR
caacaagccaacuccuucccccccacc

SEQ ID NO: 60473 - RNA, 27 nt, Artificial Sequence
  derived and/or modified sequence opt11 from anti-influenza_CDR
caacaacgcgaccacuggcccccaauc

SEQ ID NO: 60474 - RNA, 27 nt, Artificial Sequence
  derived and/or modified sequence opt11 from anti-influenza_CDR
auggacucccgccucaaccucgucuuc

SEQ ID NO: 60475 - RNA, 27 nt, Artificial Sequence
  derived and/or modified sequence opt11 from anti-influenza_CDR
augaaauugcccgugcgcuugcucgug

SEQ ID NO: 60476 - RNA, 30 nt, Artificial Sequence
  derived and/or modified sequence opt11 from anti-influenza_CDR
ggggauagugugacgagggggggguuuuau

SEQ ID NO: 60477 - RNA, 30 nt, Artificial Sequence; identical to SEQ ID NO: 52835
  derived and/or modified sequence opt11 from anti-influenza_CDR

SEQ ID NO: 60478 - RNA, 30 nt, Artificial Sequence; identical to SEQ ID NO: 52836
  derived and/or modified sequence opt11 from anti-influenza_CDR

SEQ ID NO: 60479 - RNA, 30 nt, Artificial Sequence
  derived and/or modified sequence opt11 from anti-influenza_CDR
cgcgcccaaucccucuccuccuaccuccac

SEQ ID NO: 60480 - RNA, 30 nt, Artificial Sequence; identical to SEQ ID NO: 22270
  derived and/or modified sequence opt11 from anti-influenza_CDR

SEQ ID NO: 60481 - RNA, 30 nt, Artificial Sequence
  derived and/or modified sequence opt11 from anti-influenza_CDR
caacgcuacaacuccgccccccccaucacc

SEQ ID NO: 60482 - RNA, 30 nt, Artificial Sequence
  derived and/or modified sequence opt11 from anti-influenza_CDR
ggcggcuccauauccuccggcaccuacuac

SEQ ID NO: 60483 - RNA, 30 nt, Artificial Sequence
  derived and/or modified sequence opt11 from anti-influenza_CDR
caacagagcuauagcucgcucauguucacg

SEQ ID NO: 60484 - RNA, 30 nt, Artificial Sequence
  derived and/or modified sequence opt11 from anti-influenza_CDR
cucuugaucuauggcgcgagcacgcgcgcg

SEQ ID NO: 60485 - RNA, 30 nt, Artificial Sequence
  derived and/or modified sequence opt11 from anti-influenza_CDR
ugcgcguacgggggcaaguacuuggucgug

SEQ ID NO: 60486 - RNA, 30 nt, Artificial Sequence
  derived and/or modified sequence opt11 from anti-influenza_CDR
agacccgacuucuacggcgacuucgaauac

SEQ ID NO: 60487 - RNA, 30 nt, Artificial Sequence
  derived and/or modified sequence opt11 from anti-influenza_CDR
caacacuacggcuacuccccccgcuacgcc

SEQ ID NO: 60488 - RNA, 30 nt, Artificial Sequence
  derived and/or modified sequence opt11 from anti-influenza_CDR
caacagcgcucacacuggcccccaaucaca

SEQ ID NO: 60489 - RNA, 30 nt, Artificial Sequence
  derived and/or modified sequence opt11 from anti-influenza_CDR
agcucguacgcgggcucgagcacgugggug

SEQ ID NO: 60490 - RNA, 30 nt, Artificial Sequence
  derived and/or modified sequence opt11 from anti-influenza_CDR
cuacuauacuccggcggcgaccccgucgcc

SEQ ID NO: 60491 - RNA, 30 nt, Artificial Sequence
  derived and/or modified sequence opt11 from anti-influenza_CDR
caacaauacggcggcucaccccgcuacacc

SEQ ID NO: 60492 - RNA, 30 nt, Artificial Sequence
  derived and/or modified sequence opt11 from anti-influenza_CDR
agguacgggagcggguacggguucgauagc

SEQ ID NO: 60493 - RNA, 30 nt, Artificial Sequence
  derived and/or modified sequence opt11 from anti-influenza_CDR
uccucauacgccggcaacuacaaccacguc

SEQ ID NO: 60494 - RNA, 30 nt, Artificial Sequence
  derived and/or modified sequence opt11 from anti-influenza_CDR
caacaauacaucaacuggcgcccccucucc

SEQ ID NO: 60495 - RNA, 30 nt, Artificial Sequence
  derived and/or modified sequence opt11 from anti-influenza_CDR
auaggcgcgggauaugacgugcacugguac

SEQ ID NO: 60496 - RNA, 30 nt, Artificial Sequence; identical to SEQ ID NO: 22286
  derived and/or modified sequence opt11 from anti-influenza_CDR

SEQ ID NO: 60497 - RNA, 30 nt, Artificial Sequence
  derived and/or modified sequence opt11 from anti-influenza_CDR
caauccuacgacaacucccucuccggcucc

SEQ ID NO: 60498 - RNA, 30 nt, Artificial Sequence
  derived and/or modified sequence opt11 from anti-influenza_CDR
cuccucaucuacgacgccuccaaccuccaa

SEQ ID NO: 60499 - RNA, 30 nt, Artificial Sequence
  derived and/or modified sequence opt11 from anti-influenza_CDR
cuccucauccacgacgccuccaaccucgaa

SEQ ID NO: 60500 - RNA, 30 nt, Artificial Sequence
  derived and/or modified sequence opt11 from anti-influenza_CDR
gugcagagguugaguuaugggauggacgug

SEQ ID NO: 60501 - RNA, 30 nt, Artificial Sequence
  derived and/or modified sequence opt11 from anti-influenza_CDR
guccagaaaucguacuacggcauggacgug

SEQ ID NO: 60502 - RNA, 30 nt, Artificial Sequence; identical to SEQ ID NO: 22292
  derived and/or modified sequence opt11 from anti-influenza_CDR

SEQ ID NO: 60503 - RNA, 30 nt, Artificial Sequence; identical to SEQ ID NO: 22293
  derived and/or modified sequence opt11 from anti-influenza_CDR

SEQ ID NO: 60504 - RNA, 30 nt, Artificial Sequence
  derived and/or modified sequence opt11 from anti-influenza_CDR
accaaacgcucccaacaaaccgucaucccc

SEQ ID NO: 60505 - RNA, 30 nt, Artificial Sequence
  derived and/or modified sequence opt11 from anti-influenza_CDR
accucccgcucccaacaaaccgucaucccc

SEQ ID NO: 60506 - RNA, 30 nt, Artificial Sequence; identical to SEQ ID NO: 22296
  derived and/or modified sequence opt11 from anti-influenza_CDR

SEQ ID NO: 60507 - RNA, 30 nt, Artificial Sequence
  derived and/or modified sequence opt11 from anti-influenza_CDR
cgcccgaaagugcgcgaucaagagagcagg

SEQ ID NO: 60508 - RNA, 30 nt, Artificial Sequence
  derived and/or modified sequence opt11 from anti-influenza_CDR
aggccgugggugaggggggugaguaguagg

SEQ ID NO: 60509 - RNA, 30 nt, Artificial Sequence
  derived and/or modified sequence opt11 from anti-influenza_CDR
aggccgugggugagggggcugaguaguagg

SEQ ID NO: 60510 - RNA, 30 nt, Artificial Sequence
  derived and/or modified sequence opt11 from anti-influenza_CDR
aggccgaaagugagagggcaggcgggcagg

SEQ ID NO: 60511 - RNA, 30 nt, Artificial Sequence
  derived and/or modified sequence opt11 from anti-influenza_CDR
gccccagccgucgccgcacaagcauccgca

SEQ ID NO: 60512 - RNA, 30 nt, Artificial Sequence
  derived and/or modified sequence opt11 from anti-influenza_CDR
guacaccaccccggaaccgacaacgaccaa

SEQ ID NO: 60513 - RNA, 30 nt, Artificial Sequence
  derived and/or modified sequence opt11 from anti-influenza_CDR
uucgggcaggggacgaagguggagauaaag

SEQ ID NO: 60514 - RNA, 30 nt, Artificial Sequence
  derived and/or modified sequence opt11 from anti-influenza_CDR
ggcuucgcauuccacaaccgcgccaugcac

SEQ ID NO: 60515 - RNA, 30 nt, Artificial Sequence; identical to SEQ ID NO: 22305
  derived and/or modified sequence opt11 from anti-influenza_CDR

SEQ ID NO: 60516 - RNA, 30 nt, Artificial Sequence; identical to SEQ ID NO: 22306
  derived and/or modified sequence opt11 from anti-influenza_CDR

SEQ ID NO: 60517 - RNA, 30 nt, Artificial Sequence; identical to SEQ ID NO: 22307
  derived and/or modified sequence opt11 from anti-influenza_CDR

SEQ ID NO: 60518 - RNA, 30 nt, Artificial Sequence
  derived and/or modified sequence opt11 from anti-influenza_CDR
ggcuacucauucaacaacuacggcaucaac

SEQ ID NO: 60519 - RNA, 30 nt, Artificial Sequence; identical to SEQ ID NO: 14667
  derived and/or modified sequence opt11 from anti-influenza_CDR

SEQ ID NO: 60520 - RNA, 30 nt, Artificial Sequence; identical to SEQ ID NO: 22310
  derived and/or modified sequence opt11 from anti-influenza_CDR

SEQ ID NO: 60521 - RNA, 30 nt, Artificial Sequence
  derived and/or modified sequence opt11 from anti-influenza_CDR
aggggaaauuacgggaacggguucgcguac

SEQ ID NO: 60522 - RNA, 30 nt, Artificial Sequence
  derived and/or modified sequence opt11 from anti-influenza_CDR
caacaauacggcuccucccccgcccucacc

SEQ ID NO: 60523 - RNA, 30 nt, Artificial Sequence
  derived and/or modified sequence opt11 from anti-influenza_CDR
caagaauacaacaacgacagcccacucaca

SEQ ID NO: 60524 - RNA, 30 nt, Artificial Sequence
  derived and/or modified sequence opt11 from anti-influenza_CDR
auccgcuccggccucaaccgauucgaaacc

SEQ ID NO: 60525 - RNA, 30 nt, Artificial Sequence; identical to SEQ ID NO: 22315
  derived and/or modified sequence opt11 from anti-influenza_CDR

SEQ ID NO: 60526 - RNA, 30 nt, Artificial Sequence
  derived and/or modified sequence opt11 from anti-influenza_CDR
ggcgcgagcauaagcacgggcgggaacuau

SEQ ID NO: 60527 - RNA, 30 nt, Artificial Sequence
  derived and/or modified sequence opt11 from anti-influenza_CDR
aucuucuacuccggcaccaccaaauacaac

SEQ ID NO: 60528 - RNA, 30 nt, Artificial Sequence
  derived and/or modified sequence opt11 from anti-influenza_CDR
gccuccuacgccggcacauacauccaccua

SEQ ID NO: 60529 - RNA, 30 nt, Artificial Sequence; identical to SEQ ID NO: 52887
  derived and/or modified sequence opt11 from anti-influenza_CDR

SEQ ID NO: 60530 - RNA, 30 nt, Artificial Sequence
  derived and/or modified sequence opt11 from anti-influenza_CDR
caacaauucaacgacuggcccuuccucacc

SEQ ID NO: 60531 - RNA, 30 nt, Artificial Sequence
  derived and/or modified sequence opt11 from anti-influenza_CDR
caacaacucaccaccuacccccccaucacc

SEQ ID NO: 60532 - RNA, 30 nt, Artificial Sequence
  derived and/or modified sequence opt11 from anti-influenza_CDR
ggcgggagcauaagcaauggcggguaccau

SEQ ID NO: 60533 - RNA, 30 nt, Artificial Sequence
  derived and/or modified sequence opt11 from anti-influenza_CDR
ggcgacuccgucaucaacuccgccuacuau

SEQ ID NO: 60534 - RNA, 30 nt, Artificial Sequence
  derived and/or modified sequence opt11 from anti-influenza_CDR
caacaauacgacaacuggcuccccaucacc

SEQ ID NO: 60535 - RNA, 30 nt, Artificial Sequence
  derived and/or modified sequence opt11 from anti-influenza_CDR
gcgggggauuauaguggggggauauaugcg

SEQ ID NO: 60536 - RNA, 30 nt, Artificial Sequence
  derived and/or modified sequence opt11 from anti-influenza_CDR
gcgggcgauuacucgggcucgaacuaugca

SEQ ID NO: 60537 - RNA, 30 nt, Artificial Sequence
  derived and/or modified sequence opt11 from anti-influenza_CDR
gcgggcgauuacucgggcgcgaacuaugcc

SEQ ID NO: 60538 - RNA, 30 nt, Artificial Sequence
  derived and/or modified sequence opt11 from anti-influenza_CDR
ggcuugagcuuguacucgaacgagaucaau

SEQ ID NO: 60539 - RNA, 30 nt, Artificial Sequence
  derived and/or modified sequence opt11 from anti-influenza_CDR
gccucauacgccggcaacaacauauacgua

SEQ ID NO: 60540 - RNA, 30 nt, Artificial Sequence
  derived and/or modified sequence opt11 from anti-influenza_CDR
gccucccaauccgucuccaccuuccucgcc

SEQ ID NO: 60541 - RNA, 30 nt, Artificial Sequence
  derived and/or modified sequence opt11 from anti-influenza_CDR
auaaaaucgaacacggacgggggcacgaca

SEQ ID NO: 60542 - RNA, 30 nt, Artificial Sequence
  derived and/or modified sequence opt11 from anti-influenza_CDR
gagagcguggacauauacgggaacucguuc

SEQ ID NO: 60543 - RNA, 30 nt, Artificial Sequence
  derived and/or modified sequence opt11 from anti-influenza_CDR
gagagcauagacauauacgggaacucguuc

SEQ ID NO: 60544 - RNA, 30 nt, Artificial Sequence
  derived and/or modified sequence opt11 from anti-influenza_CDR
gcgggcgauuacucgggcgugaacuaugcc

SEQ ID NO: 60545 - RNA, 33 nt, Artificial Sequence
  derived and/or modified sequence opt11 from anti-influenza_CDR
gcagccugggacgacagccuaaacggacaacua

SEQ ID NO: 60546 - RNA, 33 nt, Artificial Sequence
  derived and/or modified sequence opt11 from anti-influenza_CDR
ugcucguacgcgggcucgagcucgagcaggguc

SEQ ID NO: 60547 - RNA, 33 nt, Artificial Sequence
  derived and/or modified sequence opt11 from anti-influenza_CDR
cucguccucgccaccggccuccgcaacucaccc

SEQ ID NO: 60548 - RNA, 33 nt, Artificial Sequence
  derived and/or modified sequence opt11 from anti-influenza_CDR
caaucccuccuccacuccgacggcaaaaccuac

SEQ ID NO: 60549 - RNA, 33 nt, Artificial Sequence
  derived and/or modified sequence opt11 from anti-influenza_CDR
cgcaccucccaaucccucuccuccuaccuccac

SEQ ID NO: 60550 - RNA, 33 nt, Artificial Sequence
  derived and/or modified sequence opt11 from anti-influenza_CDR
cgcgcgagccagcgcuugaacucguacuugcac

SEQ ID NO: 60551 - RNA, 33 nt, Artificial Sequence
  derived and/or modified sequence opt11 from anti-influenza_CDR
cgcaccucccaaucccuccgcuccuaccuccac

SEQ ID NO: 60552 - RNA, 33 nt, Artificial Sequence
  derived and/or modified sequence opt11 from anti-influenza_CDR
cgcaccucccaaucccucuccuccuacacccac

SEQ ID NO: 60553 - RNA, 33 nt, Artificial Sequence
  derived and/or modified sequence opt11 from anti-influenza_CDR
cgcacaagccaaagccuaagcucauacgaccac

SEQ ID NO: 60554 - RNA, 33 nt, Artificial Sequence
  derived and/or modified sequence opt11 from anti-influenza_CDR
caagugugggauagcucgagcgaucacuauguc

SEQ ID NO: 60555 - RNA, 33 nt, Artificial Sequence
  derived and/or modified sequence opt11 from anti-influenza_CDR
caagugugggggagcucgagcgaucacuauguc

SEQ ID NO: 60556 - RNA, 33 nt, Artificial Sequence
  derived and/or modified sequence opt11 from anti-influenza_CDR
gggacgugggacaguaguuugaguguggggaug

SEQ ID NO: 60557 - RNA, 33 nt, Artificial Sequence
  derived and/or modified sequence opt11 from anti-influenza_CDR
caaucccuccuccacggcaacggcuacaacuac

SEQ ID NO: 60558 - RNA, 33 nt, Artificial Sequence
  derived and/or modified sequence opt11 from anti-influenza_CDR
agggcgagucaggggauaaggaaugacuugggg

SEQ ID NO: 60559 - RNA, 33 nt, Artificial Sequence
  derived and/or modified sequence opt11 from anti-influenza_CDR
cgcgcaagccagaacauacgcucauaccugaac

SEQ ID NO: 60560 - RNA, 33 nt, Artificial Sequence
  derived and/or modified sequence opt11 from anti-influenza_CDR
cgcgcaaaccaggacauaggcauauaccugaac

SEQ ID NO: 60561 - RNA, 33 nt, Artificial Sequence
  derived and/or modified sequence opt11 from anti-influenza_CDR
cgcgccucccaauccgucuccaacaaccuagcc

SEQ ID NO: 60562 - RNA, 33 nt, Artificial Sequence
  derived and/or modified sequence opt11 from anti-influenza_CDR
caacaauaccacaacuggccccccuccuacucc

SEQ ID NO: 60563 - RNA, 33 nt, Artificial Sequence
  derived and/or modified sequence opt11 from anti-influenza_CDR
cgcgccagccaaggcauacucaacugccuagcc

SEQ ID NO: 60564 - RNA, 33 nt, Artificial Sequence
  derived and/or modified sequence opt11 from anti-influenza_CDR
agggccucgcaaucgaucgcgagcuggcuagcg

SEQ ID NO: 60565 - RNA, 33 nt, Artificial Sequence
  derived and/or modified sequence opt11 from anti-influenza_CDR
gccccacgcgucuacgaauacuacuucgaccaa

SEQ ID NO: 60566 - RNA, 33 nt, Artificial Sequence
  derived and/or modified sequence opt11 from anti-influenza_CDR
cgcgccucccaauccgucuccucauaccuagcc

SEQ ID NO: 60567 - RNA, 33 nt, Artificial Sequence
  derived and/or modified sequence opt11 from anti-influenza_CDR
agcggggacgcacucccgaaacagaacgcguac

SEQ ID NO: 60568 - RNA, 33 nt, Artificial Sequence
  derived and/or modified sequence opt11 from anti-influenza_CDR
cagagcgcggacucgagcgggacaucgugggug

SEQ ID NO: 60569 - RNA, 33 nt, Artificial Sequence
  derived and/or modified sequence opt11 from anti-influenza_CDR
ggcgggagcaauauagggggcaagagcgugcac

SEQ ID NO: 60570 - RNA, 33 nt, Artificial Sequence
  derived and/or modified sequence opt11 from anti-influenza_CDR
caacacuacggcuccuccccccgauacgccuuc

SEQ ID NO: 60571 - RNA, 33 nt, Artificial Sequence
  derived and/or modified sequence opt11 from anti-influenza_CDR
cgcgcgagccagagcauaagcucauacuugaac

SEQ ID NO: 60572 - RNA, 33 nt, Artificial Sequence
  derived and/or modified sequence opt11 from anti-influenza_CDR
ggcgggaacgcgaucgggagcaagaaagugcac

SEQ ID NO: 60573 - RNA, 33 nt, Artificial Sequence
  derived and/or modified sequence opt11 from anti-influenza_CDR
caagugugggauuucacgaucgaucacgugguc

SEQ ID NO: 60574 - RNA, 33 nt, Artificial Sequence
  derived and/or modified sequence opt11 from anti-influenza_CDR
gcgaccugggacgggagcuugagcgcgugggug

SEQ ID NO: 60575 - RNA, 33 nt, Artificial Sequence
  derived and/or modified sequence opt11 from anti-influenza_CDR
cgcgcgagccagagcgugggcaauuacuuggcc

SEQ ID NO: 60576 - RNA, 33 nt, Artificial Sequence
  derived and/or modified sequence opt11 from anti-influenza_CDR
caacaacgcuccaaauggccccccauguacucc

SEQ ID NO: 60577 - RNA, 33 nt, Artificial Sequence
  derived and/or modified sequence opt11 from anti-influenza_CDR
gacguauccaccaccugguccugguucgcaccc

SEQ ID NO: 60578 - RNA, 33 nt, Artificial Sequence
  derived and/or modified sequence opt11 from anti-influenza_CDR
cgcgccagccagaacauaaaaagauacuucaac

SEQ ID NO: 60579 - RNA, 33 nt, Artificial Sequence
  derived and/or modified sequence opt11 from anti-influenza_CDR
cgcgcaucccaauccgucggcaacucccuagcc

SEQ ID NO: 60580 - RNA, 33 nt, Artificial Sequence
  derived and/or modified sequence opt11 from anti-influenza_CDR
ggcgagagcacgcucucguacuaugccgugagc

SEQ ID NO: 60581 - RNA, 33 nt, Artificial Sequence
  derived and/or modified sequence opt11 from anti-influenza_CDR
cgcgccagccaaaacauauacaaauaccuaaac

SEQ ID NO: 60582 - RNA, 33 nt, Artificial Sequence
  derived and/or modified sequence opt11 from anti-influenza_CDR
gcgagcuguagcgggggcuauugcauacucgau

SEQ ID NO: 60583 - RNA, 33 nt, Artificial Sequence
  derived and/or modified sequence opt11 from anti-influenza_CDR
cgcaccucccaauccaucuccuccuaccucaac

SEQ ID NO: 60584 - RNA, 33 nt, Artificial Sequence
  derived and/or modified sequence opt11 from anti-influenza_CDR
cgcgcgagccagagcauaggcgcguacgugaac

SEQ ID NO: 60585 - RNA, 33 nt, Artificial Sequence
  derived and/or modified sequence opt11 from anti-influenza_CDR
cgcgcgagccagagcauaagcacauacuugaac

SEQ ID NO: 60586 - RNA, 33 nt, Artificial Sequence
  derived and/or modified sequence opt11 from anti-influenza_CDR
cgcgcaagccagagcauagacaaauuccugaac

SEQ ID NO: 60587 - RNA, 33 nt, Artificial Sequence
  derived and/or modified sequence opt11 from anti-influenza_CDR
ggcgggcacaauaucgggagcaauagcgugcac

SEQ ID NO: 60588 - RNA, 33 nt, Artificial Sequence
  derived and/or modified sequence opt11 from anti-influenza_CDR
cgcgccucccaauccauauccacauaccuacac

SEQ ID NO: 60589 - RNA, 33 nt, Artificial Sequence
  derived and/or modified sequence opt11 from anti-influenza_CDR
cacgugggcgggcacacguacgggauagauuac

SEQ ID NO: 60590 - RNA, 33 nt, Artificial Sequence
  derived and/or modified sequence opt11 from anti-influenza_CDR
cgcgccucccaauccauauccaacuaccuaaac

SEQ ID NO: 60591 - RNA, 33 nt, Artificial Sequence
  derived and/or modified sequence opt11 from anti-influenza_CDR
cacgacgacgccucccacggcuacuccauaucc

SEQ ID NO: 60592 - RNA, 33 nt, Artificial Sequence
  derived and/or modified sequence opt11 from anti-influenza_CDR
cgcgccucccaaaccauauccacauaccuaaac

SEQ ID NO: 60593 - RNA, 33 nt, Artificial Sequence
  derived and/or modified sequence opt11 from anti-influenza_CDR
cgcgcaagccagagcauaagcagauaccugaac

SEQ ID NO: 60594 - RNA, 33 nt, Artificial Sequence
  derived and/or modified sequence opt11 from anti-influenza_CDR
gggaccugggacucgagcuugagcgcguacgug

SEQ ID NO: 60595 - RNA, 33 nt, Artificial Sequence
  derived and/or modified sequence opt11 from anti-influenza_CDR
uccucaaacuacuacgacuccgucuacgacuac

SEQ ID NO: 60596 - RNA, 33 nt, Artificial Sequence
  derived and/or modified sequence opt11 from anti-influenza_CDR
gcagccugggacgacauccuaaacguaccagua

SEQ ID NO: 60597 - RNA, 33 nt, Artificial Sequence
  derived and/or modified sequence opt11 from anti-influenza_CDR
guggccugggaugauaguguggacggguaugug

SEQ ID NO: 60598 - RNA, 33 nt, Artificial Sequence
  derived and/or modified sequence opt11 from anti-influenza_CDR
gggcccaaguacuauagcgaguacauggacgug

SEQ ID NO: 60599 - RNA, 33 nt, Artificial Sequence
  derived and/or modified sequence opt11 from anti-influenza_CDR
cgcgcgagccagggcauaagcucauacuuggcc

SEQ ID NO: 60600 - RNA, 33 nt, Artificial Sequence
  derived and/or modified sequence opt11 from anti-influenza_CDR
ucauccggcuacuaccccgaauacuuccaagac

SEQ ID NO: 60601 - RNA, 33 nt, Artificial Sequence
  derived and/or modified sequence opt11 from anti-influenza_CDR
agcgggcacaagcucggggacaaguacgugagc

SEQ ID NO: 60602 - RNA, 33 nt, Artificial Sequence
  derived and/or modified sequence opt11 from anti-influenza_CDR
uccaccggcuacuaccccgccuaccuacaccac

SEQ ID NO: 60603 - RNA, 33 nt, Artificial Sequence
  derived and/or modified sequence opt11 from anti-influenza_CDR
cgcgcgagccagcgcgugagcucauacuuggcc

SEQ ID NO: 60604 - RNA, 33 nt, Artificial Sequence; identical to SEQ ID NO: 59497
  derived and/or modified sequence opt11 from anti-influenza_CDR

SEQ ID NO: 60605 - RNA, 33 nt, Artificial Sequence
  derived and/or modified sequence opt11 from anti-influenza_CDR
caagugugggauagcucgagcgaucacgcgguc

SEQ ID NO: 60606 - RNA, 33 nt, Artificial Sequence
  derived and/or modified sequence opt11 from anti-influenza_CDR
gcgaccugggacgauaacuugagcgggcccgug

SEQ ID NO: 60607 - RNA, 33 nt, Artificial Sequence
  derived and/or modified sequence opt11 from anti-influenza_CDR
uccuccggcuacuaccccgccuaccuaccccac

SEQ ID NO: 60608 - RNA, 33 nt, Artificial Sequence
  derived and/or modified sequence opt11 from anti-influenza_CDR
ggcgggaacaauauagggagcaagggagugcac

SEQ ID NO: 60609 - RNA, 33 nt, Artificial Sequence
  derived and/or modified sequence opt11 from anti-influenza_CDR
caagugugggauagcucgagcgaucacgugguc

SEQ ID NO: 60610 - RNA, 33 nt, Artificial Sequence
  derived and/or modified sequence opt11 from anti-influenza_CDR
ggcaauuacuauuacgagagcucgcucgacuac

SEQ ID NO: 60611 - RNA, 33 nt, Artificial Sequence; identical to SEQ ID NO: 22401
  derived and/or modified sequence opt11 from anti-influenza_CDR

SEQ ID NO: 60612 - RNA, 33 nt, Artificial Sequence
  derived and/or modified sequence opt11 from anti-influenza_CDR
cgcgccucccaaggcauauccacauaccuagcc

SEQ ID NO: 60613 - RNA, 33 nt, Artificial Sequence
  derived and/or modified sequence opt11 from anti-influenza_CDR
gggcccacguacuauuacucguacauggacgug

SEQ ID NO: 60614 - RNA, 33 nt, Artificial Sequence
  derived and/or modified sequence opt11 from anti-influenza_CDR
ggcgggaacaauaucgggcgaaauagcgugcac

SEQ ID NO: 60615 - RNA, 33 nt, Artificial Sequence
  derived and/or modified sequence opt11 from anti-influenza_CDR
caagucuggcacuccuccuccgaccacuacguc

SEQ ID NO: 60616 - RNA, 33 nt, Artificial Sequence
  derived and/or modified sequence opt11 from anti-influenza_CDR
uccuccggcuacuacccccaauacuuccaagac

SEQ ID NO: 60617 - RNA, 33 nt, Artificial Sequence
  derived and/or modified sequence opt11 from anti-influenza_CDR
cgcgcgagccagagcgugagcagauacuuggcc

SEQ ID NO: 60618 - RNA, 33 nt, Artificial Sequence
  derived and/or modified sequence opt11 from anti-influenza_CDR
ugggggcaggggacgacguugacgguaaguagu

SEQ ID NO: 60619 - RNA, 33 nt, Artificial Sequence
  derived and/or modified sequence opt11 from anti-influenza_CDR
cgcgccucccaauccgucgacucaaaccuagcc

SEQ ID NO: 60620 - RNA, 33 nt, Artificial Sequence
  derived and/or modified sequence opt11 from anti-influenza_CDR
cgcgccucccaauccgucucccacaaccuagcc

SEQ ID NO: 60621 - RNA, 33 nt, Artificial Sequence
  derived and/or modified sequence opt11 from anti-influenza_CDR
cgcgccucccaauccgucuccucaaaccuagcc

SEQ ID NO: 60622 - RNA, 33 nt, Artificial Sequence
  derived and/or modified sequence opt11 from anti-influenza_CDR
cgcgccucccaauccgucgaccacaaccuagcc

SEQ ID NO: 60623 - RNA, 33 nt, Artificial Sequence
  derived and/or modified sequence opt11 from anti-influenza_CDR
caacacuacaccaacuggcccccccgccucacc

SEQ ID NO: 60624 - RNA, 33 nt, Artificial Sequence
  derived and/or modified sequence opt11 from anti-influenza_CDR
caacacuacaccaacuaccccccccgccucacc

SEQ ID NO: 60625 - RNA, 33 nt, Artificial Sequence
  derived and/or modified sequence opt11 from anti-influenza_CDR
caacacuacaccaacuuccccccccgccucacc

SEQ ID NO: 60626 - RNA, 33 nt, Artificial Sequence
  derived and/or modified sequence opt11 from anti-influenza_CDR
cgcgccucccaagucaucucccacaaccucgcc

SEQ ID NO: 60627 - RNA, 33 nt, Artificial Sequence
  derived and/or modified sequence opt11 from anti-influenza_CDR
caacacuacuccaacuggcccccccgccucacc

SEQ ID NO: 60628 - RNA, 33 nt, Artificial Sequence
  derived and/or modified sequence opt11 from anti-influenza_CDR
caacacuacuccaacuuccccccccgccucacc

SEQ ID NO: 60629 - RNA, 33 nt, Artificial Sequence
  derived and/or modified sequence opt11 from anti-influenza_CDR
caacacuacuccaacuaccccccccgccucacc

SEQ ID NO: 60630 - RNA, 33 nt, Artificial Sequence
  derived and/or modified sequence opt11 from anti-influenza_CDR
cgcgccucccaauccgucgccaacaaccuagcc

SEQ ID NO: 60631 - RNA, 33 nt, Artificial Sequence
  derived and/or modified sequence opt11 from anti-influenza_CDR
caacaauacaacaacuggccccccauguacacc

SEQ ID NO: 60632 - RNA, 33 nt, Artificial Sequence
  derived and/or modified sequence opt11 from anti-influenza_CDR
agggcaagucaaucgauagggaacuggcuagcg

SEQ ID NO: 60633 - RNA, 33 nt, Artificial Sequence
  derived and/or modified sequence opt11 from anti-influenza_CDR
caacgcuacaccuccaacucccaaggcuucacc

SEQ ID NO: 60634 - RNA, 33 nt, Artificial Sequence
  derived and/or modified sequence opt11 from anti-influenza_CDR
gcagccugggacgacacacuaaacggaccagua

SEQ ID NO: 60635 - RNA, 33 nt, Artificial Sequence
  derived and/or modified sequence opt11 from anti-influenza_CDR
aaagcgagccagaacgugggcucaaacguggcc

SEQ ID NO: 60636 - RNA, 33 nt, Artificial Sequence
  derived and/or modified sequence opt11 from anti-influenza_CDR
caggugugggauaugaguagugauaggagggug

SEQ ID NO: 60637 - RNA, 33 nt, Artificial Sequence
  derived and/or modified sequence opt11 from anti-influenza_CDR
caaucccuccuccacuccaacggcuacaacuac

SEQ ID NO: 60638 - RNA, 33 nt, Artificial Sequence
  derived and/or modified sequence opt11 from anti-influenza_CDR
accuaccucgucggcgcagucggauuccagcac

SEQ ID NO: 60639 - RNA, 33 nt, Artificial Sequence; identical to SEQ ID NO: 59550
  derived and/or modified sequence opt11 from anti-influenza_CDR

SEQ ID NO: 60640 - RNA, 33 nt, Artificial Sequence
  derived and/or modified sequence opt11 from anti-influenza_CDR
caaucccuccucgacuccaacggcuacaacuac

SEQ ID NO: 60641 - RNA, 33 nt, Artificial Sequence
  derived and/or modified sequence opt11 from anti-influenza_CDR
augcaagcccuccaaaccccacccauguacaca

SEQ ID NO: 60642 - RNA, 33 nt, Artificial Sequence
  derived and/or modified sequence opt11 from anti-influenza_CDR
caaucccuccuccacuccaacggcuacaaccac

SEQ ID NO: 60643 - RNA, 33 nt, Artificial Sequence
  derived and/or modified sequence opt11 from anti-influenza_CDR
caagugugggauaucacgagcgaucucgugguc

SEQ ID NO: 60644 - RNA, 33 nt, Artificial Sequence
  derived and/or modified sequence opt11 from anti-influenza_CDR
cgagcaagccaggacauaagcacauggcuggcc

SEQ ID NO: 60645 - RNA, 33 nt, Artificial Sequence
  derived and/or modified sequence opt11 from anti-influenza_CDR
cgcgccucccgcuccaucaccaccuuccuagcc

SEQ ID NO: 60646 - RNA, 33 nt, Artificial Sequence
  derived and/or modified sequence opt11 from anti-influenza_CDR
ggcuggggcgcggucacgagcccguucgauuuc

SEQ ID NO: 60647 - RNA, 33 nt, Artificial Sequence
  derived and/or modified sequence opt11 from anti-influenza_CDR
cgcgcgagccagagcgugagcucgagcuaucuc

SEQ ID NO: 60648 - RNA, 36 nt, Artificial Sequence
  derived and/or modified sequence opt11 from anti-influenza_CDR
caauccguccucuacuccuccaacaacaaaaacuac

SEQ ID NO: 60649 - RNA, 36 nt, Artificial Sequence
  derived and/or modified sequence opt11 from anti-influenza_CDR
gcagcgugggaugacucgcuaucgggaucgugggug

SEQ ID NO: 60650 - RNA, 36 nt, Artificial Sequence
  derived and/or modified sequence opt11 from anti-influenza_CDR
guguucuauagcgcggacaggacaucguacgcggac

SEQ ID NO: 60651 - RNA, 36 nt, Artificial Sequence
  derived and/or modified sequence opt11 from anti-influenza_CDR
cgcgugggccagagcgugagcgggagccaucucgcg

SEQ ID NO: 60652 - RNA, 36 nt, Artificial Sequence
  derived and/or modified sequence opt11 from anti-influenza_CDR
acccucuccuccgccuacuccaacuacaaagucgac

SEQ ID NO: 60653 - RNA, 36 nt, Artificial Sequence
  derived and/or modified sequence opt11 from anti-influenza_CDR
guggggacgggggggauaguggggaguaagggggau

SEQ ID NO: 60654 - RNA, 36 nt, Artificial Sequence
  derived and/or modified sequence opt11 from anti-influenza_CDR
cgcuacucccgcucaucccccggcaccuucgaaucc

SEQ ID NO: 60655 - RNA, 36 nt, Artificial Sequence
  derived and/or modified sequence opt11 from anti-influenza_CDR
caaucguacgauagcucgcucucgggcuuucacgug

SEQ ID NO: 60656 - RNA, 36 nt, Artificial Sequence
  derived and/or modified sequence opt11 from anti-influenza_CDR
cgcgcaagccagagcgugagcucgagccagcucgca

SEQ ID NO: 60657 - RNA, 36 nt, Artificial Sequence
  derived and/or modified sequence opt11 from anti-influenza_CDR
cgcgcgagccaguucgugagcacgcgcucgcucgcg

SEQ ID NO: 60658 - RNA, 36 nt, Artificial Sequence
  derived and/or modified sequence opt11 from anti-influenza_CDR
gcgaccugggacgacagcuugaacggguucuaugua

SEQ ID NO: 60659 - RNA, 36 nt, Artificial Sequence
  derived and/or modified sequence opt11 from anti-influenza_CDR
cgcgcgagccauuucgugaacuaucgcucgcucgcg

SEQ ID NO: 60660 - RNA, 36 nt, Artificial Sequence
  derived and/or modified sequence opt11 from anti-influenza_CDR
cgcgcgagccauuucgugaucgggcgcgcggucgcg

SEQ ID NO: 60661 - RNA, 36 nt, Artificial Sequence
  derived and/or modified sequence opt11 from anti-influenza_CDR
agaauauaccacggcggcaacagcggcuucgacuuc

SEQ ID NO: 60662 - RNA, 36 nt, Artificial Sequence
  derived and/or modified sequence opt11 from anti-influenza_CDR
acccucuccuccggcuucgacaacuaccaagucgcc

SEQ ID NO: 60663 - RNA, 36 nt, Artificial Sequence
  derived and/or modified sequence opt11 from anti-influenza_CDR
guggggaauggggggaauguggcgaguaagggggau

SEQ ID NO: 60664 - RNA, 36 nt, Artificial Sequence
  derived and/or modified sequence opt11 from anti-influenza_CDR
gugaggggggggaguacgguggcguauuuuggggug

SEQ ID NO: 60665 - RNA, 36 nt, Artificial Sequence
  derived and/or modified sequence opt11 from anti-influenza_CDR
ugucuaucgagaaugcgcggguacgggcucgauguc

SEQ ID NO: 60666 - RNA, 36 nt, Artificial Sequence
  derived and/or modified sequence opt11 from anti-influenza_CDR
gucgggcaaauggacaaguacuacgccauggacgug

SEQ ID NO: 60667 - RNA, 36 nt, Artificial Sequence
  derived and/or modified sequence opt11 from anti-influenza_CDR
ggcgugaccaacaaagugaacucgaucauagacaag

SEQ ID NO: 60668 - RNA, 36 nt, Artificial Sequence
  derived and/or modified sequence opt11 from anti-influenza_CDR
ggggugacgaacaaggugaacaggauaauagacaag

SEQ ID NO: 60669 - RNA, 36 nt, Artificial Sequence
  derived and/or modified sequence opt11 from anti-influenza_CDR
ggggucacgaacaaggaaaacagcauaaucgacaaa

SEQ ID NO: 60670 - RNA, 36 nt, Artificial Sequence; identical to SEQ ID NO: 22460
  derived and/or modified sequence opt11 from anti-influenza_CDR

SEQ ID NO: 60671 - RNA, 36 nt, Artificial Sequence
  derived and/or modified sequence opt11 from anti-influenza_CDR
aaaaucaccuccaaagucaacaacaucgucgacaaa

SEQ ID NO: 60672 - RNA, 36 nt, Artificial Sequence
  derived and/or modified sequence opt11 from anti-influenza_CDR
gggaucacgaacaaggucaacagcauaaucgacaaa

SEQ ID NO: 60673 - RNA, 36 nt, Artificial Sequence
  derived and/or modified sequence opt11 from anti-influenza_CDR
aacgggcgcucgagcacgagcuggggcauagacgug

SEQ ID NO: 60674 - RNA, 36 nt, Artificial Sequence
  derived and/or modified sequence opt11 from anti-influenza_CDR
gggaucacgaacaaggaaaauagcgugaucgagaaa

SEQ ID NO: 60675 - RNA, 36 nt, Artificial Sequence
  derived and/or modified sequence opt11 from anti-influenza_CDR
cccuugggcucgcgcuauuacuauggcauggacgug

SEQ ID NO: 60676 - RNA, 36 nt, Artificial Sequence
  derived and/or modified sequence opt11 from anti-influenza_CDR
gggaucacgaacaaggucaauagcgugaucgagaaa

SEQ ID NO: 60677 - RNA, 36 nt, Artificial Sequence
  derived and/or modified sequence opt11 from anti-influenza_CDR
ggcgucaccaacaaagucaacucaaucaucaacaaa

SEQ ID NO: 60678 - RNA, 36 nt, Artificial Sequence
  derived and/or modified sequence opt11 from anti-influenza_CDR
cacaugggcuaucaagugcgcgagaccauggacgug

SEQ ID NO: 60679 - RNA, 36 nt, Artificial Sequence
  derived and/or modified sequence opt11 from anti-influenza_CDR
gcgaccugggacaggcgcccgaccgcguacguggua

SEQ ID NO: 60680 - RNA, 36 nt, Artificial Sequence
  derived and/or modified sequence opt11 from anti-influenza_CDR
gaggggaagugggggccgcaggcggcguucgauaua

SEQ ID NO: 60681 - RNA, 36 nt, Artificial Sequence
  derived and/or modified sequence opt11 from anti-influenza_CDR
ggcgauaaagggaucuauuacuacuacauggacgug

SEQ ID NO: 60682 - RNA, 36 nt, Artificial Sequence; identical to SEQ ID NO: 22472
  derived and/or modified sequence opt11 from anti-influenza_CDR

SEQ ID NO: 60683 - RNA, 36 nt, Artificial Sequence
  derived and/or modified sequence opt11 from anti-influenza_CDR
cgcgcgagccagagcgugagcucgagcuaucucgcg

SEQ ID NO: 60684 - RNA, 36 nt, Artificial Sequence; identical to SEQ ID NO: 22474
  derived and/or modified sequence opt11 from anti-influenza_CDR

SEQ ID NO: 60685 - RNA, 36 nt, Artificial Sequence
  derived and/or modified sequence opt11 from anti-influenza_CDR
cgcgcgagccagagcgugagcucgaacuaucucggg

SEQ ID NO: 60686 - RNA, 36 nt, Artificial Sequence
  derived and/or modified sequence opt11 from anti-influenza_CDR
gggagcacguacgauuucucgagcgggcucgauuac

SEQ ID NO: 60687 - RNA, 36 nt, Artificial Sequence
  derived and/or modified sequence opt11 from anti-influenza_CDR
ggcguacaccaccccggaaccgacaacgaccaaaua

SEQ ID NO: 60688 - RNA, 36 nt, Artificial Sequence
  derived and/or modified sequence opt11 from anti-influenza_CDR
ggcguccaccaccccucaaccgacuccgaccaaaca

SEQ ID NO: 60689 - RNA, 36 nt, Artificial Sequence
  derived and/or modified sequence opt11 from anti-influenza_CDR
ggcguccaccaccccucaaacgaaaccgaacaaaga

SEQ ID NO: 60690 - RNA, 36 nt, Artificial Sequence
  derived and/or modified sequence opt11 from anti-influenza_CDR
caauccaucaccuucgacuacaaaaacuaccucgcc

SEQ ID NO: 60691 - RNA, 36 nt, Artificial Sequence
  derived and/or modified sequence opt11 from anti-influenza_CDR
gggggguugauagggacggggaguuauuauuggggg

SEQ ID NO: 60692 - RNA, 36 nt, Artificial Sequence
  derived and/or modified sequence opt11 from anti-influenza_CDR
gcgcgcuauaacuggggcauacgcuauuucgacuuc

SEQ ID NO: 60693 - RNA, 36 nt, Artificial Sequence
  derived and/or modified sequence opt11 from anti-influenza_CDR
caauccguccucuccaacuccaaaaaccucaacuac

SEQ ID NO: 60694 - RNA, 36 nt, Artificial Sequence
  derived and/or modified sequence opt11 from anti-influenza_CDR
ugucaggucugggagacgagugaggacuugugggug

SEQ ID NO: 60695 - RNA, 39 nt, Artificial Sequence
  derived and/or modified sequence opt11 from anti-influenza_CDR
gccagaggcggccgauacuacgucgacuacuucgacuac

SEQ ID NO: 60696 - RNA, 39 nt, Artificial Sequence
  derived and/or modified sequence opt11 from anti-influenza_CDR
gcccgcuccggcgacggcuacaacuacuacuucccccua

SEQ ID NO: 60697 - RNA, 39 nt, Artificial Sequence
  derived and/or modified sequence opt11 from anti-influenza_CDR
gcgcgcgggugcggguacaauugcuauuacuuugacggg

SEQ ID NO: 60698 - RNA, 39 nt, Artificial Sequence; identical to SEQ ID NO: 22488
  derived and/or modified sequence opt11 from anti-influenza_CDR

SEQ ID NO: 60699 - RNA, 39 nt, Artificial Sequence; identical to SEQ ID NO: 22489
  derived and/or modified sequence opt11 from anti-influenza_CDR

SEQ ID NO: 60700 - RNA, 39 nt, Artificial Sequence
  derived and/or modified sequence opt11 from anti-influenza_CDR
agcgggagcgauagcaauaucggggacuauuucgugugc

SEQ ID NO: 60701 - RNA, 39 nt, Artificial Sequence
  derived and/or modified sequence opt11 from anti-influenza_CDR
gcgaggauggugguggugacgggggauggguuugaugug

SEQ ID NO: 60702 - RNA, 39 nt, Artificial Sequence
  derived and/or modified sequence opt11 from anti-influenza_CDR
uggcuaucgauaauaaacgcgggcgggggcgauauagau

SEQ ID NO: 60703 - RNA, 39 nt, Artificial Sequence
  derived and/or modified sequence opt11 from anti-influenza_CDR
gcggccucgagcuugcaaucgggcgugcccucgcgcuuu

SEQ ID NO: 60704 - RNA, 39 nt, Artificial Sequence
  derived and/or modified sequence opt11 from anti-influenza_CDR
cacgacgccaaauucuccggcuccuacuacgucgccucc

SEQ ID NO: 60705 - RNA, 39 nt, Artificial Sequence
  derived and/or modified sequence opt11 from anti-influenza_CDR
cacgacgucaaauucuccggcuccuacuacgucgccucc

SEQ ID NO: 60706 - RNA, 39 nt, Artificial Sequence
  derived and/or modified sequence opt11 from anti-influenza_CDR
acagggagcgagagcacgaccggguacgggauggauguc

SEQ ID NO: 60707 - RNA, 39 nt, Artificial Sequence
  derived and/or modified sequence opt11 from anti-influenza_CDR
gcagcgagcacgagcgugcucggguacgggauggaugua

SEQ ID NO: 60708 - RNA, 39 nt, Artificial Sequence
  derived and/or modified sequence opt11 from anti-influenza_CDR
uccggcucaaccuucaacaucggcuccaacgccgucgac

SEQ ID NO: 60709 - RNA, 39 nt, Artificial Sequence
  derived and/or modified sequence opt11 from anti-influenza_CDR
uccggcucccgcucaaacgucggcgacaacuccgucuac

SEQ ID NO: 60710 - RNA, 39 nt, Artificial Sequence
  derived and/or modified sequence opt11 from anti-influenza_CDR
agcgggagcucgagcaauaucgggaacgauuacgugagc

SEQ ID NO: 60711 - RNA, 39 nt, Artificial Sequence
  derived and/or modified sequence opt11 from anti-influenza_CDR
gggggggggaguuauggggcguaugagggguuugauuau

SEQ ID NO: 60712 - RNA, 39 nt, Artificial Sequence
  derived and/or modified sequence opt11 from anti-influenza_CDR
agcgggagcucgagcaauaucgggagcaauuacguguac

SEQ ID NO: 60713 - RNA, 39 nt, Artificial Sequence
  derived and/or modified sequence opt11 from anti-influenza_CDR
gcccgccgccaacaacucuacaaaggcuacuaccaccac

SEQ ID NO: 60714 - RNA, 39 nt, Artificial Sequence
  derived and/or modified sequence opt11 from anti-influenza_CDR
agcgggagcacgagcaauaucggguacaaucccgugagc

SEQ ID NO: 60715 - RNA, 39 nt, Artificial Sequence; identical to SEQ ID NO: 22505
  derived and/or modified sequence opt11 from anti-influenza_CDR

SEQ ID NO: 60716 - RNA, 39 nt, Artificial Sequence; identical to SEQ ID NO: 22506
  derived and/or modified sequence opt11 from anti-influenza_CDR

SEQ ID NO: 60717 - RNA, 39 nt, Artificial Sequence
  derived and/or modified sequence opt11 from anti-influenza_CDR
gcaaaaccgcucaggggcucguacagguacuucgaccug

SEQ ID NO: 60718 - RNA, 39 nt, Artificial Sequence
  derived and/or modified sequence opt11 from anti-influenza_CDR
ccgaucugggucaagaccccgcucaagcuagcgaacgga

SEQ ID NO: 60719 - RNA, 39 nt, Artificial Sequence
  derived and/or modified sequence opt11 from anti-influenza_CDR
caagccucccaauccgucuacaacaaaaacaaccuagcc

SEQ ID NO: 60720 - RNA, 39 nt, Artificial Sequence
  derived and/or modified sequence opt11 from anti-influenza_CDR
caauccuccgaauccgucuacaaaaacaacaaccucgcc

SEQ ID NO: 60721 - RNA, 39 nt, Artificial Sequence
  derived and/or modified sequence opt11 from anti-influenza_CDR
caauccucccaauccgucgacuccaacaaccaacucucc

SEQ ID NO: 60722 - RNA, 39 nt, Artificial Sequence
  derived and/or modified sequence opt11 from anti-influenza_CDR
caauccucccaauccgucgacaacaacaaagaccucgcc

SEQ ID NO: 60723 - RNA, 39 nt, Artificial Sequence
  derived and/or modified sequence opt11 from anti-influenza_CDR
caauccucccaauccgucuacaacaacaaccgccucucc

SEQ ID NO: 60724 - RNA, 39 nt, Artificial Sequence
  derived and/or modified sequence opt11 from anti-influenza_CDR
caauccucccaauccgucuacaaaaacaacaaccucgcc

SEQ ID NO: 60725 - RNA, 39 nt, Artificial Sequence
  derived and/or modified sequence opt11 from anti-influenza_CDR
ggggggggguuuggguggagucagacguauuuuggguau

SEQ ID NO: 60726 - RNA, 42 nt, Artificial Sequence
  derived and/or modified sequence opt11 from anti-influenza_CDR
uggcucgggcgcacguacuaccgcucgaaaugguacaaugac

SEQ ID NO: 60727 - RNA, 42 nt, Artificial Sequence
  derived and/or modified sequence opt11 from anti-influenza_CDR
gggggguugguggggggguaugaugaguauuuuuuugauuau

SEQ ID NO: 60728 - RNA, 42 nt, Artificial Sequence
  derived and/or modified sequence opt11 from anti-influenza_CDR
caccccaaauacuucuacggcuccggcuccuaccccgacuuc

SEQ ID NO: 60729 - RNA, 42 nt, Artificial Sequence
  derived and/or modified sequence opt11 from anti-influenza_CDR
acgggcucgagcucggacgugggcgcgagcaauagcgugagc

SEQ ID NO: 60730 - RNA, 42 nt, Artificial Sequence; identical to SEQ ID NO: 22520
  derived and/or modified sequence opt11 from anti-influenza_CDR

SEQ ID NO: 60731 - RNA, 42 nt, Artificial Sequence; identical to SEQ ID NO: 22521
  derived and/or modified sequence opt11 from anti-influenza_CDR

SEQ ID NO: 60732 - RNA, 42 nt, Artificial Sequence
  derived and/or modified sequence opt11 from anti-influenza_CDR
gaguucgagaccucgggcuauuuccauggcucguucgauuac

SEQ ID NO: 60733 - RNA, 42 nt, Artificial Sequence; identical to SEQ ID NO: 22523
  derived and/or modified sequence opt11 from anti-influenza_CDR

SEQ ID NO: 60734 - RNA, 42 nt, Artificial Sequence
  derived and/or modified sequence opt11 from anti-influenza_CDR
acgggcgggagcucggacauaggcgcgagcaauagcgugagc

SEQ ID NO: 60735 - RNA, 42 nt, Artificial Sequence
  derived and/or modified sequence opt11 from anti-influenza_CDR
acgggcucgagcucggacgugggcggguacgauuacgugagc

SEQ ID NO: 60736 - RNA, 42 nt, Artificial Sequence
  derived and/or modified sequence opt11 from anti-influenza_CDR
ggcucgagcacgggagcggucacgagagggcacuaucccuau

SEQ ID NO: 60737 - RNA, 42 nt, Artificial Sequence; identical to SEQ ID NO: 22527
  derived and/or modified sequence opt11 from anti-influenza_CDR

SEQ ID NO: 60738 - RNA, 42 nt, Artificial Sequence
  derived and/or modified sequence opt11 from anti-influenza_CDR
cacuacggcgacucagaagccauaaacgacgccuucgacauc

SEQ ID NO: 60739 - RNA, 42 nt, Artificial Sequence
  derived and/or modified sequence opt11 from anti-influenza_CDR
acgggcucgagcucgaacauaggcgcgggcuaugacgugcac

SEQ ID NO: 60740 - RNA, 42 nt, Artificial Sequence; identical to SEQ ID NO: 22530
  derived and/or modified sequence opt11 from anti-influenza_CDR

SEQ ID NO: 60741 - RNA, 42 nt, Artificial Sequence
  derived and/or modified sequence opt11 from anti-influenza_CDR
acgggcacgagcucggacgugggcggguacaauuacgugagc

SEQ ID NO: 60742 - RNA, 42 nt, Artificial Sequence
  derived and/or modified sequence opt11 from anti-influenza_CDR
acgggcacgagcucggacgugggcgcguacaauuacgugagc

SEQ ID NO: 60743 - RNA, 42 nt, Artificial Sequence
  derived and/or modified sequence opt11 from anti-influenza_CDR
gcggagaggccgaaggugagggggcaggcggggaggaugaau

SEQ ID NO: 60744 - RNA, 42 nt, Artificial Sequence
  derived and/or modified sequence opt11 from anti-influenza_CDR
gggaguaggccgugggugaggggggugaguaguaggauaagu

SEQ ID NO: 60745 - RNA, 42 nt, Artificial Sequence
  derived and/or modified sequence opt11 from anti-influenza_CDR
aucuggggaguggcagcgcccgggacagcggcagcgcaaaua

SEQ ID NO: 60746 - RNA, 42 nt, Artificial Sequence
  derived and/or modified sequence opt11 from anti-influenza_CDR
ugggugaggcagccgccggggaagggguuggaguggguggcg

SEQ ID NO: 60747 - RNA, 42 nt, Artificial Sequence
  derived and/or modified sequence opt11 from anti-influenza_CDR
gcgagggggccggagggggugugggggaggaguauagauagu

SEQ ID NO: 60748 - RNA, 42 nt, Artificial Sequence
  derived and/or modified sequence opt11 from anti-influenza_CDR
gcgcgcgaucccgauaccccguucgugcgcgcauucgauagc

SEQ ID NO: 60749 - RNA, 42 nt, Artificial Sequence; identical to SEQ ID NO: 22539
  derived and/or modified sequence opt11 from anti-influenza_CDR

SEQ ID NO: 60750 - RNA, 42 nt, Artificial Sequence
  derived and/or modified sequence opt11 from anti-influenza_CDR
ugggacuggaacuuugaccuguaccugggcugguucgacccc

SEQ ID NO: 60751 - RNA, 42 nt, Artificial Sequence; identical to SEQ ID NO: 22541
  derived and/or modified sequence opt11 from anti-influenza_CDR

SEQ ID NO: 60752 - RNA, 42 nt, Artificial Sequence
  derived and/or modified sequence opt11 from anti-influenza_CDR
gggccaggguacucgggcuaucacuauggcugguucgauaca

SEQ ID NO: 60753 - RNA, 42 nt, Artificial Sequence
  derived and/or modified sequence opt11 from anti-influenza_CDR
gcgcgcugggacuauggcguguacgagggcuauaucgauuac

SEQ ID NO: 60754 - RNA, 45 nt, Artificial Sequence
  derived and/or modified sequence opt11 from anti-influenza_CDR
gcccgcgccggcacaacccuaaccagauucaacugguucgaccca

SEQ ID NO: 60755 - RNA, 45 nt, Artificial Sequence
  derived and/or modified sequence opt11 from anti-influenza_CDR
gcgcgcgcgggcacgaccgugaccagguucaauugguuugacccg

SEQ ID NO: 60756 - RNA, 45 nt, Artificial Sequence
  derived and/or modified sequence opt11 from anti-influenza_CDR
gcgcgcgggcaaagguacuauuacgaucgcgauggcauggacgug

SEQ ID NO: 60757 - RNA, 45 nt, Artificial Sequence
  derived and/or modified sequence opt11 from anti-influenza_CDR
gcccgcucaggcggcuaccuaccccaaaacaacuggauagaccca

SEQ ID NO: 60758 - RNA, 45 nt, Artificial Sequence
  derived and/or modified sequence opt11 from anti-influenza_CDR
auggagaacgagcgcacgcucgauuuccaugacucgaacgugaaa

SEQ ID NO: 60759 - RNA, 45 nt, Artificial Sequence
  derived and/or modified sequence opt11 from anti-influenza_CDR
ggggccgaucacgggagcgggagcaauuucgugagcccguacgug

SEQ ID NO: 60760 - RNA, 45 nt, Artificial Sequence
  derived and/or modified sequence opt11 from anti-influenza_CDR
gacacgagaucgagccuggacaauuaccaguacgggauggacguc

SEQ ID NO: 60761 - RNA, 45 nt, Artificial Sequence
  derived and/or modified sequence opt11 from anti-influenza_CDR
gaggacuaugacauacugacgggagcgggaccgggaauggaagug

SEQ ID NO: 60762 - RNA, 45 nt, Artificial Sequence
  derived and/or modified sequence opt11 from anti-influenza_CDR
cacccauacgacguccuaaccggcuccggcgacugguucgacccc

SEQ ID NO: 60763 - RNA, 45 nt, Artificial Sequence
  derived and/or modified sequence opt11 from anti-influenza_CDR
ggggccgaucacgggagcgggaacaauuucgugagcccguacgug

SEQ ID NO: 60764 - RNA, 45 nt, Artificial Sequence
  derived and/or modified sequence opt11 from anti-influenza_CDR
gugauauauagcgggggcucgaccuauuacgcggacucggucaag

SEQ ID NO: 60765 - RNA, 45 nt, Artificial Sequence
  derived and/or modified sequence opt11 from anti-influenza_CDR
ugguaccaacaaaaacccggcaaagcccccaaacuccucaucuac

SEQ ID NO: 60766 - RNA, 45 nt, Artificial Sequence
  derived and/or modified sequence opt11 from anti-influenza_CDR
gaccccuacaacgacggcaccaaauacaacgaaaaauucgaagga

SEQ ID NO: 60767 - RNA, 45 nt, Artificial Sequence
  derived and/or modified sequence opt11 from anti-influenza_CDR
gcacgagcacacacggcccugaccagauucagauggcuggacccg

SEQ ID NO: 60768 - RNA, 45 nt, Artificial Sequence; identical to SEQ ID NO: 22558
  derived and/or modified sequence opt11 from anti-influenza_CDR

SEQ ID NO: 60769 - RNA, 45 nt, Artificial Sequence
  derived and/or modified sequence opt11 from anti-influenza_CDR
gcccgagucgccacccccuacuacuacgaauccggcuucgacuac

SEQ ID NO: 60770 - RNA, 45 nt, Artificial Sequence
  derived and/or modified sequence opt11 from anti-influenza_CDR
gcgaggaggggggggggguggcaguauuauuaugggauggaugug

SEQ ID NO: 60771 - RNA, 48 nt, Artificial Sequence
  derived and/or modified sequence opt11 from anti-influenza_CDR
uccggccacaucacagucuucggcgucaacgucgacgccuucgacaug

SEQ ID NO: 60772 - RNA, 48 nt, Artificial Sequence
  derived and/or modified sequence opt11 from anti-influenza_CDR
ggcggccacauaacagucuucggccuaaacauagacgccuacgacaua

SEQ ID NO: 60773 - RNA, 48 nt, Artificial Sequence
  derived and/or modified sequence opt11 from anti-influenza_CDR
ggcggccacauaacagaauucggccuaaacauagacgccuacgacaua

SEQ ID NO: 60774 - RNA, 48 nt, Artificial Sequence
  derived and/or modified sequence opt11 from anti-influenza_CDR
gggggccauauaacggucuucggcgugaacauagacgcguucgauaua

SEQ ID NO: 60775 - RNA, 48 nt, Artificial Sequence
  derived and/or modified sequence opt11 from anti-influenza_CDR
ggcggacacauaacagucuucggcgucaacauagacgccuucgacgua

SEQ ID NO: 60776 - RNA, 48 nt, Artificial Sequence
  derived and/or modified sequence opt11 from anti-influenza_CDR
gcgcgcgauggcuggggccagcaauuggucccguacuauuucgauuac

SEQ ID NO: 60777 - RNA, 48 nt, Artificial Sequence; identical to SEQ ID NO: 22567
  derived and/or modified sequence opt11 from anti-influenza_CDR

SEQ ID NO: 60778 - RNA, 48 nt, Artificial Sequence
  derived and/or modified sequence opt11 from anti-influenza_CDR
gcgagggcgggagugaaaauauucgggcugauaguaggggcauuggac

SEQ ID NO: 60779 - RNA, 48 nt, Artificial Sequence
  derived and/or modified sequence opt11 from anti-influenza_CDR
gcacgcgacggcgcaggcucauacuacccccuaaacugguucgacccc

SEQ ID NO: 60780 - RNA, 48 nt, Artificial Sequence
  derived and/or modified sequence opt11 from anti-influenza_CDR
gucauauacucgcacgggcgcgcguacuauagcgcgagcgugaacggg

SEQ ID NO: 60781 - RNA, 48 nt, Artificial Sequence; identical to SEQ ID NO: 22571
  derived and/or modified sequence opt11 from anti-influenza_CDR

SEQ ID NO: 60782 - RNA, 48 nt, Artificial Sequence
  derived and/or modified sequence opt11 from anti-influenza_CDR
uacaucuccuacaacggccgccccaaauacaaccccucccucaccucc

SEQ ID NO: 60783 - RNA, 48 nt, Artificial Sequence
  derived and/or modified sequence opt11 from anti-influenza_CDR
gagaccagguucggggaauugcucucgcccuaugacgcguucgagauc

SEQ ID NO: 60784 - RNA, 48 nt, Artificial Sequence
  derived and/or modified sequence opt11 from anti-influenza_CDR
cucauauacugggacgacgacaagcgcuacagcccgagccugaaaaga

SEQ ID NO: 60785 - RNA, 48 nt, Artificial Sequence
  derived and/or modified sequence opt11 from anti-influenza_CDR
uacaucuacuacaucggcaacaccgacuaccgccccucccucaaaucc

SEQ ID NO: 60786 - RNA, 48 nt, Artificial Sequence
  derived and/or modified sequence opt11 from anti-influenza_CDR
gaaaucucccacggcggcuccaccaacuacaaccccucccucaaaucc

SEQ ID NO: 60787 - RNA, 48 nt, Artificial Sequence
  derived and/or modified sequence opt11 from anti-influenza_CDR
gaaaucaaccacuccggccgcaccaacuacaaccccucccucaaaucc

SEQ ID NO: 60788 - RNA, 48 nt, Artificial Sequence
  derived and/or modified sequence opt11 from anti-influenza_CDR
cucaucuccugggacgacgaaaaacacuacucccccucccuccaaucc

SEQ ID NO: 60789 - RNA, 48 nt, Artificial Sequence
  derived and/or modified sequence opt11 from anti-influenza_CDR
gagggcguguacuuugacucgggcacguacaggggcuauuucgauuac

SEQ ID NO: 60790 - RNA, 48 nt, Artificial Sequence
  derived and/or modified sequence opt11 from anti-influenza_CDR
uacaucuaccacuccggcuccaccaacuacaaccccucccucaaaucc

SEQ ID NO: 60791 - RNA, 48 nt, Artificial Sequence
  derived and/or modified sequence opt11 from anti-influenza_CDR
uacaucuacuaccgcggcuccaccuucuacaaccccucccucaaaucc

SEQ ID NO: 60792 - RNA, 48 nt, Artificial Sequence
  derived and/or modified sequence opt11 from anti-influenza_CDR
uacaucuccuacuccggcuccaccaaauacaaccccucccuccgcucc

SEQ ID NO: 60793 - RNA, 48 nt, Artificial Sequence
  derived and/or modified sequence opt11 from anti-influenza_CDR
gaaaucaaacacuccggccgcaccaacuacaaccccucccucgaaucc

SEQ ID NO: 60794 - RNA, 48 nt, Artificial Sequence
  derived and/or modified sequence opt11 from anti-influenza_CDR
gaaaucaaccacuccggcggcaccaacuacaaccccucccucaaacgc

SEQ ID NO: 60795 - RNA, 48 nt, Artificial Sequence
  derived and/or modified sequence opt11 from anti-influenza_CDR
uucauguacuacuccgccuccaccuacuacaaccccucccucaaaucc

SEQ ID NO: 60796 - RNA, 48 nt, Artificial Sequence
  derived and/or modified sequence opt11 from anti-influenza_CDR
uacgucuacuacuccggcuccaccaccuacaaccccucccucaaaucc

SEQ ID NO: 60797 - RNA, 48 nt, Artificial Sequence; identical to SEQ ID NO: 22587
  derived and/or modified sequence opt11 from anti-influenza_CDR

SEQ ID NO: 60798 - RNA, 48 nt, Artificial Sequence
  derived and/or modified sequence opt11 from anti-influenza_CDR
uucaucuacuacggcggcaacaccaaauacaaccccucccucaaaucc

SEQ ID NO: 60799 - RNA, 48 nt, Artificial Sequence
  derived and/or modified sequence opt11 from anti-influenza_CDR
uucauguuccacuccggcuccccccgcuacaaccccacccucaaaucc

SEQ ID NO: 60800 - RNA, 48 nt, Artificial Sequence
  derived and/or modified sequence opt11 from anti-influenza_CDR
uucuucuacaacggcggcuccaccaaauacaaccccucccucaaaucc

SEQ ID NO: 60801 - RNA, 48 nt, Artificial Sequence
  derived and/or modified sequence opt11 from anti-influenza_CDR
cacaucuacgacuacggccgcaccuucuacaacuccucccuccaaucc

SEQ ID NO: 60802 - RNA, 48 nt, Artificial Sequence
  derived and/or modified sequence opt11 from anti-influenza_CDR
gucuucuacuccgaaacccgcaccuacuacgccgacuccgucaaaggc

SEQ ID NO: 60803 - RNA, 48 nt, Artificial Sequence
  derived and/or modified sequence opt11 from anti-influenza_CDR
uacgucuacaaccgcggcuccaccaaauacucccccucccucaaaucc

SEQ ID NO: 60804 - RNA, 48 nt, Artificial Sequence
  derived and/or modified sequence opt11 from anti-influenza_CDR
uacaucuacaaccgcggcuccaccaaauacacccccucccucaaaucc

SEQ ID NO: 60805 - RNA, 48 nt, Artificial Sequence
  derived and/or modified sequence opt11 from anti-influenza_CDR
uaccucuacuacuccggcuccaccaaauacaaccccucccucaaaucc

SEQ ID NO: 60806 - RNA, 48 nt, Artificial Sequence
  derived and/or modified sequence opt11 from anti-influenza_CDR
uacgucuacaacuccggcaacaccaaauacaaccccucccucaaaucc

SEQ ID NO: 60807 - RNA, 48 nt, Artificial Sequence
  derived and/or modified sequence opt11 from anti-influenza_CDR
cacaucuucgacuccggcuccaccuacuacaaccccucccucaaaucc

SEQ ID NO: 60808 - RNA, 48 nt, Artificial Sequence
  derived and/or modified sequence opt11 from anti-influenza_CDR
gucuucuacuccgccgaccgcaccuccuacgccgacuccgucaaaggc

SEQ ID NO: 60809 - RNA, 48 nt, Artificial Sequence
  derived and/or modified sequence opt11 from anti-influenza_CDR
uacaucuacuacuccggcaacaccuacuacaaccccucccucaaaucc

SEQ ID NO: 60810 - RNA, 48 nt, Artificial Sequence
  derived and/or modified sequence opt11 from anti-influenza_CDR
cgcuccucccaaucccuccuccacuccaacggcuacaacuaccucgac

SEQ ID NO: 60811 - RNA, 48 nt, Artificial Sequence
  derived and/or modified sequence opt11 from anti-influenza_CDR
accaucuaccacuccggcuccaccuacuacaaccccucccucaaaucc

SEQ ID NO: 60812 - RNA, 48 nt, Artificial Sequence
  derived and/or modified sequence opt11 from anti-influenza_CDR
cgcuccucccaaucccuccuccacuccaacggccacaucuacuucgac

SEQ ID NO: 60813 - RNA, 48 nt, Artificial Sequence
  derived and/or modified sequence opt11 from anti-influenza_CDR
aucuggggcguggccgcgcccucgaccgcgagcgcgcaaacgagcuug

SEQ ID NO: 60814 - RNA, 48 nt, Artificial Sequence
  derived and/or modified sequence opt11 from anti-influenza_CDR
cgcuccucccaaucccuccucuacaccgacggcuucaccuaccucucc

SEQ ID NO: 60815 - RNA, 48 nt, Artificial Sequence
  derived and/or modified sequence opt11 from anti-influenza_CDR
gccaaaccacgccuagacuaccucgacuacuuccacgccgccgacucc

SEQ ID NO: 60816 - RNA, 48 nt, Artificial Sequence
  derived and/or modified sequence opt11 from anti-influenza_CDR
gcccgcucccccgguuacuccggcuaucucuacggcugguucgacccc

SEQ ID NO: 60817 - RNA, 48 nt, Artificial Sequence
  derived and/or modified sequence opt11 from anti-influenza_CDR
gcgauagcgggcucgggaucggccgauuacgcgagcugggcaaaggga

SEQ ID NO: 60818 - RNA, 48 nt, Artificial Sequence
  derived and/or modified sequence opt11 from anti-influenza_CDR
gcgauagcgggcucgggaucggccgauuacgcgagcugggcaaagagc

SEQ ID NO: 60819 - RNA, 48 nt, Artificial Sequence
  derived and/or modified sequence opt11 from anti-influenza_CDR
gcgauaggggggggggggagugcggauuaugcgaguugggcgaagagu

SEQ ID NO: 60820 - RNA, 48 nt, Artificial Sequence
  derived and/or modified sequence opt11 from anti-influenza_CDR
cgcuccucccaaucccuccuccgcuccaacggcuacaacuaccucgac

SEQ ID NO: 60821 - RNA, 48 nt, Artificial Sequence
  derived and/or modified sequence opt11 from anti-influenza_CDR
caaggcgaccacauagccuggcuccuccgcggaaucaacuucgacuac

SEQ ID NO: 60822 - RNA, 51 nt, Artificial Sequence
  derived and/or modified sequence opt11 from anti-influenza_CDR
gcccgacucggcuccggcucauaccacaacggccccaacugguucgaccca

SEQ ID NO: 60823 - RNA, 51 nt, Artificial Sequence
  derived and/or modified sequence opt11 from anti-influenza_CDR
gcccgcgccgaaaaccuccucucccccuaccucgccgaaggcuucgaccca

SEQ ID NO: 60824 - RNA, 51 nt, Artificial Sequence
  derived and/or modified sequence opt11 from anti-influenza_CDR
gugaucucguacgauggcucgaacaaguacuaugccgauagcgugaaaggg

SEQ ID NO: 60825 - RNA, 51 nt, Artificial Sequence
  derived and/or modified sequence opt11 from anti-influenza_CDR
ggcacaaucccgcuccugggcacgaccaacuacgcacaaaaauuccagggc

SEQ ID NO: 60826 - RNA, 51 nt, Artificial Sequence
  derived and/or modified sequence opt11 from anti-influenza_CDR
ggcauaaucgcggucuucaacacggccaacuacgcgcaaaaguuccagggc

SEQ ID NO: 60827 - RNA, 51 nt, Artificial Sequence
  derived and/or modified sequence opt11 from anti-influenza_CDR
aauauagaggacgaugggggggacaaguacuauguggauagcgugaagggg

SEQ ID NO: 60828 - RNA, 51 nt, Artificial Sequence
  derived and/or modified sequence opt11 from anti-influenza_CDR
uggauaaacccgaacucgggcacgaccgggagcgcgcaaagguuccagggc

SEQ ID NO: 60829 - RNA, 51 nt, Artificial Sequence
  derived and/or modified sequence opt11 from anti-influenza_CDR
ggcaucaaccccgucuucggccgcccccacuacgcccaaaaauuccaaggc

SEQ ID NO: 60830 - RNA, 51 nt, Artificial Sequence
  derived and/or modified sequence opt11 from anti-influenza_CDR
ggcaucaucccccucaucaacgcccccaacuacgcccccaaauuccaaggc

SEQ ID NO: 60831 - RNA, 51 nt, Artificial Sequence
  derived and/or modified sequence opt11 from anti-influenza_CDR
ggcauaaucccgaugaugggcacggucaacuacgcgcaaaagcuccagggc

SEQ ID NO: 60832 - RNA, 51 nt, Artificial Sequence
  derived and/or modified sequence opt11 from anti-influenza_CDR
ggcauaaucccgcucuucggcgcggccaaguacgcgcaaaaauuccagggc

SEQ ID NO: 60833 - RNA, 51 nt, Artificial Sequence
  derived and/or modified sequence opt11 from anti-influenza_CDR
aaauccucccaacgcguccucuacuccuccaacaacaaaaacuaccucgcc

SEQ ID NO: 60834 - RNA, 51 nt, Artificial Sequence
  derived and/or modified sequence opt11 from anti-influenza_CDR
uugaucucggacgauggcucgaacaaguucuaugccgauagcgugaaaggg

SEQ ID NO: 60835 - RNA, 51 nt, Artificial Sequence
  derived and/or modified sequence opt11 from anti-influenza_CDR
auaauaagcuacgacgggaacgaccaauacuacacggacucggucaagggc

SEQ ID NO: 60836 - RNA, 51 nt, Artificial Sequence
  derived and/or modified sequence opt11 from anti-influenza_CDR
uggaucuccaccuacaacggcaacaccaacuucgcccaaaacuuccaaggc

SEQ ID NO: 60837 - RNA, 51 nt, Artificial Sequence
  derived and/or modified sequence opt11 from anti-influenza_CDR
gucgaaggcagcuaccgcgacuucuggaacaaccaaaaccgcuucgaccca

SEQ ID NO: 60838 - RNA, 51 nt, Artificial Sequence
  derived and/or modified sequence opt11 from anti-influenza_CDR
uggaucaaccccaacucaggcgacaccaacuacgcccaaaaauuccaaggc

SEQ ID NO: 60839 - RNA, 51 nt, Artificial Sequence
  derived and/or modified sequence opt11 from anti-influenza_CDR
aaauccucccaauccguccucuacuccuccaacaacaaaucccaccucgcc

SEQ ID NO: 60840 - RNA, 51 nt, Artificial Sequence
  derived and/or modified sequence opt11 from anti-influenza_CDR
aucaucuaccccggcgacuccgacacccgcuacucccccuccuuccaaggc

SEQ ID NO: 60841 - RNA, 51 nt, Artificial Sequence
  derived and/or modified sequence opt11 from anti-influenza_CDR
ggcaucauccccgucuuccccacccccaacuacgcccaaauguuccaaggc

SEQ ID NO: 60842 - RNA, 51 nt, Artificial Sequence
  derived and/or modified sequence opt11 from anti-influenza_CDR
ggaaucguccccgucuucggcaccgccaacuacgcccaaaaauuccaaggc

SEQ ID NO: 60843 - RNA, 51 nt, Artificial Sequence
  derived and/or modified sequence opt11 from anti-influenza_CDR
uggauaaacccggaaucgggcgacaccaaguacgcgcaaaaauuccagggc

SEQ ID NO: 60844 - RNA, 51 nt, Artificial Sequence
  derived and/or modified sequence opt11 from anti-influenza_CDR
cgcuccucccaauccaucuuccacaacuccaacaacgaaaacuaccucgcc

SEQ ID NO: 60845 - RNA, 51 nt, Artificial Sequence
  derived and/or modified sequence opt11 from anti-influenza_CDR
uggauaaacgcgaaaaggggcgggaccaauuacgcgcaaaaguuccagggc

SEQ ID NO: 60846 - RNA, 51 nt, Artificial Sequence
  derived and/or modified sequence opt11 from anti-influenza_CDR
uggaucaaccccgacuccggcgccaccucauccgcccaaaacuuccaaggc

SEQ ID NO: 60847 - RNA, 51 nt, Artificial Sequence
  derived and/or modified sequence opt11 from anti-influenza_CDR
uggauaagcccggacucggacgcgaccaaguacgcgcaaaaguuccagggc

SEQ ID NO: 60848 - RNA, 51 nt, Artificial Sequence
  derived and/or modified sequence opt11 from anti-influenza_CDR
aacauaaaacaggacgggcgcgagaaauauuacguggacucgcucaggggc

SEQ ID NO: 60849 - RNA, 51 nt, Artificial Sequence
  derived and/or modified sequence opt11 from anti-influenza_CDR
ggcauaaucgcgaucuuuggcacgcccaaguacgcgcaaaaguuccagggc

SEQ ID NO: 60850 - RNA, 51 nt, Artificial Sequence; identical to SEQ ID NO: 53208
  derived and/or modified sequence opt11 from anti-influenza_CDR

SEQ ID NO: 60851 - RNA, 51 nt, Artificial Sequence
  derived and/or modified sequence opt11 from anti-influenza_CDR
uggauaagcgcauacaacggcaacaccaacuacgcacaaaaauuccagggc

SEQ ID NO: 60852 - RNA, 51 nt, Artificial Sequence
  derived and/or modified sequence opt11 from anti-influenza_CDR
ggcgucauccccaucuuccgcaccgccaacuacgcccaaaacuuccaaggc

SEQ ID NO: 60853 - RNA, 51 nt, Artificial Sequence
  derived and/or modified sequence opt11 from anti-influenza_CDR
ggcauaaucgcgaucuuucacacgcccaaguacgcgcaaaaguuccagggc

SEQ ID NO: 60854 - RNA, 51 nt, Artificial Sequence
  derived and/or modified sequence opt11 from anti-influenza_CDR
ggcaucucccccauguucggcaccaccaccuacgcccaaaaauuccaaggc

SEQ ID NO: 60855 - RNA, 51 nt, Artificial Sequence
  derived and/or modified sequence opt11 from anti-influenza_CDR
aagagcucgcaaucgguccuguacucgagcaauaacaagaacuaucucgcg

SEQ ID NO: 60856 - RNA, 51 nt, Artificial Sequence
  derived and/or modified sequence opt11 from anti-influenza_CDR
ggcaucauccccaucuucggcaccaccaaauacgcccccaaauuccaaggc

SEQ ID NO: 60857 - RNA, 51 nt, Artificial Sequence
  derived and/or modified sequence opt11 from anti-influenza_CDR
ggcaucuccccccucuucggcaccaccaacuacgcccaaaaauuccaaggc

SEQ ID NO: 60858 - RNA, 51 nt, Artificial Sequence
  derived and/or modified sequence opt11 from anti-influenza_CDR
ggaauaauggggauguucgggacgacaaacuacgcgcagaaguuccaggga

SEQ ID NO: 60859 - RNA, 51 nt, Artificial Sequence
  derived and/or modified sequence opt11 from anti-influenza_CDR
gggaucauaggcauguucgggagcacgaacuaugcccagaacuuucaaggg

SEQ ID NO: 60860 - RNA, 51 nt, Artificial Sequence
  derived and/or modified sequence opt11 from anti-influenza_CDR
uggaucaaccccaacucaggcggcaccaacuacgcccaaaaauuccaaggc

SEQ ID NO: 60861 - RNA, 51 nt, Artificial Sequence
  derived and/or modified sequence opt11 from anti-influenza_CDR
gcgaucucgagcucgggcgauagcacguacuaugccgauagcgugaaaggg

SEQ ID NO: 60862 - RNA, 51 nt, Artificial Sequence
  derived and/or modified sequence opt11 from anti-influenza_CDR
uccaucuccuccuccuccuccuacaucuacuacgucgacuccgucaaaggc

SEQ ID NO: 60863 - RNA, 51 nt, Artificial Sequence
  derived and/or modified sequence opt11 from anti-influenza_CDR
gacaucauaggcauguucgggagcacgaacuaugcccagaacuuccaaggg

SEQ ID NO: 60864 - RNA, 51 nt, Artificial Sequence
  derived and/or modified sequence opt11 from anti-influenza_CDR
ggcaucauccccauguucggcaccaccaacuacgcccaaaaauuccaaggc

SEQ ID NO: 60865 - RNA, 51 nt, Artificial Sequence
  derived and/or modified sequence opt11 from anti-influenza_CDR
ggcaucaucgccaucuucggcaccgccaacuacgcccaaaaauuccaaggc

SEQ ID NO: 60866 - RNA, 51 nt, Artificial Sequence
  derived and/or modified sequence opt11 from anti-influenza_CDR
ggcaucauccccaucuucggcaccaccaacuacgcccaaaaauuccaaggc

SEQ ID NO: 60867 - RNA, 51 nt, Artificial Sequence
  derived and/or modified sequence opt11 from anti-influenza_CDR
ggcauauucgcgcucuuuggcacgaccgauuacgcgcaaaaguuccagggc

SEQ ID NO: 60868 - RNA, 51 nt, Artificial Sequence
  derived and/or modified sequence opt11 from anti-influenza_CDR
ggaauaaucgggauguucggcacggccaacuacgcgcaaaaguuccagggc

SEQ ID NO: 60869 - RNA, 51 nt, Artificial Sequence
  derived and/or modified sequence opt11 from anti-influenza_CDR
ggcauaaucgcggucuuuggcacgaccaaguacgcgcacaaguuccagggc

SEQ ID NO: 60870 - RNA, 51 nt, Artificial Sequence
  derived and/or modified sequence opt11 from anti-influenza_CDR
ggcauacucggggucuuuggcucgcccucguacgcgcaaaaguuccagggc

SEQ ID NO: 60871 - RNA, 51 nt, Artificial Sequence
  derived and/or modified sequence opt11 from anti-influenza_CDR
ggcaucuucggcauguucggcaccgccaacuacgcccaaaaauuccaaggc

SEQ ID NO: 60872 - RNA, 51 nt, Artificial Sequence
  derived and/or modified sequence opt11 from anti-influenza_CDR
uggauaagcgcguacacgggcgauaccgauuacgcgcaaaaguuccagggc

SEQ ID NO: 60873 - RNA, 51 nt, Artificial Sequence
  derived and/or modified sequence opt11 from anti-influenza_CDR
agcuucgacccggaagacggcgagaccauauacgcacaaaaauuccagggc

SEQ ID NO: 60874 - RNA, 51 nt, Artificial Sequence
  derived and/or modified sequence opt11 from anti-influenza_CDR
gggaucucgggcucgggcgagagcacguacuaugccgauagcgugaaaggg

SEQ ID NO: 60875 - RNA, 51 nt, Artificial Sequence
  derived and/or modified sequence opt11 from anti-influenza_CDR
guggucucguacgauggcaauuacaaguacuaugccgauagcgugcaaggg

SEQ ID NO: 60876 - RNA, 51 nt, Artificial Sequence
  derived and/or modified sequence opt11 from anti-influenza_CDR
ggcuccaucuccuacuccggcuccaccuacuaccaccccucccucaaaucc

SEQ ID NO: 60877 - RNA, 51 nt, Artificial Sequence
  derived and/or modified sequence opt11 from anti-influenza_CDR
acgagagggaggccgauagggagaaauugggagccgagggacaaggacuau

SEQ ID NO: 60878 - RNA, 51 nt, Artificial Sequence
  derived and/or modified sequence opt11 from anti-influenza_CDR
gcgcgcgaggccggguaccauagcucguucucgggcguguacuuugacuau

SEQ ID NO: 60879 - RNA, 51 nt, Artificial Sequence
  derived and/or modified sequence opt11 from anti-influenza_CDR
cgaauagacccgaacgggagcgggaccacguacgcgcaaaaguuccagggc

SEQ ID NO: 60880 - RNA, 51 nt, Artificial Sequence
  derived and/or modified sequence opt11 from anti-influenza_CDR
cgaauagacccgaacggggccgggaccacguacgcgcaaaaauuccagggc

SEQ ID NO: 60881 - RNA, 51 nt, Artificial Sequence
  derived and/or modified sequence opt11 from anti-influenza_CDR
uggaucgaccccaacaacgacggcaccauauacgcccaaaaauuccaaggc

SEQ ID NO: 60882 - RNA, 51 nt, Artificial Sequence
  derived and/or modified sequence opt11 from anti-influenza_CDR
augauguaccccggcgacuccgacaccaucuacucacccuccuuccaaggc

SEQ ID NO: 60883 - RNA, 51 nt, Artificial Sequence
  derived and/or modified sequence opt11 from anti-influenza_CDR
augauguaccccggcgacgccgacgccaucuacucacccuccuuccaaggc

SEQ ID NO: 60884 - RNA, 51 nt, Artificial Sequence
  derived and/or modified sequence opt11 from anti-influenza_CDR
augauguacccgggcgagagcgagaccauauacucgcccucauuccagggc

SEQ ID NO: 60885 - RNA, 51 nt, Artificial Sequence
  derived and/or modified sequence opt11 from anti-influenza_CDR
augauguaccccggcgacgccgacaccauauacucacccuccuuccaaggc

SEQ ID NO: 60886 - RNA, 51 nt, Artificial Sequence
  derived and/or modified sequence opt11 from anti-influenza_CDR
augauguaccccggcuccuccgacaccaucuacucccccuccuuccaaggc

SEQ ID NO: 60887 - RNA, 51 nt, Artificial Sequence
  derived and/or modified sequence opt11 from anti-influenza_CDR
augauguaccccggcgacuccgacgccaucuacucacccuccuuccaaggc

SEQ ID NO: 60888 - RNA, 51 nt, Artificial Sequence
  derived and/or modified sequence opt11 from anti-influenza_CDR
augauguaccccggcgacaccgacaccauauacucacccuccuuccaaggc

SEQ ID NO: 60889 - RNA, 51 nt, Artificial Sequence
  derived and/or modified sequence opt11 from anti-influenza_CDR
augauguacccgggcgaaagcgacaccauauacucgcccucauuccagggc

SEQ ID NO: 60890 - RNA, 51 nt, Artificial Sequence
  derived and/or modified sequence opt11 from anti-influenza_CDR
guaauaagcugggacucgggaaggauaggguacgcggacucgguaaaggga

SEQ ID NO: 60891 - RNA, 51 nt, Artificial Sequence; identical to SEQ ID NO: 22681
  derived and/or modified sequence opt11 from anti-influenza_CDR

SEQ ID NO: 60892 - RNA, 51 nt, Artificial Sequence; identical to SEQ ID NO: 22682
  derived and/or modified sequence opt11 from anti-influenza_CDR

SEQ ID NO: 60893 - RNA, 51 nt, Artificial Sequence
  derived and/or modified sequence opt11 from anti-influenza_CDR
auaauaaguugggauagcgggaggauaggguaugcggauagcgugaggggg

SEQ ID NO: 60894 - RNA, 51 nt, Artificial Sequence
  derived and/or modified sequence opt11 from anti-influenza_CDR
cacgggggcguguacuauuacgggagcgcgagcucgggcugguucgauccc

SEQ ID NO: 60895 - RNA, 54 nt, Artificial Sequence
  derived and/or modified sequence opt11 from anti-influenza_CDR
cgcacguacuaccgcucgaaaugguacaaugacuacgccgagagcgugaaaucg

SEQ ID NO: 60896 - RNA, 54 nt, Artificial Sequence
  derived and/or modified sequence opt11 from anti-influenza_CDR
cgcaccuacuaccgcuccaaaugguacuacgacuacgccgaauccgucaaaucc

SEQ ID NO: 60897 - RNA, 54 nt, Artificial Sequence
  derived and/or modified sequence opt11 from anti-influenza_CDR
cgcaccuacuaccgcuccaaaugguacaacgacuacgccgucuccgucaaaucc

SEQ ID NO: 60898 - RNA, 54 nt, Artificial Sequence
  derived and/or modified sequence opt11 from anti-influenza_CDR
cgcaccuacuaccgcuccaaaugguacaacgacuacgccgacuuccucaaacgc

SEQ ID NO: 60899 - RNA, 54 nt, Artificial Sequence
  derived and/or modified sequence opt11 from anti-influenza_CDR
aggacauauuacaggagcgggugguauaacgauuacgcggaaucggucaagagc

SEQ ID NO: 60900 - RNA, 54 nt, Artificial Sequence
  derived and/or modified sequence opt11 from anti-influenza_CDR
gcgcgcuugggcgggaacaaggacuauggcgauuacuugugguauuucgaucuc

SEQ ID NO: 60901 - RNA, 54 nt, Artificial Sequence
  derived and/or modified sequence opt11 from anti-influenza_CDR
gcaaaagacaccgcagaccacggcgacuacguagaccuaggcuucuucgacgcc

SEQ ID NO: 60902 - RNA, 54 nt, Artificial Sequence
  derived and/or modified sequence opt11 from anti-influenza_CDR
gcgcgcucgggcauauucgauuggucggccccgcucguggaagcguucgauauc

SEQ ID NO: 60903 - RNA, 54 nt, Artificial Sequence
  derived and/or modified sequence opt11 from anti-influenza_CDR
gccaggcacgcgagcuguagcgcgagaucgugcuauugggggccaguggacuau

SEQ ID NO: 60904 - RNA, 54 nt, Artificial Sequence
  derived and/or modified sequence opt11 from anti-influenza_CDR
gacgccccccccaacgucgaagucgccuccaugaccaacugguacuucgaccuc

SEQ ID NO: 60905 - RNA, 54 nt, Artificial Sequence
  derived and/or modified sequence opt11 from anti-influenza_CDR
cuacgcacagacuacggcgaccccgacucagucuacuacuacggaauggacguc

SEQ ID NO: 60906 - RNA, 54 nt, Artificial Sequence
  derived and/or modified sequence opt11 from anti-influenza_CDR
ggcacaugcgcaggcgacugcucacuccacuacuacuacuacggccuggacgua

SEQ ID NO: 60907 - RNA, 54 nt, Artificial Sequence
  derived and/or modified sequence opt11 from anti-influenza_CDR
cacgucuccgucucccacggcggccgcacaaaaucaaaccccuccgucauguca

SEQ ID NO: 60908 - RNA, 54 nt, Artificial Sequence
  derived and/or modified sequence opt11 from anti-influenza_CDR
gcgcucauauacuuugacgggagcaagcaauacuacgcggacucggucaagggc

SEQ ID NO: 60909 - RNA, 54 nt, Artificial Sequence
  derived and/or modified sequence opt11 from anti-influenza_CDR
acccuaaucuccuacgacggcgccaaccaauacuacgccgacuccgucaaaggc

SEQ ID NO: 60910 - RNA, 54 nt, Artificial Sequence; identical to SEQ ID NO: 22700
  derived and/or modified sequence opt11 from anti-influenza_CDR

SEQ ID NO: 60911 - RNA, 54 nt, Artificial Sequence
  derived and/or modified sequence opt11 from anti-influenza_CDR
gggggcauaaucccgaucuuuggcgcggccaauuacgcgcaaaaguuccagggc

SEQ ID NO: 60912 - RNA, 54 nt, Artificial Sequence
  derived and/or modified sequence opt11 from anti-influenza_CDR
ggauggauaagcgcauacacaggcaacacccacuacgcaaaaaacuucgaaggc

SEQ ID NO: 60913 - RNA, 54 nt, Artificial Sequence
  derived and/or modified sequence opt11 from anti-influenza_CDR
ggguggauaaacccgaacuuuggcgggacccauuacgcgcgcaaguuccagggc

SEQ ID NO: 60914 - RNA, 54 nt, Artificial Sequence
  derived and/or modified sequence opt11 from anti-influenza_CDR
gugagguggagggcggcggcggugauaauggaucaguuuuauaagauggaugug

SEQ ID NO: 60915 - RNA, 54 nt, Artificial Sequence; identical to SEQ ID NO: 22705
  derived and/or modified sequence opt11 from anti-influenza_CDR

SEQ ID NO: 60916 - RNA, 54 nt, Artificial Sequence
  derived and/or modified sequence opt11 from anti-influenza_CDR
gccgccuccaccgccaccucaggcaccuacuacgccaugcgcccauucgacuuc

SEQ ID NO: 60917 - RNA, 57 nt, Artificial Sequence
  derived and/or modified sequence opt11 from anti-influenza_CDR
gcgcgcgggaaaaggcccggguacuguagcgggggcgugugcucgagcgauuacugg

SEQ ID NO: 60918 - RNA, 57 nt, Artificial Sequence
  derived and/or modified sequence opt11 from anti-influenza_CDR
gcccgccacuaccccuacuacgaccuccccaccggcuucuacucccaauucgacuuc

SEQ ID NO: 60919 - RNA, 57 nt, Artificial Sequence
  derived and/or modified sequence opt11 from anti-influenza_CDR
gggucggggggguaugggggguuugauuauuuugggaaguugaggacgugggauuuu

SEQ ID NO: 60920 - RNA, 57 nt, Artificial Sequence
  derived and/or modified sequence opt11 from anti-influenza_CDR
uucauaagaacgagaccguggggagggacggcagauaccgcggccucggucaagggc

SEQ ID NO: 60921 - RNA, 57 nt, Artificial Sequence; identical to SEQ ID NO: 22711
  derived and/or modified sequence opt11 from anti-influenza_CDR

SEQ ID NO: 60922 - RNA, 57 nt, Artificial Sequence
  derived and/or modified sequence opt11 from anti-influenza_CDR
gucaaagacggcuacugcacacucaccuccugccccgucggcugguacuucgaccua

SEQ ID NO: 60923 - RNA, 57 nt, Artificial Sequence; identical to SEQ ID NO: 22713
  derived and/or modified sequence opt11 from anti-influenza_CDR

SEQ ID NO: 60924 - RNA, 57 nt, Artificial Sequence
  derived and/or modified sequence opt11 from anti-influenza_CDR
gcgcgcgcgaugauacaaggggucgugaccuuguacuugcgcccgggcgauuacugg

SEQ ID NO: 60925 - RNA, 57 nt, Artificial Sequence
  derived and/or modified sequence opt11 from anti-influenza_CDR
gcgaaagugggcccguacacgggcuaugacgauuacaauuacuauggcauggacgug

SEQ ID NO: 60926 - RNA, 57 nt, Artificial Sequence
  derived and/or modified sequence opt11 from anti-influenza_CDR
gccaaggucgagagaucguucuaugacgggagcggguacggggacgcgcuagagaua

SEQ ID NO: 60927 - RNA, 57 nt, Artificial Sequence
  derived and/or modified sequence opt11 from anti-influenza_CDR
uauugcgcgcgcgggcgagugaacucgggcuaugacuggggcccgaacuuugacucg

SEQ ID NO: 60928 - RNA, 57 nt, Artificial Sequence
  derived and/or modified sequence opt11 from anti-influenza_CDR
uuuugcgcgcgcgggagcccgaacucgggcuaugacuggggcccgcacuuugacuau

SEQ ID NO: 60929 - RNA, 57 nt, Artificial Sequence
  derived and/or modified sequence opt11 from anti-influenza_CDR
agaauaaaaucgaacacggacgggggcacgacagauuacgcggccccggucaagggc

SEQ ID NO: 60930 - RNA, 57 nt, Artificial Sequence
  derived and/or modified sequence opt11 from anti-influenza_CDR
cuccgccuccaaggcgaagucgucgucccccccucccaauccaacugguucgacccc

SEQ ID NO: 60931 - RNA, 60 nt, Artificial Sequence
  derived and/or modified sequence opt11 from anti-influenza_CDR
gcgaaagagggcgggaacacgaucuuuggcuuggucacgauggcguacuauuucgauagc

SEQ ID NO: 60932 - RNA, 60 nt, Artificial Sequence
  derived and/or modified sequence opt11 from anti-influenza_CDR
gcgcgcgcgggcggggacucgagcggguacuauggcgcgcucgggcgauuuuuccagcac

SEQ ID NO: 60933 - RNA, 60 nt, Artificial Sequence
  derived and/or modified sequence opt11 from anti-influenza_CDR
gcgaaagauagcaggggcuauugcucgagcauaaucuguuucgagggcgggcucgauaac

SEQ ID NO: 60934 - RNA, 60 nt, Artificial Sequence; identical to SEQ ID NO: 22724
  derived and/or modified sequence opt11 from anti-influenza_CDR

SEQ ID NO: 60935 - RNA, 60 nt, Artificial Sequence
  derived and/or modified sequence opt11 from anti-influenza_CDR
ggcacagacccagacaccgaaguauacugccgagucggaaacugcgcagccuucgacuac

SEQ ID NO: 60936 - RNA, 60 nt, Artificial Sequence; identical to SEQ ID NO: 22726
  derived and/or modified sequence opt11 from anti-influenza_CDR

SEQ ID NO: 60937 - RNA, 60 nt, Artificial Sequence
  derived and/or modified sequence opt11 from anti-influenza_CDR
gggaccgaucccgauaccgagggcuauugcaggagcgggagcuguagcgcguucgauuuc

SEQ ID NO: 60938 - RNA, 60 nt, Artificial Sequence
  derived and/or modified sequence opt11 from anti-influenza_CDR
ggcacggacccggacacggaaguguacugccgagcgggaaauugcgcggccuuugacuuu

SEQ ID NO: 60939 - RNA, 60 nt, Artificial Sequence
  derived and/or modified sequence opt11 from anti-influenza_CDR
aggggcgggcacucguucggguacgggagcgggggcgauacacauagcgaguucgauagc

SEQ ID NO: 60940 - RNA, 60 nt, Artificial Sequence
  derived and/or modified sequence opt11 from anti-influenza_CDR
cauaugaguaugcagcagguggugagugcggggugggagagggcggauuuggugggggau

SEQ ID NO: 60941 - RNA, 60 nt, Artificial Sequence
  derived and/or modified sequence opt11 from anti-influenza_CDR
gacucccgccuccgcucccuccucuacuucgaauggcucucccaaggcuacuucaacccc

SEQ ID NO: 60942 - RNA, 60 nt, Artificial Sequence
  derived and/or modified sequence opt11 from anti-influenza_CDR
gcccgccaccucggccaacaacucgucuccaacaccuacuacuacuacggcauggacguc

SEQ ID NO: 60943 - RNA, 63 nt, Artificial Sequence
  derived and/or modified sequence opt11 from anti-influenza_CDR
acgacagggggaacgacaacgugcacggcagcgggauguggagggggauguugcacgugcugu

SEQ ID NO: 60944 - RNA, 63 nt, Artificial Sequence
  derived and/or modified sequence opt11 from anti-influenza_CDR
gcccgcgccgccgacgaaucagucgaaucccucaccauaaaagccuuccgaaccaacuaccac

SEQ ID NO: 60945 - RNA, 63 nt, Artificial Sequence; identical to SEQ ID NO: 22735
  derived and/or modified sequence opt11 from anti-influenza_CDR

SEQ ID NO: 60946 - RNA, 63 nt, Artificial Sequence
  derived and/or modified sequence opt11 from anti-influenza_CDR
gacaugcucgcguacuauagcgauaacucgggcaagaaauauaacguguacgggauggacguc

SEQ ID NO: 60947 - RNA, 63 nt, Artificial Sequence
  derived and/or modified sequence opt11 from anti-influenza_CDR
gacaugcucgcguacuacuacgacggcucgggcauacgcuauaaccuguacgggauggacguc

SEQ ID NO: 60948 - RNA, 66 nt, Artificial Sequence
  derived and/or modified sequence opt11 from anti-influenza_CDR
gccaaagacccccgccuccgccaccuccucuacuuccccuucaccuccaugaucuacuucgacuac

SEQ ID NO: 60949 - RNA, 66 nt, Artificial Sequence
  derived and/or modified sequence opt11 from anti-influenza_CDR
gccaaagacucccaacuccgcucccuccucuacuucgaauggcucucccaaggcuacuucgacccc

SEQ ID NO: 60950 - RNA, 66 nt, Artificial Sequence
  derived and/or modified sequence opt11 from anti-influenza_CDR
gccaaagacucccaacuccgcucccuccucuacuucgaauggcucucccaaggcuacuucgacuac

SEQ ID NO: 60951 - RNA, 66 nt, Artificial Sequence
  derived and/or modified sequence opt11 from anti-influenza_CDR
gccaaagacucccaacuccgcucccuccucuacuucgaauggcucucccaaggcuacuucgaaccc

SEQ ID NO: 60952 - RNA, 66 nt, Artificial Sequence
  derived and/or modified sequence opt11 from anti-influenza_CDR
gcgaaagagcgcccgcucaggcucuugcgcuauuucgauugguugagcgggggcgcgaacgauuac

SEQ ID NO: 60953 - RNA, 66 nt, Artificial Sequence; identical to SEQ ID NO: 22743
  derived and/or modified sequence opt11 from anti-influenza_CDR

SEQ ID NO: 60954 - RNA, 66 nt, Artificial Sequence
  derived and/or modified sequence opt11 from anti-influenza_CDR
gcgcgcgauggcagggaaggguacuuuuacgggagcgggagcuuuuacaaucucaagggcuugaac

SEQ ID NO: 60955 - RNA, 66 nt, Artificial Sequence
  derived and/or modified sequence opt11 from anti-influenza_CDR
agcacggacaggggacauguauugagauauuucggguggaugcugccgggagaugcauuugacgug

SEQ ID NO: 60956 - RNA, 66 nt, Artificial Sequence
  derived and/or modified sequence opt11 from anti-influenza_CDR
cucaacuacuacgaccgcuccggcuaccacucacccgacggcccauccaacaacugguucgacccc

SEQ ID NO: 60957 - RNA, 66 nt, Artificial Sequence
  derived and/or modified sequence opt11 from anti-influenza_CDR
gcccgcgucccccgcgaccgccuccucacccucuacuacgaauccuccaccuacggcuucgacuac

SEQ ID NO: 60958 - RNA, 66 nt, Artificial Sequence
  derived and/or modified sequence opt11 from anti-influenza_CDR
gcgcgcaagugggggcgcaugaccguguucggggucgcgaccgaucaauuguacuauuucgauuac

SEQ ID NO: 60959 - RNA, 66 nt, Artificial Sequence
  derived and/or modified sequence opt11 from anti-influenza_CDR
gcgacggauauagugguggagagggaugcgagucuggggggguuuaauaguuaugggauggaugug

SEQ ID NO: 60960 - RNA, 69 nt, Artificial Sequence
  derived and/or modified sequence opt11 from anti-influenza_CDR
gcccgcaaccucccagacaucgccgucgucacagccguccaagacgccacccccgucugguucgaccca

SEQ ID NO: 60961 - RNA, 69 nt, Artificial Sequence
  derived and/or modified sequence opt11 from anti-influenza_CDR
gauggcccguacucggacgauuucaggagcggguacgcggccagguacagguacuuuggcauggacgug

SEQ ID NO: 60962 - RNA, 72 nt, Artificial Sequence
  derived and/or modified sequence opt11 from anti-influenza_CDR
gggcgcgagcucuugcgcuugcaacauuucuugaccgauagccagagcgagcgcagggacuguuucgauccc

SEQ ID NO: 60963 - RNA, 72 nt, Artificial Sequence
  derived and/or modified sequence opt11 from anti-influenza_CDR
augagccugcuaacggaaguggaaacgcccacgcgcaaugaauggggcugccgcuguaacgacagcucggac

SEQ ID NO: 60964 - RNA, 72 nt, Artificial Sequence
  derived and/or modified sequence opt11 from anti-influenza_CDR
augucgcucuugaccgaggucgagaccccgaccaagaacgagugggagugcaggugcaaugacucgagcgau

SEQ ID NO: 60965 - RNA, 72 nt, Artificial Sequence
  derived and/or modified sequence opt11 from anti-influenza_CDR
augagccugcugacggaaguggagacgccgauaagaaacgaaugggaaugcagaugcaacgacagcagcgac

SEQ ID NO: 60966 - RNA, 72 nt, Artificial Sequence
  derived and/or modified sequence opt11 from anti-influenza_CDR
augucgcucuugaccgaggucgagaccccgaucaggaacgggugggagugcaagugcaaugacucgagcgau

SEQ ID NO: 60967 - RNA, 72 nt, Artificial Sequence
  derived and/or modified sequence opt11 from anti-influenza_CDR
augucgcucuugaccgaggucgagaccccgaucaggagcgagugggggugcaggugcaaugacucgagcgau

SEQ ID NO: 60968 - RNA, 72 nt, Artificial Sequence
  derived and/or modified sequence opt11 from anti-influenza_CDR
auguccuuccuccccgaagucgaaacccccauccgcaacgaauggggcugccgcugcaacgacuccuccgac

SEQ ID NO: 60969 - RNA, 72 nt, Artificial Sequence
  derived and/or modified sequence opt11 from anti-influenza_CDR
augucccuccucaccgaagucgaaacccccauccgcaacgaauggggcugccgcugcaacgacuccuccaac

SEQ ID NO: 60970 - RNA, 72 nt, Artificial Sequence
  derived and/or modified sequence opt11 from anti-influenza_CDR
augagccugcugacggaaguggagacgccgauaagaaaggaauggggaugcagaugcaacgacagcagcgac

SEQ ID NO: 60971 - RNA, 72 nt, Artificial Sequence
  derived and/or modified sequence opt11 from anti-influenza_CDR
auguccuuccucaccgaagucgaaacccccauccgcaacgaauggggcugccgcugcaacgacuccuccgac

SEQ ID NO: 60972 - RNA, 72 nt, Artificial Sequence
  derived and/or modified sequence opt11 from anti-influenza_CDR
augucgcucccgaccgaggucgagaccccgaucaggagcgagugggggugcaggugcaaugacucgagcgau

SEQ ID NO: 60973 - RNA, 72 nt, Artificial Sequence
  derived and/or modified sequence opt11 from anti-influenza_CDR
augucgcucuugcccgaggucgagaccccgaucaggaacgagugggggugcaggugcaaugacucgagcgau

SEQ ID NO: 60974 - RNA, 72 nt, Artificial Sequence
  derived and/or modified sequence opt11 from anti-influenza_CDR
augucgcucuugcccgaggucgagacaccgaucaggaacgggugggggugcaggugcaaugacucgagcgau

SEQ ID NO: 60975 - RNA, 72 nt, Artificial Sequence
  derived and/or modified sequence opt11 from anti-influenza_CDR
augucgcucuugaccgaggucgagaccccgaccaggaacgggugggagugcaggugcucgggcucgagcgau

SEQ ID NO: 60976 - RNA, 72 nt, Artificial Sequence
  derived and/or modified sequence opt11 from anti-influenza_CDR
augucccuccucaccgaagucgaaacccccauccgcaacgaaugggaauaccgcugcaacgacuccuccgac

SEQ ID NO: 60977 - RNA, 72 nt, Artificial Sequence
  derived and/or modified sequence opt11 from anti-influenza_CDR
augucgcucuugaccgaggucgagaccccgaucaggaacgagugggaguacaggugcucggacucgagcgau

SEQ ID NO: 60978 - RNA, 72 nt, Artificial Sequence
  derived and/or modified sequence opt11 from anti-influenza_CDR
augucccuccucaccgaagucgaaacccccacccgcaacggcugggaaugccgcuacuccgacuccuccgac

SEQ ID NO: 60979 - RNA, 72 nt, Artificial Sequence
  derived and/or modified sequence opt11 from anti-influenza_CDR
augucguucuugaccgaggucgagaccuugaccaggaacgggugggagugcaggugcucggacucgagcgau

SEQ ID NO: 60980 - RNA, 72 nt, Artificial Sequence
  derived and/or modified sequence opt11 from anti-influenza_CDR
augagccugcuaacggaaguggaaacgcucacgcgcaacggcugggaauguaaaugccgcgacagcucggac

SEQ ID NO: 60981 - RNA, 72 nt, Artificial Sequence
  derived and/or modified sequence opt11 from anti-influenza_CDR
augucgcucuugaccgaggucgagaccccgaucaggaacgagugggggugcaggugcaaugacucgagcgau

SEQ ID NO: 60982 - RNA, 72 nt, Artificial Sequence
  derived and/or modified sequence opt11 from anti-influenza_CDR
augagucuguugacggagguggagacgccgauaaggagcgaguggggguguaggugcaaugacaguggggau

SEQ ID NO: 60983 - RNA, 72 nt, Artificial Sequence
  derived and/or modified sequence opt11 from anti-influenza_CDR
augucgcucuugaccgaggucgagaccccgaucaggaacgagugggagugcaggugcaauggcucgagcgau

SEQ ID NO: 60984 - RNA, 72 nt, Artificial Sequence
  derived and/or modified sequence opt11 from anti-influenza_CDR
augucccucccaaccgaagucgaaacccccauccgcaacgaauggggcugccgcugcaacgacuccuccgac

SEQ ID NO: 60985 - RNA, 72 nt, Artificial Sequence
  derived and/or modified sequence opt11 from anti-influenza_CDR
augagucuguugacggagguggagacgccgauaaggaacgagugggggugcaggugcaaugggaguagcgau

SEQ ID NO: 60986 - RNA, 72 nt, Artificial Sequence
  derived and/or modified sequence opt11 from anti-influenza_CDR
augagcuugcuaacggaaguggacacgcucacgcgcaauggcuggggcugucgcuguagcgauagcucggac

SEQ ID NO: 60987 - RNA, 72 nt, Artificial Sequence
  derived and/or modified sequence opt11 from anti-influenza_CDR
augucccuccucaccgaagucgaaacccucaccaaaaacggcuggggcugccgcugcuccgacuccuccgac

SEQ ID NO: 60988 - RNA, 72 nt, Artificial Sequence
  derived and/or modified sequence opt11 from anti-influenza_CDR
augagccugcuaacggaaguggaaacgcccacgcgcaacggcugggaauguaaaugcagcgacagcucggac

SEQ ID NO: 60989 - RNA, 72 nt, Artificial Sequence
  derived and/or modified sequence opt11 from anti-influenza_CDR
augucccuccuaaccgaagucgaaacccacacccgcaacggcugggaaugcaaaugcuccgacuccuccgac

SEQ ID NO: 60990 - RNA, 72 nt, Artificial Sequence
  derived and/or modified sequence opt11 from anti-influenza_CDR
augucgcucuugaccgaggucaagaccccgaccaggaacgggugggagugcaagugcucggacucgagcgau

SEQ ID NO: 60991 - RNA, 72 nt, Artificial Sequence
  derived and/or modified sequence opt11 from anti-influenza_CDR
augagcuugcuaacggaaguggaaacgcucacgcgcaauggcuggggcugucgcuguagcgauagcucggac

SEQ ID NO: 60992 - RNA, 72 nt, Artificial Sequence
  derived and/or modified sequence opt11 from anti-influenza_CDR
augucgcucuugaccgaggucgagaccccgaccagggacgggugggagugcaagugcucggacucgagcgau

SEQ ID NO: 60993 - RNA, 72 nt, Artificial Sequence
  derived and/or modified sequence opt11 from anti-influenza_CDR
augagcuugcuaacggaaguggaaacgcccacgcgcaauggcuggggcugucgcuguagcgauagcucggac

SEQ ID NO: 60994 - RNA, 72 nt, Artificial Sequence
  derived and/or modified sequence opt11 from anti-influenza_CDR
augagccugcuaacagaaguagaaacgccaacaagaaacggcugggaaugcaaaugcaacgacagcagcgac

SEQ ID NO: 60995 - RNA, 72 nt, Artificial Sequence
  derived and/or modified sequence opt11 from anti-influenza_CDR
augucccuccucaccgaagucgaaacccucacccgcaacggcugggaaugcaaaugcuccgacuccuccgac

SEQ ID NO: 60996 - RNA, 72 nt, Artificial Sequence
  derived and/or modified sequence opt11 from anti-influenza_CDR
augucgcucuugaccgaggucgagaccccgaucaggaacgagugggggugcaagugcaaugacucgagcgau

SEQ ID NO: 60997 - RNA, 72 nt, Artificial Sequence
  derived and/or modified sequence opt11 from anti-influenza_CDR
augucguucuugaccgaggucgagaccccgaucaggaacgagugggggugcaggugcaauggcucgagcgau

SEQ ID NO: 60998 - RNA, 72 nt, Artificial Sequence
  derived and/or modified sequence opt11 from anti-influenza_CDR
augucgcucuugaccgaggucgagaccccgaccaggaacgggugggagugcaggugcaaugacucgagcgau

SEQ ID NO: 60999 - RNA, 72 nt, Artificial Sequence
  derived and/or modified sequence opt11 from anti-influenza_CDR
augucgcucuugaccgaggucgagaccccgaucaggaaagggugggagugcaauugcucggacucgagcgau

SEQ ID NO: 61000 - RNA, 72 nt, Artificial Sequence
  derived and/or modified sequence opt11 from anti-influenza_CDR
augucgcucuugaccgaggucgagaccccgaccaggaacgagugggagugcaggugcucggacucgagcgau

SEQ ID NO: 61001 - RNA, 72 nt, Artificial Sequence
  derived and/or modified sequence opt11 from anti-influenza_CDR
augagcuugcuaacgggcguggaaacgcacacgcgaaauggcuggggcuguaaauguagcgauagcucggac

SEQ ID NO: 61002 - RNA, 72 nt, Artificial Sequence
  derived and/or modified sequence opt11 from anti-influenza_CDR
augucccuccuccccgaagucgaaacacacacccgcaacggcuggggcugccgcugcuccgacuccuccgac

SEQ ID NO: 61003 - RNA, 72 nt, Artificial Sequence
  derived and/or modified sequence opt11 from anti-influenza_CDR
acagauggcccguacucggacgauuucaggagcggguacgcggccagguacagguacuuuggcauggacgug

SEQ ID NO: 61004 - RNA, 75 nt, Artificial Sequence
  derived and/or modified sequence opt11 from anti-influenza_CDR
gcgaaacauaugucgcuacagcaaguggucucggccgggugggagcgagcggacuuggucggggacgcguucgau

SEQ ID NO: 61005 - RNA, 75 nt, Artificial Sequence
  derived and/or modified sequence opt11 from anti-influenza_CDR
gcgaaacaucuaucgaugcagcaaguggucucggccgggugggagcgagcggacuuggucggggacgcguucgau

SEQ ID NO: 61006 - RNA, 75 nt, Artificial Sequence
  derived and/or modified sequence opt11 from anti-influenza_CDR
gcgaaacaugccucgcuacagcaaguggucucggccgggugggagcgagcggacuuggucggggacgcguucgau

SEQ ID NO: 61007 - RNA, 75 nt, Artificial Sequence
  derived and/or modified sequence opt11 from anti-influenza_CDR
gcgaaacauagcucgcuccagcaaguggucucggccgggugggagcgcgcggacuuggucggggacgcguucgau

SEQ ID NO: 61008 - RNA, 75 nt, Artificial Sequence
  derived and/or modified sequence opt11 from anti-influenza_CDR
gcgaaacaucucucgcuccagcaaguggucucggccgggugggagcgcgcggacuuggucggggacgcguucgau

SEQ ID NO: 61009 - RNA, 75 nt, Artificial Sequence
  derived and/or modified sequence opt11 from anti-influenza_CDR
gcgaagcauaugaguaugcagcagguggugagugcggggugggagagggcggauuuggugggggaugcguuugau

SEQ ID NO: 61010 - RNA, 75 nt, Artificial Sequence
  derived and/or modified sequence opt11 from anti-influenza_CDR
gcccgcggccccgaaaccuacuacuacgacaaaaccaacuggcucaacucccaccccgacgaauacuuccaacac

SEQ ID NO: 61011 - RNA, 75 nt, Artificial Sequence
  derived and/or modified sequence opt11 from anti-influenza_CDR
acgacagacggcccguacucggacgauuucaggagcggguacgcggccagguacagguacuuuggcauggacgug

SEQ ID NO: 61012 - RNA, 75 nt, Artificial Sequence
  derived and/or modified sequence opt11 from anti-influenza_CDR
accgauggcccguacucggacgauuucaggagcggguacgcggccagguacagguacuuuggcauggacgugugg

SEQ ID NO: 61013 - RNA, 78 nt, Artificial Sequence
  derived and/or modified sequence opt11 from anti-influenza_CDR
gacauacaaaugacccagagcccgagcucgcuaucggccucggucggggacagggucacgaucacgugcaggagcucg

SEQ ID NO: 61014 - RNA, 78 nt, Artificial Sequence
  derived and/or modified sequence opt11 from anti-influenza_CDR
gcgaccgggcgcgcggccacgggcucggccucgugcacgggcgggggcacguacuggaccuauugcacgugcacgaca

SEQ ID NO: 61015 - RNA, 81 nt, Artificial Sequence
  derived and/or modified sequence opt11 from anti-influenza_CDR
ggguacauacccgaggccccgcgcgauggccaggccuaugucaggaaagauggcgagugggugcucuugagcacguucuug

SEQ ID NO: 61016 - RNA, 90 nt, Artificial Sequence
  derived and/or modified sequence opt11 from anti-influenza_CDR
caagugcaauugcucgagaccgggggcgggcucgugaaaccgggccagagcuugaaauugagcugugccgcgagcggguucacguucacg

SEQ ID NO: 61017 - RNA, 96 nt, Artificial Sequence
  derived and/or modified sequence opt11 from anti-influenza_CDR
cgcuucaccaucucccgcgacaacuccaaaaacacccucuaccuccaaaugaacucccuccgcgccgaagacaccgccgucuacuacugcgccaaa

SEQ ID NO: 61018 - RNA, 96 nt, Artificial Sequence
  derived and/or modified sequence opt11 from anti-influenza_CDR
ggcguccccucccgcuucuccggcuccggcuccggcaccgacuucacccucaccaucuccucccuccaacccgaagacuucgccaccuacuacugc

SEQ ID NO: 61019 - RNA, 15 nt, Artificial Sequence
  derived and/or modified sequence opt11 from anti-OX40_HeavyChain_CDR1
agcuauagcaugaac

SEQ ID NO: 61020 - RNA, 15 nt, Artificial Sequence
  derived and/or modified sequence opt11 from anti-OX40_HeavyChain_CDR1
gacuacgccaugcau

SEQ ID NO: 61021 - RNA, 15 nt, Artificial Sequence
  derived and/or modified sequence opt11 from anti-OX40_HeavyChain_CDR1
gacucguacaugagu

SEQ ID NO: 61022 - RNA, 15 nt, Artificial Sequence
  derived and/or modified sequence opt11 from anti-OX40_HeavyChain_CDR1
gacgcguacaugagu

SEQ ID NO: 61023 - RNA, 15 nt, Artificial Sequence
  derived and/or modified sequence opt11 from anti-OX40_HeavyChain_CDR1
gagucguacaugagu

SEQ ID NO: 61024 - RNA, 15 nt, Artificial Sequence
  derived and/or modified sequence opt11 from anti-OX40_HeavyChain_CDR1
agcggguacuggaac

SEQ ID NO: 61025 - RNA, 21 nt, Artificial Sequence
  derived and/or modified sequence opt11 from anti-OX40_LightChain_CDR2
uacaccucccgccuccacucc

SEQ ID NO: 61026 - RNA, 21 nt, Artificial Sequence
  derived and/or modified sequence opt11 from anti-OX40_LightChain_CDR2
gccgccuccucccuccaauca

SEQ ID NO: 61027 - RNA, 21 nt, Artificial Sequence
  derived and/or modified sequence opt11 from anti-OX40_LightChain_CDR2
gacgcgagcaaucgcgcgaca

SEQ ID NO: 61028 - RNA, 21 nt, Artificial Sequence
  derived and/or modified sequence opt11 from anti-OX40_LightChain_CDR2
uacaccucccgccuccgcucc

SEQ ID NO: 61029 - RNA, 24 nt, Artificial Sequence
  derived and/or modified sequence opt11 from anti-OX40_LightChain_CDR3
caacaacgcuccaacuggcccacc

SEQ ID NO: 61030 - RNA, 24 nt, Artificial Sequence
  derived and/or modified sequence opt11 from anti-OX40_HeavyChain_CDR3
gccccccgcugguacuucuccgua

SEQ ID NO: 61031 - RNA, 24 nt, Artificial Sequence
  derived and/or modified sequence opt11 from anti-OX40_HeavyChain_CDR3
gcaccccgcugguacuucuccgcc

SEQ ID NO: 61032 - RNA, 24 nt, Artificial Sequence
  derived and/or modified sequence opt11 from anti-OX40_HeavyChain_CDR3
gccccacgcugguacuucgccgua

SEQ ID NO: 61033 - RNA, 27 nt, Artificial Sequence
  derived and/or modified sequence opt11 from anti-OX40_LightChain_CDR3
cagcaaggaaacacgcucccguggaca

SEQ ID NO: 61034 - RNA, 27 nt, Artificial Sequence
  derived and/or modified sequence opt11 from anti-OX40_HeavyChain_CDR3
gaaucgggcugguacuuguucgacuac

SEQ ID NO: 61035 - RNA, 27 nt, Artificial Sequence
  derived and/or modified sequence opt11 from anti-OX40_LightChain_CDR3
caacaauacaacuccuacccccccacc

SEQ ID NO: 61036 - RNA, 27 nt, Artificial Sequence
  derived and/or modified sequence opt11 from anti-OX40_LightChain_CDR3
caacaaggccacacccucccccccacc

SEQ ID NO: 61037 - RNA, 27 nt, Artificial Sequence
  derived and/or modified sequence opt11 from anti-OX40_LightChain_CDR3
caacaaggccacacccuccccgccacc

SEQ ID NO: 61038 - RNA, 27 nt, Artificial Sequence
  derived and/or modified sequence opt11 from anti-OX40_LightChain_CDR3
caacaaggccacaccgccccaccaacc

SEQ ID NO: 61039 - RNA, 27 nt, Artificial Sequence
  derived and/or modified sequence opt11 from anti-OX40_LightChain_CDR3
caacaaggcgccacccuaccccccacc

SEQ ID NO: 61040 - RNA, 27 nt, Artificial Sequence
  derived and/or modified sequence opt11 from anti-OX40_LightChain_CDR3
caacaaggccacgcccucccacccacc

SEQ ID NO: 61041 - RNA, 27 nt, Artificial Sequence
  derived and/or modified sequence opt11 from anti-OX40_LightChain_CDR3
caacaagcccacacccucccccccacc

SEQ ID NO: 61042 - RNA, 27 nt, Artificial Sequence
  derived and/or modified sequence opt11 from anti-OX40_LightChain_CDR3
caacaaggccacacccucgcccccacc

SEQ ID NO: 61043 - RNA, 27 nt, Artificial Sequence
  derived and/or modified sequence opt11 from anti-OX40_LightChain_CDR3
caagccggccacacccuacccccaacc

SEQ ID NO: 61044 - RNA, 30 nt, Artificial Sequence
  derived and/or modified sequence opt11 from anti-OX40_HeavyChain_CDR1
ggguacacguucacgagcuacgucaugcac

SEQ ID NO: 61045 - RNA, 30 nt, Artificial Sequence; identical to SEQ ID NO: 22835
  derived and/or modified sequence opt11 from anti-OX40_HeavyChain_CDR3

SEQ ID NO: 61046 - RNA, 33 nt, Artificial Sequence
  derived and/or modified sequence opt11 from anti-OX40_LightChain_CDR1
cgcgccucccaagacauauccaacuaccuaaac

SEQ ID NO: 61047 - RNA, 33 nt, Artificial Sequence
  derived and/or modified sequence opt11 from anti-OX40_LightChain_CDR1
agggcaagucaggggauaaguaguuggcuggcg

SEQ ID NO: 61048 - RNA, 33 nt, Artificial Sequence
  derived and/or modified sequence opt11 from anti-OX40_LightChain_CDR1
cgcgcgagccagagcgugagcucauacuuggcc

SEQ ID NO: 61049 - RNA, 39 nt, Artificial Sequence
  derived and/or modified sequence opt11 from anti-OX40_HeavyChain_CDR3
uacagguacgauuacgauggcgggcacgcgauggauuac

SEQ ID NO: 61050 - RNA, 39 nt, Artificial Sequence
  derived and/or modified sequence opt11 from anti-OX40_HeavyChain_CDR3
uacaaauacgacuacgacgccggacacgcaauggacuac

SEQ ID NO: 61051 - RNA, 39 nt, Artificial Sequence
  derived and/or modified sequence opt11 from anti-OX40_HeavyChain_CDR3
uacaaguacgauuacgauggcgggcacgcgauggauuac

SEQ ID NO: 61052 - RNA, 45 nt, Artificial Sequence
  derived and/or modified sequence opt11 from anti-OX40_HeavyChain_CDR3
gaccaaucaaccgccgacuacuacuucuacuacggcauggacguc

SEQ ID NO: 61053 - RNA, 48 nt, Artificial Sequence
  derived and/or modified sequence opt11 from anti-OX40_HeavyChain_CDR2
uacaucuccuacaacggcaucaccuaccacaaccccucccucaaaucc

SEQ ID NO: 61054 - RNA, 48 nt, Artificial Sequence
  derived and/or modified sequence opt11 from anti-OX40_HeavyChain_CDR2
uacaucuccuacaacgccaucaccuaccacaaccccucccucaaaucc

SEQ ID NO: 61055 - RNA, 48 nt, Artificial Sequence
  derived and/or modified sequence opt11 from anti-OX40_HeavyChain_CDR2
uacaucuccuacuccggcaucaccuaccacaaccccucccucaaaucc

SEQ ID NO: 61056 - RNA, 51 nt, Artificial Sequence
  derived and/or modified sequence opt11 from anti-OX40_HeavyChain_CDR2
uacaucaaccccuacaacgacggcaccaaauacaacgaaaaauucaaaggc

SEQ ID NO: 61057 - RNA, 51 nt, Artificial Sequence
  derived and/or modified sequence opt11 from anti-OX40_HeavyChain_CDR2
uacaucuccuccuccuccuccaccaucgacuacgccgacuccgucaaaggc

SEQ ID NO: 61058 - RNA, 51 nt, Artificial Sequence
  derived and/or modified sequence opt11 from anti-OX40_HeavyChain_CDR2
ggaauaagcuggaacucgggcucgauaggguacgcggacucgguaaaggga

SEQ ID NO: 61059 - RNA, 51 nt, Artificial Sequence
  derived and/or modified sequence opt11 from anti-OX40_HeavyChain_CDR2
gacauguacccggacaacggcgacagcucguacaaccaaaaauucagggaa

SEQ ID NO: 61060 - RNA, 51 nt, Artificial Sequence
  derived and/or modified sequence opt11 from anti-OX40_HeavyChain_CDR2
gacauguaccccgacaacgccgacuccuccuacaaccaaaaauuccgcgaa

SEQ ID NO: 61061 - RNA, 51 nt, Artificial Sequence
  derived and/or modified sequence opt11 from anti-OX40_HeavyChain_CDR2
gacauguaccccgacaacgcagacgccagcuacaaccaaaaauuccgcgaa

SEQ ID NO: 61062 - RNA, 51 nt, Artificial Sequence
  derived and/or modified sequence opt11 from anti-OX40_HeavyChain_CDR2
gacauguaccccgacaacggagacgccagcuacaaccaaaaauuccgcgaa

SEQ ID NO: 61063 - RNA, 51 nt, Artificial Sequence
  derived and/or modified sequence opt11 from anti-OX40_HeavyChain_CDR2
gacauguacccggacucgggcgacagcucguacaaccaaaaguucagggaa

SEQ ID NO: 61064 - RNA, 51 nt, Artificial Sequence
  derived and/or modified sequence opt11 from anti-OX40_HeavyChain_CDR2
gacauguaccccgacaacggcagcucaagcuacaaccaaaaauuccgcgaa

SEQ ID NO: 61065 - RNA, 309 nt, Artificial Sequence
  derived and/or modified sequence opt11 from Ig_LightChain_kappa_constant_domain
accgucgccgcccccuccgucuucaucuucccccccuccgacgaacaacucaaauccggcaccgccuccgucgucugccuccucaacaacuucuacccccgcgaagccaaaguccaauggaaagucgacaacgcccuccaauccggcaacucccaagaaucagucaccgaacaagacuccaaagacuccaccuacucccuauccuccacccucacccucuccaaagccgacuacgaaaaacacaaagucuacgccugcgaagucacccaccaaggccucuccucccccgucaccaaauccuucaaccgc

SEQ ID NO: 61066 - RNA, 309 nt, Artificial Sequence
  derived and/or modified sequence opt11 from Ig_LightChain_kappa_constant_domain
accgucgccgcccccuccgucuucaucuucccccccuccgacgaacaacucaaauccggcaccgccuccgucgucugccuccucaacaacuucuacccccgcgaagccaaaguccaauggaaagucgacaacgcccuccaauccggcaacucccaagaauccgucaccgaacaagacuccaaagacuccaccuacucccucuccaacacccucacccucuccaaagccgacuacgaaaaacacaaagucuacgccugcgaagucacccaccaaggccucuccucccccgucaccaaauccuucaaccgc

SEQ ID NO: 61067 - RNA, 312 nt, Artificial Sequence
  derived and/or modified sequence opt11 from Ig_LightChain_lambda_constant_domain
cccaaagccgcccccucagucacccucuucccccccuccuccgaagaacuccaagccaacaaagccacccucgucugccucaucucagacuucuaccccggcgccgucaccgucgccuggaaagccgacuccucccccgucaaagccggcgucgaaaccaccacccccuccaaacaauccaacaacaaauacgccgccuccuccuaccucucccucacccccgaacaauggaaaucccaccgcuccuacuccugccaagucacccacgaaggcuccaccgucgaaaaaaccgucgcccccaccgaaugcucc

SEQ ID NO: 61068 - RNA, 312 nt, Artificial Sequence
  derived and/or modified sequence opt11 from Ig_LightChain_lambda_constant_domain
cccaaagccgcccccuccgucacccucuucccccccuccuccgaagaacuccaagccaacaaagccacccucgucugccucaucuccgacuucuaccccggcgccgucaccgucgccuggaaagccgacuccucccccgucaaagccggcgucgaaaccaccacccccuccaaacaauccaacaacaaauacgccgccuccuccuaccucucccucacccccgaacaauggaaaucacaccgcuccuacuccugccaagucacccacgaaggcuccaccgucgaaaaaaccgucgcccccgccgaaugcucc

SEQ ID NO: 61069 - RNA, 312 nt, Artificial Sequence
  derived and/or modified sequence opt11 from Ig_LightChain_lambda_constant_domain
cccaaagccgcccccuccgucacccucuucccccccuccuccgaagaacuccaagccaacaaagccacccucgucugccucaucuccgacuucuaccccggcgccgucaccgucgccuggaaagccgacuccucccccgucaaagccggcguagaaaccaccacccccuccaaacaauccaacaacaaauacgccgccuccuccuaccucucccucacccccgaacaauggaaaucccacaaauccuacuccugccaagucacccacgaaggcuccaccgucgaaaaaaccgucgcccccaccgaaugcucc

SEQ ID NO: 61070 - RNA, 312 nt, Artificial Sequence
  derived and/or modified sequence opt11 from Ig_LightChain_lambda_constant_domain
cccaaagccgcccccuccgucacccucuucccccccuccuccgaagaacuccaagccaacaaagccacccucgucugccucaucuccgacuucuaccccggcgccgucaccgucgccuggaaagccgacuccucccccgucaaagccggcgucgaaaccaccacccccuccaaacaauccaacaacaaauacgccgccuccuccuaccucucccucacccccgaacaauggaaaucccacaaauccuacuccugccaagucacccacgaaggcuccaccgucgaaaaaaccgucgcccccgccgaaugcucc

SEQ ID NO: 61071 - RNA, 282 nt, Artificial Sequence
  derived and/or modified sequence opt11 from IgG1_HeavyChain_CH1_constant_domain
uccgccuccaccaaaggccccuccgucuucccccucgcccccuccuccaaauccaccuccggcggcaccgccgcccucggcugccucgucaaagacuacuuccccgaaccagucaccgucuccuggaacuccggcguccacaccuuccccgccguccuccaauccuccggccucuacucccucuccuccgucgucaccguccccuccuccucccucggcacccaaaccuacaucugcaacgucaaccacaaacccuccaacaccaaagucgacaaaaaaguc

SEQ ID NO: 61072 - RNA, 270 nt, Artificial Sequence
  derived and/or modified sequence opt11 from IgG1_HeavyChain_CH1_constant_domain
uccggccccuccgucuucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccuccucccucggcacccaaaccuacaucugcaacgucaaccacaaacccuccaacaccaaagucgacaaaaaaguc

SEQ ID NO: 61073 - RNA, 270 nt, Artificial Sequence
  derived and/or modified sequence opt11 from IgG1_HeavyChain_CH1_constant_domain
uccggccccuccgucuucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccucauccucccucggcacccaaaccuacaucugcaacgucaaccacaaacccuccaacaccaaagucgacaaaaaagcc

SEQ ID NO: 61074 - RNA, 270 nt, Artificial Sequence
  derived and/or modified sequence opt11 from IgG1_HeavyChain_CH1_constant_domain
uccggccccuccgucuucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccuccucccucggcacccaaaccuacaucugcaacguaaaccacaaacccuccaacaccaaagucgacaaacgcguc

SEQ ID NO: 61075 - RNA, 270 nt, Artificial Sequence
  derived and/or modified sequence opt11 from IgG1_HeavyChain_CH1_constant_domain
uccggccccuccgucuucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccuccucccucggcacccaaaccuacaucugcaacgucaaccacaaacccucaaacaccaaagucgacaaacgcgcc

SEQ ID NO: 61076 - RNA, 270 nt, Artificial Sequence
  derived and/or modified sequence opt11 from IgG1_HeavyChain_CH1_constant_domain
uccggccccuccguccucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccuccucccucggcacccaaaccuacaucugcaacgucaaccacaaacccuccaacaccaaagucgacaaaaaaguc

SEQ ID NO: 61077 - RNA, 270 nt, Artificial Sequence
  derived and/or modified sequence opt11 from IgG1_HeavyChain_CH1_constant_domain
uccggccccuccguccucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccuccucccucggcacccaaaccuacaucugcaacgucaaccacaaacccuccaacaccaaagucgacaaaaaagcc

SEQ ID NO: 61078 - RNA, 270 nt, Artificial Sequence
  derived and/or modified sequence opt11 from IgG1_HeavyChain_CH1_constant_domain
uccggccccuccguccucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccuccucccucggcacccaaaccuacaucugcaacgucaaccacaaacccuccaacaccaaagucgacaaacgcguc

SEQ ID NO: 61079 - RNA, 270 nt, Artificial Sequence
  derived and/or modified sequence opt11 from IgG1_HeavyChain_CH1_constant_domain
uccggccccuccguccucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccuccucccucggcacccaaacauacaucugcaacgucaaccacaaacccucaaacaccaaagucgacaaacgcgcc

SEQ ID NO: 61080 - RNA, 282 nt, Artificial Sequence
  derived and/or modified sequence opt11 from IgG1_HeavyChain_CH1_constant_domain
uccgccuccaccaaaggccccuccgucuucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccuccucacucggcacccaaaccuacaucugcaacgucaaccacaaacccuccaacaccaaagucgacaaaaaagcc

SEQ ID NO: 61081 - RNA, 282 nt, Artificial Sequence
  derived and/or modified sequence opt11 from IgG1_HeavyChain_CH1_constant_domain
uccgccuccaccaaaggccccuccgucuucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccuccucccucggcacccaaaccuacaucugcaacgucaaccacaaacccuccaacaccaaagucgacaaacgcguc

SEQ ID NO: 61082 - RNA, 282 nt, Artificial Sequence
  derived and/or modified sequence opt11 from IgG1_HeavyChain_CH1_constant_domain
uccgccuccaccaaaggccccuccgucuucccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccuauccuccgucgucaccguccccuccuccucccucggcacccaaaccuacaucugcaacgucaaccacaaacccuccaacaccaaagucgacaaacgcgcc

SEQ ID NO: 61083 - RNA, 282 nt, Artificial Sequence
  derived and/or modified sequence opt11 from IgG1_HeavyChain_CH1_constant_domain
uccgccuccaccaaaggccccuccguccuaccccucgcccccuccuccaaauccaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccuccucccucggcacccaaaccuacaucugcaacgucaaccacaaacccuccaacaccaaagucgacaaaaaaguc

SEQ ID NO: 61084 - RNA, 282 nt, Artificial Sequence
  derived and/or modified sequence opt11 from IgG1_HeavyChain_CH1_constant_domain
uccgccuccaccaaaggccccuccguccucccccucgcccccuccuccaaauccaccuccggcggaaccgccgcccuaggcugccucgucaaagacuacuuccccgaacccgucaccgucuccuggaacuccggcguccacaccuuccccgccguccuccaauccuccggccucuacucccucuccuccgucgucaccguccccuccuccucccucggcacccaaaccuacaucugcaacgucaaccacaaacccuccaacaccaaagucgacaaaaaagcc

SEQ ID NO: 61085 - RNA, 282 nt, Artificial Sequence
  derived and/or modified sequence opt11 from IgG1_HeavyChain_CH1_constant_domain
uccgccuccaccaaaggccccuccguccucccccucgcccccuccuccaaaucaaccuccggcggcaccgccgcccucggcugccucgucaaagacuacuuccccgaacccgucaccgucuccuggaacuccggcguccacaccuuccccgccguccuccaauccuccggccucuacucccucuccuccgucgucaccguccccuccucaucccucggcacccaaaccuacaucugcaacgucaaccacaaacccuccaacaccaaagucgacaaacgcguc

SEQ ID NO: 61086 - RNA, 282 nt, Artificial Sequence
  derived and/or modified sequence opt11 from IgG1_HeavyChain_CH1_constant_domain
uccgccuccaccaaaggccccuccguccucccccucgcccccuccucaaaauccaccuccggcggcaccgccgcccucggcugccucgucaaagacuacuuccccgaacccgucaccgucuccuggaacuccggcguccacaccuuccccgccguccuccaauccuccggccucuacucacucuccuccgucgucaccguccccuccuccucccucggcacccaaaccuacaucugcaacgucaaccacaaacccuccaacaccaaagucgacaaacgcgcc

SEQ ID NO: 61087 - RNA, 330 nt, Artificial Sequence
  derived and/or modified sequence opt11 from IgG1_HeavyChain_CH2_constant_domain
gcccccgaacuccucggcggcccauccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgcgaagaacaauacaacuccaccuaccgcgucgucuccguccucaccguccuccaccaagacuggcucaacggcaaagaauacaaaugcaaagucuccaacaaagcccuccccgcccccaucgaaaaaaccaucuccaaagcaaaa

SEQ ID NO: 61088 - RNA, 330 nt, Artificial Sequence
  derived and/or modified sequence opt11 from IgG1_HeavyChain_CH2_constant_domain
gcccccgaacuccucggcggccccuccgucuuccucuucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgcgaagaacaauacaacuccaccuaccgcgucgucuccguccucaccguccuccaccaagacuggcucaacggcaaagaauacaaaugcaaagucuccaacaaagcccuacccgcccccaucgaaaaaaccaucuccaaagccaaa

SEQ ID NO: 61089 - RNA, 330 nt, Artificial Sequence
  derived and/or modified sequence opt11 from IgG1_HeavyChain_CH2_constant_domain
gcccccgaacuccucggcggccccuccgucuuccucuucccccccaaacccaaagacacccucaugaucucccgcacccccgaaguaaccugcgucgucgucgacgucucccacgaagaccccgaagucaaauucaacgucuacgucgacggcgucgaaguccacaacgccaaaaccaaaccccgcgaagaacaauacgccuccaccuaccgcgucgucuccguccucaccguccuccaccaagacuggcucaacggcaaagaauacaaaugcaaagucuccaacaaagcccuccccgcccccaucgaaaaaaccaucucaaaagccaaa

SEQ ID NO: 61090 - RNA, 330 nt, Artificial Sequence
  derived and/or modified sequence opt11 from IgG1_HeavyChain_CH2_constant_domain
gcccccgaacuccucggcggccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgcgaagaacaauacgccuccaccuaccgcguagucuccguccuaaccguccuccaccaagacuggcuaaacggcaaagaauacaaaugcaaagucuccaacaaagcccuccccgcccccaucgaaaaaaccaucuccaaagccaaa

SEQ ID NO: 61091 - RNA, 330 nt, Artificial Sequence
  derived and/or modified sequence opt11 from IgG1_HeavyChain_CH2_constant_domain
gcacccgaacuccucggcgcccccuccgucuuccucuucccccccaaacccaaagacacccucaugaucucccgaacccccgaagucaccugcguagucgucgacgucucccacgaagaccccgaagucaaauucaacgucuacgucgacggcgucgaaguccacaacgccaaaaccaaaccccgcgaagaacaauacaacuccaccuaccgcgucgucuccguccucaccguccuccaccaagacuggcuaaacggcaaagaauacaaaugcaaagucuccaacaaagcccuccccgcccccaucgaaaaaaccaucuccaaagccaaa

SEQ ID NO: 61092 - RNA, 330 nt, Artificial Sequence
  derived and/or modified sequence opt11 from IgG1_HeavyChain_CH2_constant_domain
gcccccgaacuccucggcgcccccuccgucuuccucuucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgcgaagaacaauacgccuccacauaccgcgucgucucaguccucaccguccuccaccaagacuggcucaacggcaaagaauacaaaugcaaagucuccaacaaagcccuccccgcccccaucgaaaaaaccaucuccaaagccaaa

SEQ ID NO: 61093 - RNA, 330 nt, Artificial Sequence
  derived and/or modified sequence opt11 from IgG1_HeavyChain_CH2_constant_domain
gcccccgaacuccucggcgcccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgcgaagaacaauacaacuccaccuaccgcgucgucuccguccucaccguccuccaccaagacuggcuaaacggcaaagaauacaaaugcaaagucuccaacaaagcccuccccgcccccaucgaaaaaaccaucuccaaagccaaa

SEQ ID NO: 61094 - RNA, 330 nt, Artificial Sequence
  derived and/or modified sequence opt11 from IgG1_HeavyChain_CH2_constant_domain
gcccccgaacuccucggcgcccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgcgaagaacaauacgccuccaccuaccgcgucgucuccguccucaccguccuccaccaagacuggcucaacggcaaagaauacaaaugcaaagucucaaacaaagcccuccccgcccccaucgaaaaaaccaucuccaaagccaaa

SEQ ID NO: 61095 - RNA, 330 nt, Artificial Sequence
  derived and/or modified sequence opt11 from IgG1_HeavyChain_CH2_constant_domain
gcccccgaacucgccggcggccccuccgucuuccucuucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgagaagaacaauacaacuccaccuaccgcgucgucuccguccucaccguccuccaccaagacuggcucaacggcaaagaauacaaaugcaaagucuccaacaaagcccuccccgcccccaucgaaaaaacaaucucaaaagccaaa

SEQ ID NO: 61096 - RNA, 330 nt, Artificial Sequence
  derived and/or modified sequence opt11 from IgG1_HeavyChain_CH2_constant_domain
gcccccgaacucgccggcggccccuccgucuuccucuucccccccaaacccaaagacacccucaugaucucacgcacccccgaagucaccugcgucgucgucgacgucucccacgaagaccccgaagucaaauucaacgucuacgucgacggcgucgaaguccacaacgccaaaaccaaaccccgcgaagaacaauacgccuccaccuaccgcgucgucuccguccucaccguccuccaccaagacuggcucaacggcaaagaauacaaaugcaaagucuccaacaaagcccuccccgcccccaucgaaaaaaccaucucaaaagccaaa

SEQ ID NO: 61097 - RNA, 330 nt, Artificial Sequence
  derived and/or modified sequence opt11 from IgG1_HeavyChain_CH2_constant_domain
gcccccgaacucgccggcggccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaacccagagaagaacaauacaacuccaccuaccgcgucgucuccguccucaccguccuccaccaagacuggcucaacggcaaagaauacaaaugcaaagucucaaacaaagcccuccccgcacccaucgaaaaaaccaucuccaaagccaaa

SEQ ID NO: 61098 - RNA, 330 nt, Artificial Sequence
  derived and/or modified sequence opt11 from IgG1_HeavyChain_CH2_constant_domain
gcccccgaacucgccggcggccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccacgcgaagaacaauacgccuccaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61099 - RNA, 330 nt, Artificial Sequence
  derived and/or modified sequence opt11 from IgG1_HeavyChain_CH2_constant_domain
gcccccgaacucgccggcgcccccuccgucuuccucuucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgcgaagaacaauacaacuccaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61100 - RNA, 330 nt, Artificial Sequence
  derived and/or modified sequence opt11 from IgG1_HeavyChain_CH2_constant_domain
gcccccgaacucgccggcgcccccuccgucuuccucuucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgcgaagaacaauacgccucaaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61101 - RNA, 330 nt, Artificial Sequence
  derived and/or modified sequence opt11 from IgG1_HeavyChain_CH2_constant_domain
gcccccgaacucgccggcgcccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgcgaagaacaauacaacuccaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61102 - RNA, 330 nt, Artificial Sequence
  derived and/or modified sequence opt11 from IgG1_HeavyChain_CH2_constant_domain
gcccccgaacucgccggcgcccccuccgucuuccucuucccccccaaacccaaagacacccucaugaucucccgcacccccgaagucaccugcguagucgucgacgucucccacgaagaccccgaagucaaauucaacugguacgucgacggcgucgaaguccacaacgccaaaaccaaaccccgcgaagaacaauacgccuccaccuaccgcgucgucuccguccucaccguccuccaccaagacuggcuaaacggcaaagaauacaaaugcaaagucuccaacaaagcccuccccgcccccaucgaaaaaaccaucuccaaagccaaa

SEQ ID NO: 61103 - RNA, 330 nt, Artificial Sequence
  derived and/or modified sequence opt11 from IgG1_HeavyChain_CH2_constant_domain
gcccccgaagcccucggcggccccuccgucuuccucuucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgcgaagaacaauacaacuccaccuaccgcgucgucucaguccucaccguccuccaccaagacuggcucaacggcaaagaauacaaaugcaaagucuccaacaaagcccuccccgcccccaucgaaaaaaccaucuccaaagccaaa

SEQ ID NO: 61104 - RNA, 330 nt, Artificial Sequence
  derived and/or modified sequence opt11 from IgG1_HeavyChain_CH2_constant_domain
gcccccgaagcccucggcggccccuccgucuuccucuucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgcgaagaacaauacgccuccaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61105 - RNA, 330 nt, Artificial Sequence
  derived and/or modified sequence opt11 from IgG1_HeavyChain_CH2_constant_domain
gcccccgaagcccucggcggccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgcaaaaaccaaaccccgcgaagaacaauacaacuccaccuaccgcgucgucuccguccuaaccguccuccaccaagacuggcucaacggcaaagaauacaaaugcaaagucuccaacaaagcccuccccgcccccaucgaaaaaaccaucuccaaagccaaa

SEQ ID NO: 61106 - RNA, 330 nt, Artificial Sequence
  derived and/or modified sequence opt11 from IgG1_HeavyChain_CH2_constant_domain
gcccccgaagcccucggcggccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgcgaagaacaauacgccuccaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61107 - RNA, 330 nt, Artificial Sequence
  derived and/or modified sequence opt11 from IgG1_HeavyChain_CH2_constant_domain
gcccccgaagcccucggcgcccccuccgucuuccuauucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgcgaagaacaauacaacuccaccuaccgcgucgucuccguccucaccguccuccaccaagacuggcucaacggcaaagaauacaaaugcaaagucucaaacaaagcccuccccgcccccaucgaaaaaaccaucuccaaagccaaa

SEQ ID NO: 61108 - RNA, 330 nt, Artificial Sequence
  derived and/or modified sequence opt11 from IgG1_HeavyChain_CH2_constant_domain
gcccccgaagcccucggcgcccccuccgucuuccucuucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgcgaagaacaauacgccuccaccuaccgagucguauccguccucaccguccuccaccaagacuggcucaacggcaaagaauacaaaugcaaagucuccaacaaagcccuccccgcccccaucgaaaaaaccaucuccaaagccaaa

SEQ ID NO: 61109 - RNA, 330 nt, Artificial Sequence
  derived and/or modified sequence opt11 from IgG1_HeavyChain_CH2_constant_domain
gcccccgaagcccucggagcccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgcgaagaacaauacaacuccaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61110 - RNA, 330 nt, Artificial Sequence
  derived and/or modified sequence opt11 from IgG1_HeavyChain_CH2_constant_domain
gcccccgaagcccucggcgcccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaacaaaaccccgcgaagaacaauacgccuccaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61111 - RNA, 330 nt, Artificial Sequence
  derived and/or modified sequence opt11 from IgG1_HeavyChain_CH2_constant_domain
gcccccgaagccgccggcggccccuccgucuuccucuucccccccaaacccaaagacacccucaugaucucacgcacccccgaagucaccugcgucgucgucgacgucucccacgaagaccccgaagucaaauucaacgucuacgucgacggcgucgaaguccacaacgccaaaaccaaaccccgcgaagaacaauacaacuccaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61112 - RNA, 330 nt, Artificial Sequence
  derived and/or modified sequence opt11 from IgG1_HeavyChain_CH2_constant_domain
gcccccgaagccgccggcggccccuccgucuuccucuucccccccaaacccaaagacacccucaugaucucccgcacccccgaagucaccugcgucgucgucgacgucucccacgaagacccagaagucaaauucaacgucuacgucgacggcgucgaaguccacaacgccaaaaccaaaccccgcgaagaacaauacgccuccaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61113 - RNA, 330 nt, Artificial Sequence
  derived and/or modified sequence opt11 from IgG1_HeavyChain_CH2_constant_domain
gcccccgaagccgccggcggccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgcgaagaacaauacaacuccaccuaccgagucgucuccguccucaccguccuccaccaagacuggcucaacggcaaagaauacaaaugcaaagucuccaacaaagcccuccccgcccccaucgaaaaaaccaucucaaaagccaaa

SEQ ID NO: 61114 - RNA, 330 nt, Artificial Sequence
  derived and/or modified sequence opt11 from IgG1_HeavyChain_CH2_constant_domain
gcccccgaagccgccggcggccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgagaagaacaauacgccuccaccuaccgcgucgucuccguccucaccguccuccaccaagacuggcuaaacggcaaagaauacaaaugcaaagucuccaacaaagcccuccccgcccccaucgaaaaaaccaucuccaaagccaaa

SEQ ID NO: 61115 - RNA, 330 nt, Artificial Sequence
  derived and/or modified sequence opt11 from IgG1_HeavyChain_CH2_constant_domain
gcccccgaagccgccggcgcccccuccgucuuccucuucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgcgaagaacaauacaacuccaccuaccgcgucgucuccguccuaaccguacuccaccaagacuggcucaacggcaaagaauacaaaugcaaagucuccaacaaagcccuccccgcccccaucgaaaaaaccaucuccaaagccaaa

SEQ ID NO: 61116 - RNA, 330 nt, Artificial Sequence
  derived and/or modified sequence opt11 from IgG1_HeavyChain_CH2_constant_domain
gcccccgaagccgccggcgcccccuccgucuuccucuucccccccaaacccaaagacacccucaugaucucccgcacccccgaagucaccugcgucgucgucgacgucucccacgaagaccccgaagucaaauucaacgucuacgucgacggcgucgaaguccacaacgccaaaaccaaaccccgcgaagaacaauacgccuccaccuaccgcgucgucuccguccucaccguccuccaccaagacuggcuaaacggcaaagaauacaaaugcaaagucuccaacaaagcccuccccgcccccaucgaaaaaaccaucuccaaagccaaa

SEQ ID NO: 61117 - RNA, 330 nt, Artificial Sequence
  derived and/or modified sequence opt11 from IgG1_HeavyChain_CH2_constant_domain
gcccccgaagccgccggcgcccccuccgucuuccucuucccccccaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgcgaagaacaauacaacuccaccuaccgcgucgucucaguccucaccguccuccaccaagacuggcucaacggaaaagaauacaaaugcaaagucuccaacaaagcccuccccgcccccaucgaaaaaaccaucuccaaagccaaa

SEQ ID NO: 61118 - RNA, 330 nt, Artificial Sequence
  derived and/or modified sequence opt11 from IgG1_HeavyChain_CH2_constant_domain
gcccccgaagccgccggcgcccccuccgucuuccucuuccccccaaaacccaaagacacccucaugaucucccgcacccccgaagucaccugcgucgucgucgacgucucccacgaagaccccgaagucaaauucaacugguacgucgacggcgucgaaguccacaacgccaaaaccaaaccccgcgaagaacaauacgccuccaccuaccgcgucgucuccguccucaccguccuccaccaagacuggcucaacggcaaagaauacaaaugcaaagucuccaacaaagcccuccccgcccccaucgaaaaaaccaucuccaaagccaaa

SEQ ID NO: 61119 - RNA, 318 nt, Artificial Sequence
  derived and/or modified sequence opt11 from IgG1_HeavyChain_CH3_constant_domain
ggccaaccccgcgaaccccaagucuacacccucccccccucccgcgaagaaaugaccaaaaaccaagucucccucaccugccucgucaaaggcuucuaccccuccgacaucgccgucgaaugggaauccaacggccaacccgaaaacaacuacaaaaccaccccccccguccucgacuccgacggcuccuucuuccucuacuccaaacucaccgucgacaaaucccgcuggcaacaaggcaacgucuucuccugcuccgucaugcacgaagcccuccacaaccacuacacccaaaaaucccucucccucucccccggc

SEQ ID NO: 61120 - RNA, 318 nt, Artificial Sequence
  derived and/or modified sequence opt11 from IgG1_HeavyChain_CH3_constant_domain
ggccaaccccgcgaaccccaagucuacacccucccccccucccgcgaagaacucaccaaaaaccaagucucccucaccugccucgucaaaggcuucuaccccuccgacaucgccgucgaaugggaauccaacggccaacccgaaaacaacuacaaaaccaccccccccguccucgacuccgacggcuccuucuuccucuacuccaaacucaccgucgacaaaucccgcuggcaacaaggcaacgucuucuccugcuccgucaugcacgaagcccuccacaaccacuacacccaaaaaucacucucccucucccccggc

SEQ ID NO: 61121 - RNA, 318 nt, Artificial Sequence
  derived and/or modified sequence opt11 from IgG1_HeavyChain_CH3_constant_domain
ggccaaccccgcgaaccccaagucuacacccucccccccucccgcgacgaaaugaccaaaaaccaagucucccucaccugccucgucaaaggcuucuaccccuccgacaucgccgucgaaugggaauccaacggccaacccgaaaacaacuacaaaaccaccccccccguccucgacuccgacggcuccuucuuccucuacuccaaacucaccgucgacaaaucccgcuggcaacaaggcaacgucuucuccugcuccgucaugcacgaagcccuccacaaccacuacacccaaaaaucccucucccucucccccggc

SEQ ID NO: 61122 - RNA, 318 nt, Artificial Sequence
  derived and/or modified sequence opt11 from IgG1_HeavyChain_CH3_constant_domain
ggccaaccccgcgaaccccaagucuacacccucccccccucccgcgacgaacucaccaaaaaccaagucucccucaccugccucgucaaaggcuucuaccccuccgacaucgccgucgaaugggaauccaacggccaacccgaaaacaacuacaaaaccaccccccccguccucgacuccgacggcuccuucuuccucuacuccaaacucaccgucgacaaaucccgcuggcaacaaggcaacgucuucuccugcuccgucaugcacgaagcccuccacaaccacuacacccaaaaaucccucucccucucccccggc

SEQ ID NO: 61123 - RNA, 297 nt, Artificial Sequence
  derived and/or modified sequence opt11 from IgG2_HeavyChain_CH1_constant_domain
uccgccuccaccaaaggccccuccgucuucccccucgcccccugcucccgcuccaccuccgaauccaccgccgcccucggcugccucgucaaagacuacuuccccgaacccgucaccgucuccuggaacuccggcgcccucaccuccggcguccacaccuuccccgccguccuccaauccuccggccucuacucccucuccuccgucgucaccguccccuccuccaacuucggcacccaaaccuacacaugcaacgucgaccacaaacccuccaacaccaaagucgacaaaaccguc

SEQ ID NO: 61124 - RNA, 297 nt, Artificial Sequence
  derived and/or modified sequence opt11 from IgG2_HeavyChain_CH1_constant_domain
uccgccuccaccaaaggccccuccgucuucccccucgcccccugcucccgcuccaccuccgaauccaccgccgcccucggcugccucgucaaagacuacuuccccgaacccgucaccgucuccuggaacuccggcgcccucaccuccggcguccacaccuuccccgccguccuccaauccuccggccuauacucccucuccuccgucgucaccgucaccuccuccaacuucggcacccaaaccuacaccugcaacgucgaccacaaacccuccaacaccaaagucgacaaaaccguc

SEQ ID NO: 61125 - RNA, 327 nt, Artificial Sequence
  derived and/or modified sequence opt11 from IgG2_HeavyChain_CH2_constant_domain
gccccccccgucgcaggccccuccgucuuccucuucccccccaaacccaaagacacccucaugaucucccgcacccccgaagucaccugcgucgucgucgacgucucccacgaagaccccgaaguccaauucaacugguacgucgacggcgucgaaguccacaacgccaaaaccaaaccccgcgaagaacaauucaacuccaccuuccgcgucgucuccguccucaccgucguccaccaagacuggcucaacggcaaagaauacaaaugcaaagucuccaacaaaggccuccccgcccccaucgaaaaaaccaucuccaaaaccaaa

SEQ ID NO: 61126 - RNA, 327 nt, Artificial Sequence
  derived and/or modified sequence opt11 from IgG2_HeavyChain_CH2_constant_domain
gccccccccgucgccggccccuccgucuuccucuucccccccaaacccaaagacacccucaugaucucccgcacccccgaagucaccugcgucgucgucgacgucucccacgaagaccccgaaguccaauucaacugguacgucgacggcgucgaaguccacaacgccaaaaccaaaccccgcgaagaacaauucaacuccaccuuccgcgucgucuccguccucaccgucguccaccaagacuggcucaacggcaaagaauacaaaugcaaagucuccaacaaaggccuccccgccuccaucgaaaaaaccaucuccaaaaccaaa

SEQ ID NO: 61127 - RNA, 327 nt, Artificial Sequence
  derived and/or modified sequence opt11 from IgG2_HeavyChain_CH2_constant_domain
gccccccccgucgccggccccuccgucuuccucuucccccccaaacccaaagacacccucaugaucucccgcacccccgaagucaccugcgucgucgucgacgucucccacgaagaccccgaaguccaauucaacugguacgucgacggcgucgaaguccacaacgccaaaaccaaaccccgcgaagaacaauucaacuccaccuuccgcgucgucuccguccucaccgucguccaccaagacuggcucaacggcaaagaauacaaaugcaaagucuccaacaaaggccuccccucccccaucgaaaaaaccaucuccaaaaccaaa

SEQ ID NO: 61128 - RNA, 327 nt, Artificial Sequence
  derived and/or modified sequence opt11 from IgG2_HeavyChain_CH2_constant_domain
gccccccccgucgccggccccuccgucuuccucuucccccccaaacccaaagacacccucaugaucucccgcacccccgaagucaccugcguagucgucgacgucucccacgaagaccccgaaguccaauucaacugguacgucgacggcgucgaaguccacaacgccaaaaccaaaccccgagaagaacaauucaacuccaccuuccgcgucgucuccguccucaccgucguccaccaagacuggcucaacggcaaagaauacaaaugcaaagucuccaacaaaggccuccccuccuccaucgaaaaaaccaucuccaaaaccaaa

SEQ ID NO: 61129 - RNA, 327 nt, Artificial Sequence
  derived and/or modified sequence opt11 from IgG2_HeavyChain_CH2_constant_domain
gccccccccgucgccggcccauccgucuuccuauucccccccaaacccaaagacacccucaugaucucccgcacccccgaagucaccugcgucgucgucgacgucucccacgaagaccccgaaguccaauucaacugguacgucgacggcauggaaguccacaacgccaaaaccaaaccccgcgaagaacaauucaacuccaccuuccgcguagucuccguccucaccguaguccaccaagacuggcucaacggcaaagaauacaaaugcaaagucuccaacaaaggccuccccgcccccaucgaaaaaaccaucuccaaaaccaaa

SEQ ID NO: 61130 - RNA, 327 nt, Artificial Sequence
  derived and/or modified sequence opt11 from IgG2_HeavyChain_CH2_constant_domain
gccccccccgucgccggccccuccgucuuccucuucccccccaaacccaaagacacccucaugaucucccgcacccccgaagucaccugcgucgucgucgacguaucccacgaagaccccgaaguccaauucaacugguacgucgacggcauggaaguccacaacgccaaaaccaaaccccgcgaagaacaauucaacuccaccuuccgcgucgucuccguccucaccgucguccaccaagacuggcuaaacggcaaagaauacaaaugcaaagucuccaacaaaggccuccccgccuccaucgaaaaaaccaucuccaaaaccaaa

SEQ ID NO: 61131 - RNA, 327 nt, Artificial Sequence
  derived and/or modified sequence opt11 from IgG2_HeavyChain_CH2_constant_domain
gccccccccgucgccggccccuccgucuuccucuucccccccaaacccaaagacacccucaugaucucccgcacccccgaagucaccugcgucgucgucgacgucucccacgaagaccccgaaguccaauucaacugguacgucgacggcauggaaguccacaacgccaaaaccaaaccccgcgaagaacaauucaacuccaccuuccgcgucgucuccguccucaccgucguccaccaagacuggcucaacggcaaagaauacaaaugcaaagucuccaacaaaggccuccccucccccaucgaaaaaaccaucuccaaaaccaaa

SEQ ID NO: 61132 - RNA, 327 nt, Artificial Sequence
  derived and/or modified sequence opt11 from IgG2_HeavyChain_CH2_constant_domain
gccccccccgucgccggccccuccgucuuccucuucccccccaaacccaaagacacccucaugaucucccgcacccccgaagucaccugcgucgucgucgacgucucccacgaagaccccgaaguccaauucaacugguacgucgacggcauggaaguccacaacgccaaaaccaaaccccgcgaagaacaauucaacuccaccuuccgcgucgucuccguccucaccgucguccaccaagacuggcucaacggcaaagaauacaaaugcaaagucuccaacaaaggccuacccuccuccaucgaaaaaaccaucuccaaaaccaaa

SEQ ID NO: 61133 - RNA, 318 nt, Artificial Sequence
  derived and/or modified sequence opt11 from IgG2_HeavyChain_CH3_constant_domain
ggccaaccccgcgaaccccaagucuacacccucccccccucccgcgaagaaaugaccaaaaaccaagucucccucaccugccucgucaaaggcuucuaccccuccgacaucgccgucgaaugggaauccaacggccaacccgaaaacaacuacaaaaccaccccccccaugcucgacuccgacggcuccuucuuccucuacuccaaacucaccgucgacaaaucccgcuggcaacaaggcaacgucuucuccugcuccgucaugcacgaagcccuccacaaccacuacacccaaaaaucccucucccucucccccggc

SEQ ID NO: 61134 - RNA, 297 nt, Artificial Sequence
  derived and/or modified sequence opt11 from IgG4_HeavyChain_CH1_constant_domain
uccgccuccaccaaaggccccuccgucuucccccucgcccccugcucccgcuccaccuccgaauccaccgccgcccucggcugccucgucaaagacuacuuccccgaacccgucaccgucuccuggaacuccggcgcccucaccuccggcguccacaccuuccccgccguccuccaauccuccggccucuacucccucuccuccguagucaccguccccucauccucccucggcaccaaaaccuacaccugcaacgucgaccacaaacccuccaacaccaaagucgacaaacgcguc

SEQ ID NO: 61135 - RNA, 330 nt, Artificial Sequence
  derived and/or modified sequence opt11 from IgG4_HeavyChain_CH2_constant_domain
gcccccgaauuccucggcggccccuccgucuuccucuucccccccaaacccaaagacacccuaaugaucucccgcacccccgaagucaccugcgucgucgucgacgucucccaagaagaccccgaaguccaauucaacugguacgucgacggcgucgaaguccacaacgccaaaaccaaaccccgcgaagaacaauucaacuccaccuaccgcgucgucuccguccucaccguccuccaccaagacuggcucaacggcaaagaauacaaaugcaaagucucaaacaaaggccuccccuccuccaucgaaaaaaccaucuccaaagccaaa

SEQ ID NO: 61136 - RNA, 318 nt, Artificial Sequence
  derived and/or modified sequence opt11 from IgG4_HeavyChain_CH3_constant_domain
ggccaaccccgcgaaccccaagucuacacccucccccccucccaagaagaaaugaccaaaaaccaagucucccuaaccugccucgucaaaggcuucuaccccuccgacaucgccgucgaaugggaauccaacggccaacccgaaaacaacuacaaaaccaccccccccguccucgacuccgacggcuccuucuuccucuacucccgccucaccgucgacaaaucccgcuggcaagaaggcaacgucuucuccugcuccgucaugcacgaagcccuccacaaccacuacacccaaaaaucccucucccucucccucggc

SEQ ID NO: 61137 - DNA, 42 bp, Artificial Sequence
  5'-UTR of human ribosomal protein Large 32 lacking the 5' terminal oligopyrimidine tract
ggcgctgcctacggaggtggcagccatctccttctcggcatc

SEQ ID NO: 61138 - RNA, 42 nt, Artificial Sequence
  5'-UTR of human ribosomal protein Large 32 lacking the 5' terminal oligopyrimidine tract mRNA
ggcgcugccuacggagguggcagccaucuccuucucggcauc

SEQ ID NO: 61139 - DNA, 75 bp, Artificial Sequence
  5'-UTR of human mitochondrial ATP synthase subunit alpha lacking the 5' terminal oligopyrimidine tract
gcggctcggccattttgtcccagtcagtccggaggctgcggctgcagaagtaccgcctgcggagtaactgcaaag

SEQ ID NO: 61140 - RNA, 75 nt, Artificial Sequence
  5'-UTR of human mitochondrial ATP synthase subunit alpha lacking the 5' terminal oligopyrimidine tract mRNA
gcggcucggccauuuugucccagucaguccggaggcugcggcugcagaaguaccgccugcggaguaacugcaaag

SEQ ID NO: 61141 - DNA, 62 bp, Artificial Sequence
  5'-UTR of human peroxisomal multifunctional enzyme type 2 lacking the 5' terminal oligopyrimidine tract
gtcccgcagtcggcgtccagcggctctgcttgttcgtgtgtgtgtcgttgcaggccttattc

SEQ ID NO: 61142 - RNA, 62 nt, Artificial Sequence
  5'-UTR of human peroxisomal multifunctional enzyme type 2 lacking the 5' terminal oligopyrimidine tract mRNA
gucccgcagucggcguccagcggcucugcuuguucgugugugugucguugcaggccuuauuc

SEQ ID NO: 61143 - DNA, 110 bp, Artificial Sequence
  3'-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 61144 - RNA, 110 nt, Artificial Sequence
  3'-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 61145 - DNA, 108 bp, Artificial Sequence
  3'-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 61146 - RNA, 108 nt, Artificial Sequence
  3'-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 61147 - DNA, 132 bp, Artificial Sequence
  3'-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 61148 - RNA, 132 nt, Artificial Sequence
  3'-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 61149 - DNA, 44 bp, Artificial Sequence
  Center, alpha-complex-binding portion of the 3'UTR of an alpha-globin gene (muag)
gcccgatgggcctcccaacgggccctcctcccctccttgcaccg

SEQ ID NO: 61150 - RNA, 44 nt, Artificial Sequence
  Center, alpha-complex-binding portion of the 3'UTR of an alpha-globin gene (muag) mRNA
gcccgaugggccucccaacgggcccuccuccccuccuugcaccg

SEQ ID NO: 61151 - DNA, 186 bp, Artificial Sequence
  3'-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 61152 - RNA, 186 nt, Artificial Sequence
  3'-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 61153 - DNA, 186 bp, Artificial Sequence
  3'-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 61154 - RNA, 186 nt, Artificial Sequence
  3'-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 61155 - DNA, 187 bp, Artificial Sequence
  3'-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 61156 - RNA, 187 nt, Artificial Sequence
  3'-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 61157 - DNA, 24 bp, Artificial Sequence
  histone stem-loop sequence
caaaggctcttttcagagccacca

SEQ ID NO: 61158 - RNA, 24 nt, Artificial Sequence
  histone stem-loop sequence mRNA
caaaggcucuuuucagagccacca

SEQ ID NO: 61159 - DNA, 13 bp, Artificial Sequence
  Kozak
gccgccaccatgg

SEQ ID NO: 61160 - RNA, 13 nt, Artificial Sequence
  Kozak mRNA
gccgccaccaugg

SEQ ID NO: 61161 - DNA, 1344 bp, Artificial Sequence
  Antibody Rituximab - wildtype, heavy chain
caggcgtatctgcagcagagcggcgcggaactggtgcgcccgggcgcgagcgtgaaaatgagctgcaaagcgagcggctatacctttaccagctataacatgcattgggtgaaacagaccccgcgccagggcctggaatggattggcgcgatttatccgggcaacggcgataccagctataaccagaaatttaaaggcaaagcgaccctgaccgtggataaaagcagcagcaccgcgtatatgcagctgagcagcctgaccagcgaagatagcgcggtgtatttttgcgcgcgcgtggtgtattatagcaacagctattggtattttgatgtgtggggcaccggcaccaccgtgaccgtgagcggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagcggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaataa

SEQ ID NO: 61162 - DNA, 1344 bp, Artificial Sequence
  Antibody Rituximab - GC-optimized heavy chain
caggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagtga

SEQ ID NO: 61163 - DNA, 633 bp, Artificial Sequence
  Antibody Rituximab - wildtype, light chain
cagattgtgctgagccagagcccggcgattctgagcgcgagcccgggcgaaaaagtgaccatgacctgccgcgcgagcagcagcgtgagctatatgcattggtatcagcagaaaccgggcagcagcccgaaaccgtggatttatgcgccgagcaacctggcgagcggcgtgccggcgcgctttagcggcagcggcagcggcaccagctatagcctgaccattagccgcgtggaagcggaagatgcggcgacctattattgccagcagtggagctttaacccgccgacctttggcgcgggcaccaaactggaactgaaacgcaccgtggcggcgccgagcgtgtttatttttccgccgagcgatgaacagctgaaaagcggcaccgcgagcgtggtgtgcctgctgaacaacttttatccgcgcgaagcgaaagtgcagtggaaagtggataacgcgctgcagagcggcaacagccaggaaagcgtgaccgaacaggatagcaaagatagcacctatagcctgagcagcaccctgaccctgagcaaagcggattatgaaaaacataaagtgtatgcgtgcgaagtgacccatcagggcctgagcagcccggtgaccaaaagctttaaccgctaa

SEQ ID NO: 61164 - DNA, 633 bp, Artificial Sequence
  Antibody Rituximab - GC-optimized light chain
cagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgctga

SEQ ID NO: 61165 - DNA, 2269 bp, Artificial Sequence
  Antibody Rituximab - modified RNA for the light and heavy chains in the total construct
aagcttaccatggccgtgatggcgccgcggaccctggtcctcctgctgagcggcgccctcgccctgacgcagacctgggccgggcaggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagcatcatcatcatcatcattgaccagatctttctgacatttctgacatttctgacatttctgacatttctgacatttctgacatttctgacatttctgacatttctgacatttctgacatatgcataccatggccgtgatggcgccgcggaccctggtcctcctgctgagcggcgccctcgccctgacgcagacctgggccgggcagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgctgaccactagt

SEQ ID NO: 61166 - DNA, 1359 bp, Artificial Sequence
  Antibody Cetuximab (Erbitux) - wildtype, heavy chain
caggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcagagcaacgataccgcgatttattattgcgcgcgcgcgctgacctattatgattatgaatttgcgtattggggccagggcaccctggtgaccgtgagcgcggcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaacgcgtggaaccgaaaagcccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaataa

SEQ ID NO: 61167 - DNA, 1359 bp, Artificial Sequence
  Antibody Cetuximab (Erbitux) - GC-optimized heavy chain
caggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagtga

SEQ ID NO: 61168 - DNA, 642 bp, Artificial Sequence
  Antibody Cetuximab (Erbitux) - wildtype, light chain
gatattctgctgacccagagcccggtgattctgagcgtgagcccgggcgaacgcgtgagctttagctgccgcgcgagccagagcattggcaccaacattcattggtatcagcagcgcaccaacggcagcccgcgcctgctgattaaatatgcgagcgaaagcattagcggcattccgagccgctttagcggcagcggcagcggcaccgattttaccctgagcattaacagcgtggaaagcgaagatattgcggattattattgccagcagaacaacaactggccgaccacctttggcgcgggcaccaaactggaactgaaacgcaccgtggcggcgccgagcgtgtttatttttccgccgagcgatgaacagctgaaaagcggcaccgcgagcgtggtgtgcctgctgaacaacttttatccgcgcgaagcgaaagtgcagtggaaagtggataacgcgctgcagagcggcaacagccaggaaagcgtgaccgaacaggatagcaaagatagcacctatagcctgagcagcaccctgaccctgagcaaagcggattatgaaaaacataaagtgtatgcgtgcgaagtgacccatcagggcctgagcagcccggtgaccaaaagctttaaccgcggcgcgtaa

SEQ ID NO: 61169 - DNA, 642 bp, Artificial Sequence
  Antibody Cetuximab (Erbitux) - GC-optimized light chain
gacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcctga

SEQ ID NO: 61170 - DNA, 2293 bp, Artificial Sequence
  Antibody Cetuximab (Erbitux) - total construct with GC-optimized heavy and light chains
aagcttaccatggccgtgatggcgccgcggaccctggtcctcctgctgagcggcgccctcgccctgacgcagacctgggccgggcaggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagcatcatcatcatcatcattgaccagatctttctgacatttctgacatttctgacatttctgacatttctgacatttctgacatttctgacatttctgacatttctgacatttctgacatatgcataccatggccgtgatggcgccgcggaccctggtcctcctgctgagcggcgccctcgccctgacgcagacctgggccggggacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcctgaccactagt

SEQ ID NO: 61171 - DNA, 1356 bp, Artificial Sequence
  Antibody Trastuzumab (Herceptin) - wildtype, heavy chain
gaagtgcagctggtggaaagcggcggcggcctggtgcagccgggcggcagcctgcgcctgagctgcgcggcgagcggctttaacattaaagatacctatattcattgggtgcgccaggcgccgggcaaaggcctggaatgggtggcgcgcatttatccgaccaacggctatacccgctatgcggatagcgtgaaaggccgctttaccattagcgcggataccagcaaaaacaccgcgtatctgcagatgaacagcctgcgcgcggaagataccgcggtgtattattgcagccgctggggcggcgatggcttttatgcgatggattattggggccagggcaccctggtgaccgtgagcagcgcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaataa

SEQ ID NO: 61172 - DNA, 1356 bp, Artificial Sequence
  Antibody Trastuzumab (Herceptin) - GC-optimized heavy chain
gaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagtga

SEQ ID NO: 61173 - DNA, 645 bp, Artificial Sequence
  Antibody Trastuzumab (Herceptin) - wildtype, light chain
gatattcagatgacccagagcccgagcagcctgagcgcgagcgtgggcgatcgcgtgaccattacctgccgcgcgagccaggatgtgaacaccgcggtggcgtggtatcagcagaaaccgggcaaagcgccgaaactgctgatttatagcgcgagctttctgtatagcggcgtgccgagccgctttagcggcagccgcagcggcaccgattttaccctgaccattagcagcctgcagccggaagattttgcgacctattattgccagcagcattataccaccccgccgacctttggccagggcaccaaagtggaaattaaacgcaccgtggcggcgccgagcgtgtttatttttccgccgagcgatgaacagctgaaaagcggcaccgcgagcgtggtgtgcctgctgaacaacttttatccgcgcgaagcgaaagtgcagtggaaagtggataacgcgctgcagagcggcaacagccaggaaagcgtgaccgaacaggatagcaaagatagcacctatagcctgagcagcaccctgaccctgagcaaagcggattatgaaaaacataaagtgtatgcgtgcgaagtgacccatcagggcctgagcagcccggtgaccaaaagctttaaccgcggcgaatgctaa

SEQ ID NO: 61174 - DNA, 645 bp, Artificial Sequence
  Antibody Trastuzumab (Herceptin) - GC-optimized light chain
gacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctga

SEQ ID NO: 61175 - DNA, 2295 bp, Artificial Sequence
  Antibody Trastuzumab (Herceptin) - total construct with GC-optimized heavy und light chain
aagcttaccatggccgtgatggcgccgcggaccctggtcctcctgctgagcggcgccctcgccctgacgcagacctgggccggggaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagcatcatcatcatcatcattgaccagatctttctgacatttctgacatttctgacatttctgacatttctgacatttctgacatttctgacatttctgacatttctgacatttctgacatatgcataccatggccgtgatggcgccgcggaccctggtcctcctgctgagcggcgccctcgccctgacgcagacctgggccggggacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctgatgaccactag

SEQ ID NO: 61176 - protein, 4 aa, Artificial Sequence
  localization sequence for the endoplasmic reticulum
KDEL

SEQ ID NO: 61177 - protein, 4 aa, Artificial Sequence
  localization sequence for the endoplasmic reticulum
DDEL

SEQ ID NO: 61178 - protein, 4 aa, Artificial Sequence
  localization sequence for the endoplasmic reticulum
DEEL

SEQ ID NO: 61179 - protein, 4 aa, Artificial Sequence
  localization sequence for the endoplasmic reticulum
QEDL

SEQ ID NO: 61180 - protein, 4 aa, Artificial Sequence
  localization sequence for the endoplasmic reticulum
RDEL

SEQ ID NO: 61181 - protein, 7 aa, Artificial Sequence
  localization sequence for the nucleus
PKKKRKV

SEQ ID NO: 61182 - protein, 7 aa, Artificial Sequence
  localization sequence for the nucleus
PQKKIKS

SEQ ID NO: 61183 - protein, 5 aa, Artificial Sequence
  localization sequence for the nucleus
QPKKP

SEQ ID NO: 61184 - protein, 4 aa, Artificial Sequence
  localization sequence for the nucleus
RKKR

SEQ ID NO: 61185 - protein, 12 aa, Artificial Sequence
  localization sequence for the nuclear region
RKKRRQRRRAHQ

SEQ ID NO: 61186 - protein, 16 aa, Artificial Sequence
  localization sequence for the nuclear region
RQARRNRRRRWRERQR

SEQ ID NO: 61187 - protein, 19 aa, Artificial Sequence
  localization sequence for the nuclear region
MPLTRRRPAASQALAPPTP

SEQ ID NO: 61188 - protein, 15 aa, Artificial Sequence
  localization sequence for the endosomal compartiment
MDDQRDLISNNEQLP

SEQ ID NO: 61189 - protein, 32 aa, Artificial Sequence
  Myristoylation sequence, likalizing the antibody to the mitochondrial matrix
  misc_feature (7)..(8): Xaa can be any naturally occurring amino acid
  misc_feature (32)..(32): Xaa can be any naturally occurring amino acid
MLFNLRXXLNNAAFRHGHNFMVRNFRCGQPLX

SEQ ID NO: 61190 - protein, 8 aa, Artificial Sequence
  sequence for localization of antibodies to the plasma membrane
GCVCSSNP

SEQ ID NO: 61191 - protein, 8 aa, Artificial Sequence
  sequence for localization of antibodies to the plasma membrane
GQTVTTPL

SEQ ID NO: 61192 - protein, 8 aa, Artificial Sequence
  sequence for localization of antibodies to the plasma membrane
GQELSQHE

SEQ ID NO: 61193 - protein, 8 aa, Artificial Sequence
  sequence for localization of antibodies to the plasma membrane
GNSPSYNP

SEQ ID NO: 61194 - protein, 8 aa, Artificial Sequence
  sequence for localization of antibodies to the plasma membrane
GVSGSKGQ

SEQ ID NO: 61195 - protein, 8 aa, Artificial Sequence
  sequence for localization of antibodies to the plasma membrane
GQTITTPL

SEQ ID NO: 61196 - protein, 8 aa, Artificial Sequence
  sequence for localization of antibodies to the plasma membrane
GQTLTTPL

SEQ ID NO: 61197 - protein, 8 aa, Artificial Sequence
  sequence for localization of antibodies to the plasma membrane
GQIFSRSA

SEQ ID NO: 61198 - protein, 8 aa, Artificial Sequence
  sequence for localization of antibodies to the plasma membrane
GQIHGLSP

SEQ ID NO: 61199 - protein, 8 aa, Artificial Sequence
  sequence for localization of antibodies to the plasma membrane
GARASVLS

SEQ ID NO: 61200 - protein, 8 aa, Artificial Sequence
  sequence for localization of antibodies to the plasma membrane
GCTLSAEE

SEQ ID NO: 61201 - protein, 8 aa, Artificial Sequence
  sequence for localization of antibodies to the endoplasmic reticulum
GQNLSTSN

SEQ ID NO: 61202 - protein, 8 aa, Artificial Sequence
  sequence for localization of antibodies to the nucleus
GAALTILV

SEQ ID NO: 61203 - protein, 8 aa, Artificial Sequence
  sequence for localization of antibodies to the nucleus
GAALTLLG

SEQ ID NO: 61204 - protein, 8 aa, Artificial Sequence
  sequence for localization of antibodies to the nucleus endoplasmic reticulum and the cytoplasma
GAQVSSQK

SEQ ID NO: 61205 - protein, 8 aa, Artificial Sequence
  sequence for localization of antibodies to the nucleus endoplasmic reticulum and the cytoplasma
GAQLSRNT

SEQ ID NO: 61206 - protein, 8 aa, Artificial Sequence
  sequence for localization of antibodies to the golgi apparatus, the nucleus, the cytoplasma and the cytoskeleton
GNAAAAKK

SEQ ID NO: 61207 - protein, 8 aa, Artificial Sequence
  sequence for localization of antibodies to the cytoplasma and the cytoskeleton
GNEASYPL

SEQ ID NO: 61208 - protein, 8 aa, Artificial Sequence
  sequence for localization of antibodies to the plasma membrane and the cytoskeleton
GSSKSKPK

SEQ ID NO: 61209 - DNA, 2269 bp, Artificial Sequence
  Alternative sequence of the construct of Fig. 12  (antibody rituximab), wherein the restriction sites have been modified as compared to SEQ ID NO. 6697 of Fig. 12
aagcttaccatggccgtgatggcgccgcggaccctggtcctcctgctgagcggcgccctcgccctgacgcagacctgggccgggcaggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagcatcatcatcatcatcattgaccatgcatttctgacatttctgacatttctgacatttctgacatttctgacatttctgacatttctgacatttctgacatttctgacatttctgacatagatctaccatggccgtgatggcgccgcggaccctggtcctcctgctgagcggcgccctcgccctgacgcagacctgggccgggcagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgctgaccactagt

SEQ ID NO: 61210 - DNA, 2293 bp, Artificial Sequence
  Alternative sequence of the construct of Fig. 17  (antibody cetuximab), wherein the restriction sites have been modified as compared to SEQ ID NO. 6702 of Fig. 17
aagcttaccatggccgtgatggcgccgcggaccctggtcctcctgctgagcggcgccctcgccctgacgcagacctgggccgggcaggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagcatcatcatcatcatcattgaccatgcatttctgacatttctgacatttctgacatttctgacatttctgacatttctgacatttctgacatttctgacatttctgacatttctgacatagatctaccatggccgtgatggcgccgcggaccctggtcctcctgctgagcggcgccctcgccctgacgcagacctgggccggggacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcctgaccactagt

SEQ ID NO: 61211 - DNA, 2295 bp, Artificial Sequence
  Alternative sequence of the construct of Fig. 22  (antibody trastuzumab), wherein the restriction sites have been modified as compared to SEQ ID NO. 6707 of Fig. 22
aagcttaccatggccgtgatggcgccgcggaccctggtcctcctgctgagcggcgccctcgccctgacgcagacctgggccggggaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagcatcatcatcatcatcattgaccatgcatttctgacatttctgacatttctgacatttctgacatttctgacatttctgacatttctgacatttctgacatttctgacatttctgacatagatctaccatggccgtgatggcgccgcggaccctggtcctcctgctgagcggcgccctcgccctgacgcagacctgggccggggacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctgatgaccactag

SEQ ID NO: 61212 - protein, 458 aa, Artificial Sequence
  Protein (HC) w/o signal peptide encoded by mRNA R3578, R3000
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61213 - protein, 452 aa, Artificial Sequence; identical to SEQ ID NO: 154
  Protein (HC) w/o signal peptide & his-tag encoded by mRNA R3578, R3000

SEQ ID NO: 61214 - protein, 213 aa, Artificial Sequence; identical to SEQ ID NO: 156
  Protein (LC) w/o signal peptide encoded by mRNA R3578, R3000

SEQ ID NO: 61215 - RNA, 1374 nt, Artificial Sequence
  CDS (HC) w/o signal peptide encoded by mRNA R3578, R3000
caggugcagcugaagcagagcggcccggggcucguccagcccucgcagagccugagcaucaccugcacggugagcggcuucagccugaccaacuacggggugcacuggguccggcagucgcccggcaaggggcucgaguggcugggcgugaucuggagcggcgggaacaccgacuacaacacccccuucacgagccgccugagcaucaacaaggacaacagcaagucgcagguguucuucaagaugaacagccuccagagcaacgacaccgccaucuacuacugcgcgcgggcccugaccuacuacgacuacgaguucgccuacuggggccaggggacccuggucacggugagcgccgcgagcaccaagggcccgagcguguucccccucgcccccucgagcaagagcaccagcggcgggaccgccgcccugggcugccuggucaaggacuacuuccccgagccggugacggugagcuggaacucgggggcccucaccagcggcguccacaccuuccccgcggugcugcagagcagcgggcuguacagccucagcucgguggucaccgugcccagcagcagccugggcacgcagaccuacaucugcaacgugaaccacaagcccagcaacaccaaggucgacaagcgcguggagccgaagucgcccaagagcugcgacaagacccacacgugcccgcccugccccgcccccgagcugcucggcgggcccagcguguuccuguucccgcccaagcccaaggacacccugaugaucagccggacccccgaggucaccugcgugguggucgacgugagccacgaggacccggaggugaaguucaacugguacgucgacggcguggaggugcacaacgccaagacgaagccccgcgaggagcaguacaacagcaccuaccgggucgugucggugcucaccguccugcaccaggacuggcugaacgggaaggaguacaagugcaaggugagcaacaaggcccuccccgcgcccaucgagaagaccaucagcaaggccaagggccagccgcgcgagccccagguguacacgcugccccccagccgggacgagcugaccaagaaccaggucagccucaccugccuggugaagggguucuacccgucggacaucgccguggagugggagagcaacggccagcccgagaacaacuacaagaccacgcccccgguccuggacagcgacggcagcuucuuccucuacagcaagcugaccguggacaagagccgcuggcagcaggggaacguguucucgugcagcgucaugcacgaggcccugcacaaccacuacacccagaagagccucagccugagccccggcaagcaucaucaucaucaucau

SEQ ID NO: 61216 - RNA, 1356 nt, Artificial Sequence
  CDS (HC) w/o signal peptide & his-tag encoded by mRNA R3578, R3000
caggugcagcugaagcagagcggcccggggcucguccagcccucgcagagccugagcaucaccugcacggugagcggcuucagccugaccaacuacggggugcacuggguccggcagucgcccggcaaggggcucgaguggcugggcgugaucuggagcggcgggaacaccgacuacaacacccccuucacgagccgccugagcaucaacaaggacaacagcaagucgcagguguucuucaagaugaacagccuccagagcaacgacaccgccaucuacuacugcgcgcgggcccugaccuacuacgacuacgaguucgccuacuggggccaggggacccuggucacggugagcgccgcgagcaccaagggcccgagcguguucccccucgcccccucgagcaagagcaccagcggcgggaccgccgcccugggcugccuggucaaggacuacuuccccgagccggugacggugagcuggaacucgggggcccucaccagcggcguccacaccuuccccgcggugcugcagagcagcgggcuguacagccucagcucgguggucaccgugcccagcagcagccugggcacgcagaccuacaucugcaacgugaaccacaagcccagcaacaccaaggucgacaagcgcguggagccgaagucgcccaagagcugcgacaagacccacacgugcccgcccugccccgcccccgagcugcucggcgggcccagcguguuccuguucccgcccaagcccaaggacacccugaugaucagccggacccccgaggucaccugcgugguggucgacgugagccacgaggacccggaggugaaguucaacugguacgucgacggcguggaggugcacaacgccaagacgaagccccgcgaggagcaguacaacagcaccuaccgggucgugucggugcucaccguccugcaccaggacuggcugaacgggaaggaguacaagugcaaggugagcaacaaggcccuccccgcgcccaucgagaagaccaucagcaaggccaagggccagccgcgcgagccccagguguacacgcugccccccagccgggacgagcugaccaagaaccaggucagccucaccugccuggugaagggguucuacccgucggacaucgccguggagugggagagcaacggccagcccgagaacaacuacaagaccacgcccccgguccuggacagcgacggcagcuucuuccucuacagcaagcugaccguggacaagagccgcuggcagcaggggaacguguucucgugcagcgucaugcacgaggcccugcacaaccacuacacccagaagagccucagccugagccccggcaag

SEQ ID NO: 61217 - RNA, 639 nt, Artificial Sequence
  CDS (LC) w/o signal peptide encoded by mRNA R3578, R3000
gacauccugcucacccagagcccggugauccugucggucagccccggcgagcgggugagcuucagcugccgcgccagccagucgaucgggacgaacauccacugguaccagcagcggaccaacggcagcccccgccugcucaucaaguacgcgagcgagagcaucagcgggauccccucgcgguucagcggcagcgggagcggcaccgacuucacccugagcaucaacagcguggagucggaggacaucgccgacuacuacugccagcagaacaacaacuggccgacgaccuucggcgccgggaccaagcuggagcucaagcgcaccgucgccgcgcccagcguguucaucuucccgcccagcgacgagcagcugaagagcggcacggccagcguggucugccugcucaacaacuucuacccccgggaggccaaggugcaguggaagguggacaacgcccugcagucggggaacagccaggagagcgucaccgagcaggacagcaaggacagcaccuacagccugucgagcacccucacgcugagcaaggccgacuacgagaagcacaagguguacgcgugcgaggugacccaccagggccugagcagccccgucaccaagucguucaaccgcggcgcc

SEQ ID NO: 61218 - RNA, 1374 nt, Artificial Sequence
  derived and/or modified sequence opt2 from CDS (HC) w/o signal peptide encoded by mRNA R3578, R3000
cagguccagcucaagcaguccggccccggccucguccagcccucccagucccucuccaucaccugcaccgucuccggcuucucccucaccaacuacggcguccacuggguccgccagucccccggcaagggccucgaguggcucggcgucaucugguccggcggcaacaccgacuacaacacccccuucaccucccgccucuccaucaacaaggacaacuccaagucccaggucuucuucaagaugaacucccuccaguccaacgacaccgccaucuacuacugcgcccgcgcccucaccuacuacgacuacgaguucgccuacuggggccagggcacccucgucaccgucuccgccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaagucccccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaagcaccaccaccaccaccac

SEQ ID NO: 61219 - RNA, 1356 nt, Artificial Sequence; identical to SEQ ID NO: 15438
  derived and/or modified sequence opt2 from CDS (HC) w/o signal peptide & his-tag encoded by mRNA R3578, R3000

SEQ ID NO: 61220 - RNA, 639 nt, Artificial Sequence; identical to SEQ ID NO: 15440
  derived and/or modified sequence opt2 from CDS (LC) w/o signal peptide encoded by mRNA R3578, R3000

SEQ ID NO: 61221 - RNA, 1374 nt, Artificial Sequence
  derived and/or modified sequence opt3 from CDS (HC) w/o signal peptide encoded by mRNA R3578, R3000
caggugcaacugaagcagagcggccccgggcucguccagccuucccagucucuuucaauuaccugcacaguuaguggauucagccugacuaacuacggugugcacuggguaagacaauccccaggcaaaggguuggagugguuaggagugaucuggucuggcgguaauacggacuauaacaccccguuuacaucgaggcugucaauaaauaaggauaacagcaaaagucaggucuucuuuaagaugaauagccuacagucuaacgacacugcuaucuacuauugugcucgggcacucaccuacuaugauuacgaguucgccuauugggggcagggaacacuggugaccguuagcgcggcuuccacuaaaggccccucaguguuuccucuugccccaaguagcaagucuacauccggcgggaccgcagcccugggaugcuuggucaaggacuacuuccccgaaccugugacgguaucauggaauagcggugcucucacaaguggcguucauaccuuuccagcagugcugcaaucuuccgggcuguacagccucucgucugucgugacagugcccuccucaaguuuaggaacucagaccuauauuuguaacgucaaucacaaaccuagcaacacaaagguugauaaacgcguggaaccaaaguccccgaaaucuugcgacaagacccauacgugucccccuugcccagcccccgagcugcuuggcgguccuagcguauucuuguuuccacccaagccgaaagauacucugaugaucucacgaacaccugaagugaccugugucgugguugacgugagucacgaggaucccgaggucaaguucaauugguacguggacgggguagaaguucauaacgcuaaaacuaagccacgugaggaacaguauaauuccacauacagaguggucagcgugcuaaccguccuccaccaggauuggcugaacggaaaagaguauaagugcaaagugucuaauaaggcccuuccugcgcccauugagaagacgaucucaaaagcaaagggccaaccaagggaaccccagguuuacacccugccuccaagucgggacgaguugacuaaaaaccaggugagccucacuugucugguaaagggcuuuuauccguccgauauagccgucgaaugggagucuaacgggcaacccgaaaauaacuacaaaaccacaccuccaguguuagacucggacggauccuucuuucuguacuccaagcucacuguugauaagucacgcuggcagcaggguaauguguucaguugcucugucaugcacgaggcccuucauaaccacuauacccagaaaagccuguccuugucacccggcaagcaucaccaccaucaccau

SEQ ID NO: 61222 - RNA, 1356 nt, Artificial Sequence; identical to SEQ ID NO: 23080
  derived and/or modified sequence opt3 from CDS (HC) w/o signal peptide & his-tag encoded by mRNA R3578, R3000

SEQ ID NO: 61223 - RNA, 639 nt, Artificial Sequence; identical to SEQ ID NO: 23082
  derived and/or modified sequence opt3 from CDS (LC) w/o signal peptide encoded by mRNA R3578, R3000

SEQ ID NO: 61224 - RNA, 1374 nt, Artificial Sequence
  derived and/or modified sequence opt4 from CDS (HC) w/o signal peptide encoded by mRNA R3578, R3000
caggugcagcugaagcagagcggccccggccuggugcagcccagccagagccugagcaucaccugcaccgugagcggcuucagccugaccaacuacggcgugcacugggugagacagagccccggcaagggccuggaguggcugggcgugaucuggagcggcggcaacaccgacuacaacacccccuucaccagcagacugagcaucaacaaggacaacagcaagagccagguguucuucaagaugaacagccugcagagcaacgacaccgccaucuacuacugcgccagagcccugaccuacuacgacuacgaguucgccuacuggggccagggcacccuggugaccgugagcgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagccccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaagcaccaccaccaccaccac

SEQ ID NO: 61225 - RNA, 1356 nt, Artificial Sequence; identical to SEQ ID NO: 30722
  derived and/or modified sequence opt4 from CDS (HC) w/o signal peptide & his-tag encoded by mRNA R3578, R3000

SEQ ID NO: 61226 - RNA, 639 nt, Artificial Sequence; identical to SEQ ID NO: 30724
  derived and/or modified sequence opt4 from CDS (LC) w/o signal peptide encoded by mRNA R3578, R3000

SEQ ID NO: 61227 - RNA, 1374 nt, Artificial Sequence
  derived and/or modified sequence opt5 from CDS (HC) w/o signal peptide encoded by mRNA R3578, R3000
caggugcaacugaagcagagcggccccgggcucguccagccuucccagucucugagcaucacaugcacaguuuccggauucucucuuacgaacuacggcgugcacugggugagacaaagcccggggaaaggacuggaguggcucggcgucauuugguccgggggaaauaccgacuauaacacacccuuuaccucucggcugagcaucaauaaggauaacuccaaaagccagguguucuuuaagaugaacucucuucaguccaaugacacagccauuuacuauugugcucgcgcccugaccuacuaugauuacgaguucgcguauuggggccagggcacacucguuaccgugagcgcugccucuacgaaagggccuuccgucuuuccccuggccccuagcucuaaguccaccagcggaggcacagcugcccuggggugccucgugaaggacuacuuccccgaaccuguuaccguguccuggaacucuggagcucugacaagcggcguccauaccuuuccggccgugcuucaauccagcgggcuguacucucucuccagcguggucacgguucccucuagcucccugggaacacagaccuauaucuguaaugugaaucacaaaccuucuaacacaaagguggauaaaagagucgaacccaagagcccuaaauccugcgacaagacccauaccugucccccgugcccugcgcccgagcuucugggcggcccuagcguguuccucuuuccucccaagcccaaagauacacugaugauuucucggacgccggaaguuaccuguguggucguggacguuucccacgaggaucccgaggugaaguucaauugguacgucgacgggguggaaguccauaacgccaaaacaaagccucgcgaggaacaguauaauagcaccuacagagugguuucugugcugacaguccuccaccaggauuggcugaacggaaaagaguauaagugcaaaguguccaauaaggcccuucccgcuccuaucgagaagaccaucagcaaagcuaagggccaaccccgggaaccgcagguuuacacgcugccucccucccgcgacgagcucaccaaaaaccaggugucucugaccugucuugucaagggguuuuauccuagcgauauugccguggaaugggaguccaacggacaacccgaaaauaacuacaaaaccacaccucccgugcuggacucugacggcagcuucuuucucuacuccaagcugaccguugauaagagcagauggcagcaggggaaugucuucucuugcuccgugaugcacgaggcgcugcauaaccacuauacacagaaaagccucucucuguccccgggaaagcaucaccaccaucaccau

SEQ ID NO: 61228 - RNA, 1356 nt, Artificial Sequence; identical to SEQ ID NO: 38364
  derived and/or modified sequence opt5 from CDS (HC) w/o signal peptide & his-tag encoded by mRNA R3578, R3000

SEQ ID NO: 61229 - RNA, 639 nt, Artificial Sequence; identical to SEQ ID NO: 38366
  derived and/or modified sequence opt5 from CDS (LC) w/o signal peptide encoded by mRNA R3578, R3000

SEQ ID NO: 61230 - RNA, 1374 nt, Artificial Sequence
  derived and/or modified sequence opt6 from CDS (HC) w/o signal peptide encoded by mRNA R3578, R3000
caaguacaacucaaacaaucaggaccaggacuuguccaaccuucccaauccuuaucaauaacaugcacaguaucaggauucuccuuaacaaacuacggaguacacuggguccgccaauccccaggcaaaggacuagaauggcuaggaguuauaugguccggaggaaauacagacuacaacacaccauuuacaucaagacucucaauaaauaaagacaauuccaaaucacaagucuucuucaaaaugaacucuuuacaauccaacgacacagcuaucuacuacugcgcccgugcucuaacauacuacgauuacgaauuugcauacuggggacaaggaacauuaguuaccgucucagccgcuucaacuaaaggaccauccguauucccacuagcuccaagcuccaaaucaacauccggaggaacagcagcucuaggaugucucgucaaagacuacuuccccgaaccaguaaccguaucauggaacucaggagcacuaacaucugguguacauaccuucccagcaguacuacaaucaucagguuuauacucauuaucaagcguaguaacagucccaucuucaucacuaggaacacaaacguacauauguaauguaaaccacaaaccuuccaauacaaaaguagacaaaagaguagaacccaaaucucccaaaucaugcgauaaaacccacacauguccaccaugccccgcuccagaacuacuaggaggcccauccgucuuucuauucccaccaaaaccuaaagauacccuaaugauuucacgcacaccagaaguaacuugcguaguaguagacguaucacacgaagauccugaaguaaaauuuaacugguauguagacggaguagaaguacacaaugcaaaaaccaaaccccgugaagaacaauauaacuccacauacagaguaguaucuguacuuacaguacuccaccaagacugguuaaauggaaaagaauacaaaugcaaaguauccaacaaagccuuaccagcucccauagaaaaaaccauaucaaaagcaaaaggucaaccaagagaaccacaaguuuauacccuaccaccuucuagagaugaacuaaccaaaaaccaaguaucacuuacaugccuagucaaaggcuucuauccaucugauaucgcagucgaaugggaaaguaacggacaaccagaaaacaacuacaaaacuacaccuccaguacuagauuccgacggcucauucuuccuauauucaaaauuaacuguggauaaaucaagauggcaacaaggcaauguauucucaugcucaguaaugcaugaagcauuacacaaccauuacacacaaaaaucccucucauuaucacccggaaaacaccaucaucaccaccac

SEQ ID NO: 61231 - RNA, 1356 nt, Artificial Sequence
  derived and/or modified sequence opt6 from CDS (HC) w/o signal peptide & his-tag encoded by mRNA R3578, R3000
caaguucaauuaaaacaaucaggaccuggauuaguacaacccucccaaagccuauccaucacaugcacaguaucaggauuuucucucacaaacuauggaguccacuggguacgacaaucaccaggaaaaggucuagaauggcuaggaguaauauggucuggcggcaacacagacuacaacaccccauucacaucaagauuaucuauaaacaaagauaacucaaaaucacaagucuuuuucaaaaugaauagucuacaaucaaaugauacagcaauauauuacugcgcacgagcucuaacauacuaugacuacgaauuugcuuacuggggucaaggaacucuagucaccguaucagcugccucaacaaaaggaccaucaguauucccccuagcaccaucaucuaaaucaacaucaggcggaacugcagcauuaggaugccucguaaaagacuacuucccagaaccaguaacagucucauggaacucaggcgcacucacaucagguguacacacauucccagcuguauuacaaucaucaggccuauacucccucucaucugucguaacaguuccaaguucauccuuagguacacaaacauacauaugcaauguaaaucacaaaccaucaaacaccaaagucgauaaaagagucgaaccaaaaagcccaaaaucuugcgauaaaacacacacaugucccccuugcccagccccagaauuacuagguggaccuucagucuuucuauucccaccuaaaccuaaagacacauuaaugauaucaagaacacccgaaguuacauguguaguuguagaugucucacaugaagauccugaaguaaaauucaacugguacgucgacggaguagaaguacacaacgcaaaaacaaaaccaagagaagaacaauacaauucaaccuaccgugucgucucaguacuaaccguucuucaccaagacuggcuaaauggaaaagaauacaaauguaaaguaucaaauaaagcauuacccgccccaaucgaaaagacaauaucaaaagcuaaaggucaaccaagagaaccucaaguauauacccuaccaccaucuagagacgaauuaaccaaaaaucaaguaucauuaacuugccuaguaaaaggcuucuaccccuccgacauugcuguagaaugggaaucuaacggccaaccagaaaauaacuauaaaacaacaccaccaguccuagacucagacggaucuuucuucuuauauucaaaacuaacaguagacaaauccagauggcaacaaggaaaugucuucuccugcucaguaaugcaugaagcacuacacaaccacuacacacaaaaaucccucagccucucccccggaaaa

SEQ ID NO: 61232 - RNA, 639 nt, Artificial Sequence
  derived and/or modified sequence opt6 from CDS (LC) w/o signal peptide encoded by mRNA R3578, R3000
gacauacuacuaacacaaucaccaguaauauuauccguauccccaggcgaaagaguaucauucucaugcagagcaucacaaucaauaggaacaaacauacacugguaccaacaaagaacuaacggaucaccaagacuauuaauaaaauacgcaucagaauccauaucaggaauaccaucaagauucucaggaucaggaucaggaacagacuucacacuauccauaaacucaguagaauccgaagacauagccgacuacuacugccaacaaaacaacaacuggccaacaacauuuggagccggaacaaaauuagaacucaaaagaacaguagcagccccaucaguauucauauucccacccuccgacgaacaacuaaaaucagguacagcaucaguaguaugccuacuaaacaacuucuacccaagagaagcaaaaguacaauggaaaguagacaacgcacuacaaucaggaaacucacaagaaucaguaacagaacaagauucaaaagacucaacauacucacuaucaucaacauuaacacuauccaaagccgauuacgaaaaacacaaaguauacgcaugcgaaguaacacaucaaggccuaucaucaccaguaacaaaaucauucaacagaggagca

SEQ ID NO: 61233 - RNA, 1374 nt, Artificial Sequence
  derived and/or modified sequence opt11 from CDS (HC) w/o signal peptide encoded by mRNA R3578, R3000
caaguccaacuuaaacaaucaggccccggccucguacaacccucccaaucgcuuucaaucaccuguaccgucucaggcuucucucucaccaacuacggcguucauuggguccgccaaucccccggcaaaggccucgaauggcucggcgucaucugguccggcggcaauacagacuacaacacccccuuuaccucccgccucucaaucaacaaagacaacuccaaaucucaggucuucuucaaaaugaauagccuccaauccaacgacaccgcuaucuauuacugugcacgcgcucugacuuacuacgacuacgaauuugcauacuggggacaaggcacccuagucaccguauccgccgccuccacuaagggccccucugucuucccccuagccccauccuccaagagcaccuccggcggaaccgccgcacuaggcugccucgucaaagacuacuucccagaacccgucaccgucuccuggaacucaggugcccuaaccucaggcguccacacauuccccgccguucugcaauccucaggccuuuacucucucucuucaguuguaaccguccccuccucuagccucggcacccaaacuuauauuugcaacguaaaccacaaaccauccaauacaaaaguagacaaaagagucgaacccaaaagccccaaauccugcgacaaaacccauaccugcccacccugccccgcacccgaacuacucggcggccccuccgucuuccucuucccacccaaacccaaagacacccucaugaucucccgcacacccgaaguaaccugcgucgucgucgacguuagccacgaagaccccgaaguuaaauucaacugguacguagacgguguagaaguccacaaugcaaagaccaaaccccgcgaagaacaauacaauucaaccuaucgaguaguauccguccucacuguacuccaccaagacuggcuaaacggcaaagaauacaaaugcaaaguaagcaacaaagcccuacccgcccccauagaaaagacaauaagcaaagcuaaaggccaaccccgcgaaccccaagucuacacccucccacccucacgugacgaacucaccaaaaaccaaguaucauuaacuugccucgucaaaggcuucuaccccuccgacaucgccgucgaaugggaauccaauggccaaccagaaaacaacuacaaaaccacaccacccguccucgacuccgauggaucuuucuuucucuacuccaaacuaacagucgacaaaagccgauggcaacaaggcaacguuuucuccugcuccgucaugcacgaagcccuacacaaccacuacacccaaaaaucccucucccuaucccccggcaaacaccaccaccaccaccac

SEQ ID NO: 61234 - RNA, 1356 nt, Artificial Sequence
  derived and/or modified sequence opt11 from CDS (HC) w/o signal peptide & his-tag encoded by mRNA R3578, R3000
caaguccagcuaaaacaguccggccccggccugguccaaccaucccaaucccuauccaucacuugcaccgucuccggcuucucccucacuaacuacggcguccacuggguccgccaaagccccggaaaaggccucgaauggcuuggagucauauggucgggcggcaacacagacuacaacacgcccuucaccucacgauuaucaaucaacaaagacaacagcaaaagccaagucuucuucaaaaugaacucacuccaaucaaacgacacagccaucuacuacugcgcccgugcccucacauacuacgacuacgaguucgccuacuggggacaaggcacucucguaaccguuagcgccgcaucuaccaagggccccagcgucuuuccacucgcccccuccuccaaaucuaccuccggcggaaccgccgcccuuggcugccucguaaaagacuacuuccccgaaccaguaaccguuuccuggaacuccggagcacucaccuccggcguacacacauucccagccguccuccaauccuccggccucuacucacucuccuccguagucacggucccguccuccucccucggcacccaaacauauaucugcaaugucaaucacaaacccuccaacaccaaaguagacaaacgcgucgaacccaaaucccccaaaagcugcgacaaaacccacacaugcccucccugcccagcccccgaauuacuaggcggccccuccguauuccuauucccacccaaacccaaagacacgcucaugaucuccagaacccccgaaguaaccugcgucgucgucgacgucucccaugaagaccccgaagucaaauucaacugguacgucgacggagucgaaguccacaacgccaaaaccaaaccccgcgaagaacaauacaacuccacauaccgaguagucuccguucuaaccguccuacaccaagacuggcucaacggcaaagaauacaaaugcaaagucucaaacaaagcccuucccgcccccaucgaaaagaccaucucaaaagccaaaggacaaccccgagaaccacaagucuauacacucccacccucacgugacgaacuaaccaaaaaccaagucucccuaaccugccuaguaaaagguuucuaccccuccgacauugccgucgaaugggaaagcaauggccagcccgaaaacaacuacaaaaccaccccacccguccucgacuccgacggcagcuucuuccuauacuccaaacucacaguagacaaaucccgcuggcaacagggcaacguauucucaugcuccguuaugcacgaagcacuccacaaccacuacacccaaaaaucacuaucacuaucucccggcaaa

SEQ ID NO: 61235 - RNA, 639 nt, Artificial Sequence
  derived and/or modified sequence opt11 from CDS (LC) w/o signal peptide encoded by mRNA R3578, R3000
gacauccuccucacccaaucccccguaauccucuccgucucacccggcgaacgcgucuccuucuccugccgcgccucccaauccaucggaaccaacauacacugguaccaacaacgaaccaacggaucccccagacuccuaaucaaauacgcauccgaauccaucuccggaauccccucccgcuucuccggcucaggcuccggcaccgacuucacccuauccaucaacucagucgaauccgaagacaucgccgacuacuacugccaacaaaacaacaacuggcccaccacauucggcgccggaaccaaacucgaacucaaacgaaccgucgccgcccccuccgucuucaucuucccacccuccgacgaacaacucaaauccggcaccgccucugucgucugccuccucaacaacuucuacccccgcgaagccaaaguccaauggaaagucgacaacgcacuucaauccggcaacucccaagaaucagucaccgaacaagacuccaaagacuccaccuacucccuauccucaacacucacccucagcaaagccgacuacgaaaaacacaaaguauacgccugcgaagucacccaccaaggccuuuccucccccgucaccaaauccuucaaccgaggagcc

SEQ ID NO: 61236 - protein, 477 aa, Artificial Sequence
  Protein 1 (HC) w/o his-tag encoded by mRNA R3578, R3000
MAVMAPRTLVLLLSGALALTQTWAGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61237 - protein, 483 aa, Artificial Sequence
  Protein 1 (HC) encoded by mRNA R3578, R3000
MAVMAPRTLVLLLSGALALTQTWAGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61238 - protein, 238 aa, Artificial Sequence
  Protein 2 (LC) encoded by mRNA R3578, R3000
MAVMAPRTLVLLLSGALALTQTWAGDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGA

SEQ ID NO: 61239 - RNA, 1434 nt, Artificial Sequence
  CDS 1 (HC) w/o his-tag as RNA from mRNA R3578, R3000
auggccgugauggcgccgcggacccugguccuccugcugagcggcgcccucgcccugacgcagaccugggccgggcaggugcagcugaagcagagcggcccggggcucguccagcccucgcagagccugagcaucaccugcacggugagcggcuucagccugaccaacuacggggugcacuggguccggcagucgcccggcaaggggcucgaguggcugggcgugaucuggagcggcgggaacaccgacuacaacacccccuucacgagccgccugagcaucaacaaggacaacagcaagucgcagguguucuucaagaugaacagccuccagagcaacgacaccgccaucuacuacugcgcgcgggcccugaccuacuacgacuacgaguucgccuacuggggccaggggacccuggucacggugagcgccgcgagcaccaagggcccgagcguguucccccucgcccccucgagcaagagcaccagcggcgggaccgccgcccugggcugccuggucaaggacuacuuccccgagccggugacggugagcuggaacucgggggcccucaccagcggcguccacaccuuccccgcggugcugcagagcagcgggcuguacagccucagcucgguggucaccgugcccagcagcagccugggcacgcagaccuacaucugcaacgugaaccacaagcccagcaacaccaaggucgacaagcgcguggagccgaagucgcccaagagcugcgacaagacccacacgugcccgcccugccccgcccccgagcugcucggcgggcccagcguguuccuguucccgcccaagcccaaggacacccugaugaucagccggacccccgaggucaccugcgugguggucgacgugagccacgaggacccggaggugaaguucaacugguacgucgacggcguggaggugcacaacgccaagacgaagccccgcgaggagcaguacaacagcaccuaccgggucgugucggugcucaccguccugcaccaggacuggcugaacgggaaggaguacaagugcaaggugagcaacaaggcccuccccgcgcccaucgagaagaccaucagcaaggccaagggccagccgcgcgagccccagguguacacgcugccccccagccgggacgagcugaccaagaaccaggucagccucaccugccuggugaagggguucuacccgucggacaucgccguggagugggagagcaacggccagcccgagaacaacuacaagaccacgcccccgguccuggacagcgacggcagcuucuuccucuacagcaagcugaccguggacaagagccgcuggcagcaggggaacguguucucgugcagcgucaugcacgaggcccugcacaaccacuacacccagaagagccucagccugagccccggcaaguga

SEQ ID NO: 61240 - RNA, 1452 nt, Artificial Sequence
  CDS 1 (HC) as RNA from mRNA R3578, R3000
auggccgugauggcgccgcggacccugguccuccugcugagcggcgcccucgcccugacgcagaccugggccgggcaggugcagcugaagcagagcggcccggggcucguccagcccucgcagagccugagcaucaccugcacggugagcggcuucagccugaccaacuacggggugcacuggguccggcagucgcccggcaaggggcucgaguggcugggcgugaucuggagcggcgggaacaccgacuacaacacccccuucacgagccgccugagcaucaacaaggacaacagcaagucgcagguguucuucaagaugaacagccuccagagcaacgacaccgccaucuacuacugcgcgcgggcccugaccuacuacgacuacgaguucgccuacuggggccaggggacccuggucacggugagcgccgcgagcaccaagggcccgagcguguucccccucgcccccucgagcaagagcaccagcggcgggaccgccgcccugggcugccuggucaaggacuacuuccccgagccggugacggugagcuggaacucgggggcccucaccagcggcguccacaccuuccccgcggugcugcagagcagcgggcuguacagccucagcucgguggucaccgugcccagcagcagccugggcacgcagaccuacaucugcaacgugaaccacaagcccagcaacaccaaggucgacaagcgcguggagccgaagucgcccaagagcugcgacaagacccacacgugcccgcccugccccgcccccgagcugcucggcgggcccagcguguuccuguucccgcccaagcccaaggacacccugaugaucagccggacccccgaggucaccugcgugguggucgacgugagccacgaggacccggaggugaaguucaacugguacgucgacggcguggaggugcacaacgccaagacgaagccccgcgaggagcaguacaacagcaccuaccgggucgugucggugcucaccguccugcaccaggacuggcugaacgggaaggaguacaagugcaaggugagcaacaaggcccuccccgcgcccaucgagaagaccaucagcaaggccaagggccagccgcgcgagccccagguguacacgcugccccccagccgggacgagcugaccaagaaccaggucagccucaccugccuggugaagggguucuacccgucggacaucgccguggagugggagagcaacggccagcccgagaacaacuacaagaccacgcccccgguccuggacagcgacggcagcuucuuccucuacagcaagcugaccguggacaagagccgcuggcagcaggggaacguguucucgugcagcgucaugcacgaggcccugcacaaccacuacacccagaagagccucagccugagccccggcaagcaucaucaucaucaucauuga

SEQ ID NO: 61241 - RNA, 717 nt, Artificial Sequence
  CDS 2 (LC) as RNA from mRNA R3578, R3000
auggccgugauggcgccgcggacccugguccuccugcugagcggcgcccucgcccugacgcagaccugggccggggacauccugcucacccagagcccggugauccugucggucagccccggcgagcgggugagcuucagcugccgcgccagccagucgaucgggacgaacauccacugguaccagcagcggaccaacggcagcccccgccugcucaucaaguacgcgagcgagagcaucagcgggauccccucgcgguucagcggcagcgggagcggcaccgacuucacccugagcaucaacagcguggagucggaggacaucgccgacuacuacugccagcagaacaacaacuggccgacgaccuucggcgccgggaccaagcuggagcucaagcgcaccgucgccgcgcccagcguguucaucuucccgcccagcgacgagcagcugaagagcggcacggccagcguggucugccugcucaacaacuucuacccccgggaggccaaggugcaguggaagguggacaacgcccugcagucggggaacagccaggagagcgucaccgagcaggacagcaaggacagcaccuacagccugucgagcacccucacgcugagcaaggccgacuacgagaagcacaagguguacgcgugcgaggugacccaccagggccugagcagccccgucaccaagucguucaaccgcggcgccuga

SEQ ID NO: 61242 - RNA, 2848 nt, Artificial Sequence
  CDS (HC)-IRES-CDS (LC) as RNA from mRNA R3578, R3000
auggccgugauggcgccgcggacccugguccuccugcugagcggcgcccucgcccugacgcagaccugggccgggcaggugcagcugaagcagagcggcccggggcucguccagcccucgcagagccugagcaucaccugcacggugagcggcuucagccugaccaacuacggggugcacuggguccggcagucgcccggcaaggggcucgaguggcugggcgugaucuggagcggcgggaacaccgacuacaacacccccuucacgagccgccugagcaucaacaaggacaacagcaagucgcagguguucuucaagaugaacagccuccagagcaacgacaccgccaucuacuacugcgcgcgggcccugaccuacuacgacuacgaguucgccuacuggggccaggggacccuggucacggugagcgccgcgagcaccaagggcccgagcguguucccccucgcccccucgagcaagagcaccagcggcgggaccgccgcccugggcugccuggucaaggacuacuuccccgagccggugacggugagcuggaacucgggggcccucaccagcggcguccacaccuuccccgcggugcugcagagcagcgggcuguacagccucagcucgguggucaccgugcccagcagcagccugggcacgcagaccuacaucugcaacgugaaccacaagcccagcaacaccaaggucgacaagcgcguggagccgaagucgcccaagagcugcgacaagacccacacgugcccgcccugccccgcccccgagcugcucggcgggcccagcguguuccuguucccgcccaagcccaaggacacccugaugaucagccggacccccgaggucaccugcgugguggucgacgugagccacgaggacccggaggugaaguucaacugguacgucgacggcguggaggugcacaacgccaagacgaagccccgcgaggagcaguacaacagcaccuaccgggucgugucggugcucaccguccugcaccaggacuggcugaacgggaaggaguacaagugcaaggugagcaacaaggcccuccccgcgcccaucgagaagaccaucagcaaggccaagggccagccgcgcgagccccagguguacacgcugccccccagccgggacgagcugaccaagaaccaggucagccucaccugccuggugaagggguucuacccgucggacaucgccguggagugggagagcaacggccagcccgagaacaacuacaagaccacgcccccgguccuggacagcgacggcagcuucuuccucuacagcaagcugaccguggacaagagccgcuggcagcaggggaacguguucucgugcagcgucaugcacgaggcccugcacaaccacuacacccagaagagccucagccugagccccggcaagcaucaucaucaucaucauugaccaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacauccugcucacccagagcccggugauccugucggucagccccggcgagcgggugagcuucagcugccgcgccagccagucgaucgggacgaacauccacugguaccagcagcggaccaacggcagcccccgccugcucaucaaguacgcgagcgagagcaucagcgggauccccucgcgguucagcggcagcgggagcggcaccgacuucacccugagcaucaacagcguggagucggaggacaucgccgacuacuacugccagcagaacaacaacuggccgacgaccuucggcgccgggaccaagcuggagcucaagcgcaccgucgccgcgcccagcguguucaucuucccgcccagcgacgagcagcugaagagcggcacggccagcguggucugccugcucaacaacuucuacccccgggaggccaaggugcaguggaagguggacaacgcccugcagucggggaacagccaggagagcgucaccgagcaggacagcaaggacagcaccuacagccugucgagcacccucacgcugagcaaggccgacuacgagaagcacaagguguacgcgugcgaggugacccaccagggccugagcagccccgucaccaagucguucaaccgcggcgccuga

SEQ ID NO: 61243 - RNA, 3040 nt, Artificial Sequence
  R3578
gggagaaagcuuaccauggccgugauggcgccgcggacccugguccuccugcugagcggcgcccucgcccugacgcagaccugggccgggcaggugcagcugaagcagagcggcccggggcucguccagcccucgcagagccugagcaucaccugcacggugagcggcuucagccugaccaacuacggggugcacuggguccggcagucgcccggcaaggggcucgaguggcugggcgugaucuggagcggcgggaacaccgacuacaacacccccuucacgagccgccugagcaucaacaaggacaacagcaagucgcagguguucuucaagaugaacagccuccagagcaacgacaccgccaucuacuacugcgcgcgggcccugaccuacuacgacuacgaguucgccuacuggggccaggggacccuggucacggugagcgccgcgagcaccaagggcccgagcguguucccccucgcccccucgagcaagagcaccagcggcgggaccgccgcccugggcugccuggucaaggacuacuuccccgagccggugacggugagcuggaacucgggggcccucaccagcggcguccacaccuuccccgcggugcugcagagcagcgggcuguacagccucagcucgguggucaccgugcccagcagcagccugggcacgcagaccuacaucugcaacgugaaccacaagcccagcaacaccaaggucgacaagcgcguggagccgaagucgcccaagagcugcgacaagacccacacgugcccgcccugccccgcccccgagcugcucggcgggcccagcguguuccuguucccgcccaagcccaaggacacccugaugaucagccggacccccgaggucaccugcgugguggucgacgugagccacgaggacccggaggugaaguucaacugguacgucgacggcguggaggugcacaacgccaagacgaagccccgcgaggagcaguacaacagcaccuaccgggucgugucggugcucaccguccugcaccaggacuggcugaacgggaaggaguacaagugcaaggugagcaacaaggcccuccccgcgcccaucgagaagaccaucagcaaggccaagggccagccgcgcgagccccagguguacacgcugccccccagccgggacgagcugaccaagaaccaggucagccucaccugccuggugaagggguucuacccgucggacaucgccguggagugggagagcaacggccagcccgagaacaacuacaagaccacgcccccgguccuggacagcgacggcagcuucuuccucuacagcaagcugaccguggacaagagccgcuggcagcaggggaacguguucucgugcagcgucaugcacgaggcccugcacaaccacuacacccagaagagccucagccugagccccggcaagcaucaucaucaucaucauugaccaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacauccugcucacccagagcccggugauccugucggucagccccggcgagcgggugagcuucagcugccgcgccagccagucgaucgggacgaacauccacugguaccagcagcggaccaacggcagcccccgccugcucaucaaguacgcgagcgagagcaucagcgggauccccucgcgguucagcggcagcgggagcggcaccgacuucacccugagcaucaacagcguggagucggaggacaucgccgacuacuacugccagcagaacaacaacuggccgacgaccuucggcgccgggaccaagcuggagcucaagcgcaccgucgccgcgcccagcguguucaucuucccgcccagcgacgagcagcugaagagcggcacggccagcguggucugccugcucaacaacuucuacccccgggaggccaaggugcaguggaagguggacaacgcccugcagucggggaacagccaggagagcgucaccgagcaggacagcaaggacagcaccuacagccugucgagcacccucacgcugagcaaggccgacuacgagaagcacaagguguacgcgugcgaggugacccaccagggccugagcagccccgucaccaagucguucaaccgcggcgccugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61244 - RNA, 3052 nt, Artificial Sequence
  R3000
gggagaaagcuuaccauggccgugauggcgccgcggacccugguccuccugcugagcggcgcccucgcccugacgcagaccugggccgggcaggugcagcugaagcagagcggcccggggcucguccagcccucgcagagccugagcaucaccugcacggugagcggcuucagccugaccaacuacggggugcacuggguccggcagucgcccggcaaggggcucgaguggcugggcgugaucuggagcggcgggaacaccgacuacaacacccccuucacgagccgccugagcaucaacaaggacaacagcaagucgcagguguucuucaagaugaacagccuccagagcaacgacaccgccaucuacuacugcgcgcgggcccugaccuacuacgacuacgaguucgccuacuggggccaggggacccuggucacggugagcgccgcgagcaccaagggcccgagcguguucccccucgcccccucgagcaagagcaccagcggcgggaccgccgcccugggcugccuggucaaggacuacuuccccgagccggugacggugagcuggaacucgggggcccucaccagcggcguccacaccuuccccgcggugcugcagagcagcgggcuguacagccucagcucgguggucaccgugcccagcagcagccugggcacgcagaccuacaucugcaacgugaaccacaagcccagcaacaccaaggucgacaagcgcguggagccgaagucgcccaagagcugcgacaagacccacacgugcccgcccugccccgcccccgagcugcucggcgggcccagcguguuccuguucccgcccaagcccaaggacacccugaugaucagccggacccccgaggucaccugcgugguggucgacgugagccacgaggacccggaggugaaguucaacugguacgucgacggcguggaggugcacaacgccaagacgaagccccgcgaggagcaguacaacagcaccuaccgggucgugucggugcucaccguccugcaccaggacuggcugaacgggaaggaguacaagugcaaggugagcaacaaggcccuccccgcgcccaucgagaagaccaucagcaaggccaagggccagccgcgcgagccccagguguacacgcugccccccagccgggacgagcugaccaagaaccaggucagccucaccugccuggugaagggguucuacccgucggacaucgccguggagugggagagcaacggccagcccgagaacaacuacaagaccacgcccccgguccuggacagcgacggcagcuucuuccucuacagcaagcugaccguggacaagagccgcuggcagcaggggaacguguucucgugcagcgucaugcacgaggcccugcacaaccacuacacccagaagagccucagccugagccccggcaagcaucaucaucaucaucauugaccaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacauccugcucacccagagcccggugauccugucggucagccccggcgagcgggugagcuucagcugccgcgccagccagucgaucgggacgaacauccacugguaccagcagcggaccaacggcagcccccgccugcucaucaaguacgcgagcgagagcaucagcgggauccccucgcgguucagcggcagcgggagcggcaccgacuucacccugagcaucaacagcguggagucggaggacaucgccgacuacuacugccagcagaacaacaacuggccgacgaccuucggcgccgggaccaagcuggagcucaagcgcaccgucgccgcgcccagcguguucaucuucccgcccagcgacgagcagcugaagagcggcacggccagcguggucugccugcucaacaacuucuacccccgggaggccaaggugcaguggaagguggacaacgcccugcagucggggaacagccaggagagcgucaccgagcaggacagcaaggacagcaccuacagccugucgagcacccucacgcugagcaaggccgacuacgagaagcacaagguguacgcgugcgaggugacccaccagggccugagcagccccgucaccaagucguucaaccgcggcgccugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61245 - protein, 457 aa, Artificial Sequence
  Protein (HC) w/o signal peptide encoded by mRNA R1965, R2999, R3012
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61246 - protein, 451 aa, Artificial Sequence; identical to SEQ ID NO: 888
  Protein (HC) w/o signal peptide & his-tag encoded by mRNA R1965, R2999, R3012

SEQ ID NO: 61247 - protein, 214 aa, Artificial Sequence; identical to SEQ ID NO: 742
  Protein (LC) w/o signal peptide encoded by mRNA R1965, R2999, R3012

SEQ ID NO: 61248 - RNA, 1371 nt, Artificial Sequence
  CDS (HC) w/o signal peptide encoded by mRNA R1965, R2999, R3012
gaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccccgaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggaagcaucaucaucaucaucau

SEQ ID NO: 61249 - RNA, 1353 nt, Artificial Sequence
  CDS (HC) w/o signal peptide & his-tag encoded by mRNA R1965, R2999, R3012
gaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccccgaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggaag

SEQ ID NO: 61250 - RNA, 642 nt, Artificial Sequence
  CDS (LC) w/o signal peptide encoded by mRNA R1965, R2999, R3012
gacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugc

SEQ ID NO: 61251 - RNA, 1371 nt, Artificial Sequence
  derived and/or modified sequence opt2 from CDS (HC) w/o signal peptide encoded by mRNA R1965, R2999, R3012
gagguccagcucgucgaguccggcggcggccucguccagcccggcggcucccuccgccucuccugcgccgccuccggcuucaacaucaaggacaccuacauccacuggguccgccaggcccccggcaagggccucgagugggucgcccgcaucuaccccaccaacggcuacacccgcuacgccgacuccgucaagggccgcuucaccaucuccgccgacaccuccaagaacaccgccuaccuccagaugaacucccuccgcgccgaggacaccgccgucuacuacugcucccgcuggggcggcgacggcuucuacgccauggacuacuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagccccccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaagcaccaccaccaccaccac

SEQ ID NO: 61252 - RNA, 1353 nt, Artificial Sequence; identical to SEQ ID NO: 16172
  derived and/or modified sequence opt2 from CDS (HC) w/o signal peptide & his-tag encoded by mRNA R1965, R2999, R3012

SEQ ID NO: 61253 - RNA, 642 nt, Artificial Sequence; identical to SEQ ID NO: 16026
  derived and/or modified sequence opt2 from CDS (LC) w/o signal peptide encoded by mRNA R1965, R2999, R3012

SEQ ID NO: 61254 - RNA, 1371 nt, Artificial Sequence
  derived and/or modified sequence opt3 from CDS (HC) w/o signal peptide encoded by mRNA R1965, R2999, R3012
gaggugcagcuggucgaaagcggcgggggacucguucaacccgguggcucccuuagacugucuugcgccgcuucaggguucaacaucaaggacaccuacauucacugggugaggcaggcaccuggaaaaggcuuggaguggguagcccggauauauccaacaaaugguuacacucgcuaugcggauagugugaaggggcgauuuacgaucagcgcugacaccuccaaaaacacagccuacuuacagaugaauagccugcgugcagaagauacugccgucuauuacuguucgagauggggaggcgacggcuucuaugcuauggauuacugggggcagggaacccuagugacaguuucaagcgcaaguaccaaggguccguccguguuuccccucgccccuucuagcaaauccacuucaggcgggacagcugcccugggaugccuugucaaggacuacuucccagagcccgugaccguaaguuggaacagcggcgcgcugacgucugguguucauacuuuuccugcaguguugcaauccucagggcucuauagccugaguucugucgugaccgugccauccagcucgcugggaacacagacuuacauuuguaaugucaaccacaagcccucuaauaccaaaguugauaagaaaguggaaccuccaaaguccugcgacaaaacacauaccuguccgcccugcccugccccagagcucuuaggcggccccucaguauuccuguuuccuccaaagcccaaggauacgcuuaugaucaguaggacuccggaggugacaugugucgugguugacgugagccacgaagauccugaggucaaauucaacugguauguggacgggguagaaguucauaaugcuaagaccaaaccccgggaggagcaguacaacuccacuuaucgcguggucucuguguugacaguccugcaccaggauuggcuaaauggaaaggaauacaaaugcaaggugagcaacaaagcccucccagcaccuauugagaagaccaucucaaaggcuaaaggucaacccagagaaccacagguuuauacgcugcccccuaguagggacgagcuuaccaagaaucaggugucccugacauguuugguaaaaggcuuuuacccaagcgacauagccgucgaaugggagucuaacgggcagccggagaauaacuacaagacuacacccccugugcucgauucagacggaaguuucuuucuguauagcaaauuaaccguugauaagucccgguggcaacagggcaacguguucucuugcucggucaugcacgaagcgcugcauaaucacuacacucagaagucucucucccuuucaccagguaaacaucaccaccaucaccau

SEQ ID NO: 61255 - RNA, 1353 nt, Artificial Sequence; identical to SEQ ID NO: 23814
  derived and/or modified sequence opt3 from CDS (HC) w/o signal peptide & his-tag encoded by mRNA R1965, R2999, R3012

SEQ ID NO: 61256 - RNA, 642 nt, Artificial Sequence; identical to SEQ ID NO: 23668
  derived and/or modified sequence opt3 from CDS (LC) w/o signal peptide encoded by mRNA R1965, R2999, R3012

SEQ ID NO: 61257 - RNA, 1371 nt, Artificial Sequence
  derived and/or modified sequence opt4 from CDS (HC) w/o signal peptide encoded by mRNA R1965, R2999, R3012
gaggugcagcugguggagagcggcggcggccuggugcagcccggcggcagccugagacugagcugcgccgccagcggcuucaacaucaaggacaccuacauccacugggugagacaggcccccggcaagggccuggaguggguggccagaaucuaccccaccaacggcuacaccagauacgccgacagcgugaagggcagauucaccaucagcgccgacaccagcaagaacaccgccuaccugcagaugaacagccugagagccgaggacaccgccguguacuacugcagcagauggggcggcgacggcuucuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagccccccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaagcaccaccaccaccaccac

SEQ ID NO: 61258 - RNA, 1353 nt, Artificial Sequence; identical to SEQ ID NO: 31456
  derived and/or modified sequence opt4 from CDS (HC) w/o signal peptide & his-tag encoded by mRNA R1965, R2999, R3012

SEQ ID NO: 61259 - RNA, 642 nt, Artificial Sequence; identical to SEQ ID NO: 31310
  derived and/or modified sequence opt4 from CDS (LC) w/o signal peptide encoded by mRNA R1965, R2999, R3012

SEQ ID NO: 61260 - RNA, 1371 nt, Artificial Sequence
  derived and/or modified sequence opt5 from CDS (HC) w/o signal peptide encoded by mRNA R1965, R2999, R3012
gaggugcagcuggucgaaagcggcgggggacucguucagcccggcgggucccugagacuuucuugcgccgcuagcggauucaacaucaaggacaccuacauucacugggugcggcaggccccuggcaaagggcuggaguggguggcgcgcaucuauccgacaaauggauacacgagauaugcugauuccgucaagggccgguuuaccauuucugccgacacaagcaaaaacaccgccuaccuccagaugaauagccugcgcgcugaagauacagccguguauuacuguucuagauggggcggggacggauucuaugcuauggauuacuggggccaggggacccuuguuacagugagcuccgccagcaccaagggacccucugucuuuccucuggcgcccuccagcaaaucuacguccggcgggaccgccgcucucggaugccuggugaaggacuacuucccugagcccguuacagugagcuggaacucuggcgcccugaccuccggcguccauacauuuccugcugugcuccaaagcuccgggcuguauucucuuagcuccguggucaccguuccguccucuucccugggaacgcagacauacaucuguaaugugaaccacaagcccagcaauaccaaaguggauaagaaagucgaaccucccaagucuugcgacaaaacacauaccuguccucccugcccggccccugagcuccugggcgggcccagcguguuccuuuuuccucccaagcccaaggauacccugaugauuucccggacaccugagguuacguguguggucguggacguuucucacgaagauccggaggugaaauucaacugguaugucgacggaguggaaguccauaaugcgaagaccaaaccccgcgaggagcaguacaacagcacauauagagugguuuccgugcucaccguccugcaccaggauuggcugaauggcaaggaauacaaaugcaaggugagcaacaaagcccucccugcucccaucgagaagacaaucucuaaggccaaagggcaaccucgggaaccccagguuuauacccugccgccuucccgcgacgagcuuacgaagaaucaggugagccugacaugucucgucaaaggauuuuaccccucugacauugcuguggaaugggaguccaacggccagccugagaauaacuacaagaccacacccccugugcuggauagcgacggcuccuucuuucuuuauucuaaacugaccguugauaagagcagauggcaacaggggaacgucuucuccugcucugugaugcacgaagcccuccauaaucacuacacccaaaagagccugucccugagccccggaaaacaucaccaccaucaccau

SEQ ID NO: 61261 - RNA, 1353 nt, Artificial Sequence; identical to SEQ ID NO: 39098
  derived and/or modified sequence opt5 from CDS (HC) w/o signal peptide & his-tag encoded by mRNA R1965, R2999, R3012

SEQ ID NO: 61262 - RNA, 642 nt, Artificial Sequence; identical to SEQ ID NO: 38952
  derived and/or modified sequence opt5 from CDS (LC) w/o signal peptide encoded by mRNA R1965, R2999, R3012

SEQ ID NO: 61263 - RNA, 1371 nt, Artificial Sequence
  derived and/or modified sequence opt6 from CDS (HC) w/o signal peptide encoded by mRNA R1965, R2999, R3012
gaaguccaauuaguagaaucaggagguggauuaguccaaccaggaggaucucuacgauuaucuugugcugcaagcggauucaauauaaaagauacauauauccacuggguaagacaagcaccaggaaaagguuuagaauggguagcaagaauauauccuaccaauggauauacacgauacgcagacucuguuaaaggacgauucacaauaucagcagauacaucuaaaaauacagcauaccuacaaaugaacucccuaagagcugaagacacagcaguuuacuauugcucacgcugggguggugacggauucuaugcaauggacuauuggggucaaggaacacuaguaacagucuccucagcaucaacaaaaggaccuucaguauucccacuagcaccaucaucaaaaucaacauccggaggaacagcugcauuaggaugcuuaguaaaagauuacuuuccagagccaguaacaguaucauggaacucaggagcgcuaacaucugguguacacacauuuccagcaguacuacaaucuucaggacuauacucccuauccucuguagucacaguaccaucaucuucucuagguacacaaacauacauauguaacguuaaccacaaacccagcaacacaaaagucgauaaaaaaguugaaccaccuaaaucaugcgauaaaacacacacaugcccaccaugccccgcaccagaacucuuaggaggaccaucaguauuccuauuucccccuaaaccaaaagauacauuaaugauaucaagaaccccagaagucacaugcguuguuguagauguaagucacgaagacccagaaguuaaauuuaacugguauguagacggaguagaaguacauaacgcuaaaacaaaaccuagagaagaacaauauaauagcacauaccgcguaguuucagucuuaacaguacuacaccaagacugguuaaauggaaaagaauauaaaugcaaaguaagcaauaaagcauuaccugcaccaauagaaaaaacaauaucuaaagcaaaaggacaaccaagagaaccacaagucuacacacuaccaccaucaagagacgaacuaacuaaaaaccaaguuucccuaacuugucuagucaaaggauuuuauccuucagacauugcgguagaaugggaaaguaacggacaaccugaaaauaauuauaaaacaacaccaccaguacucgacagugauggaucuuuuuuucuauauuccaaauuaacuguagauaaaucaagauggcaacaaggaaauguauucucauguucaguaaugcaugaagcauuacacaaucauuacacacaaaaaucauuauccuuaagccccggaaaacaccaccaccaucaccau

SEQ ID NO: 61264 - RNA, 1353 nt, Artificial Sequence
  derived and/or modified sequence opt6 from CDS (HC) w/o signal peptide & his-tag encoded by mRNA R1965, R2999, R3012
gaaguacaacuaguagaaucaggaggcggauuaguucaacccggaggaagccuaagauuaucaugcgccgcuuccggauuuaauauaaaagauacauauauccauuggguaagacaagcaccuggaaaaggauuagaauggguagcacgaauauacccuacaaacggauauacgcguuaugcagacucaguaaaaggaagauuuacaauaucagcagacacaaguaaaaauacagccuaucuucaaaugaacuccuuaagagcagaagacaccgcugucuacuauugcagcagauggggaggagauggauucuaugccauggacuauuggggucaaggaacacuaguaacaguaucaucagcuucaacaaaaggaccaucaguauucccauuagcaccguccucaaagucaacaagcgguggaacagcagcacuuggaugccuaguaaaagauuacuuuccagaaccaguaacaguaaguuggaacagcggagccuuaacauccgguguacauacuuuuccagcuguccuacaaucgucaggacuauauucauuaucuucaguuguaacaguaccaucaucaucacuagggacccaaaccuauauauguaauguaaaccauaaaccaucuaauacaaaagucgauaaaaaaguagaaccaccuaaauccugugauaaaacucacacaugcccaccauguccugcaccagaacuacuaggagguccaucaguauuuuuauucccaccaaaaccuaaagacacccuuaugauaucaagaacaccagaaguaacauguguaguugucgacguaucacaugaagacccagaaguaaaauuuaacugguauguugacggaguagaaguacacaaugcaaaaacaaaaccacgugaagaacaauacaauucaacauacagaguuguaucaguauuaaccguccuacaucaagacuggcuaaacggaaaagaauacaaauguaaaguaucaaacaaagcacuaccagcaccaauagaaaaaacaauaucaaaagccaaaggacaaccaagagaaccacaaguauacacacuaccaccaucuagagacgaauuaacuaaaaaucaaguaucucuaacaugucuaguuaaagguuucuaucccagugacauagcaguugaaugggaaucaaacggacaaccagaaaacaauuauaaaacaacacccccaguacuagauucugauggcucuuuuuucuuauauucaaaacuaacuguagauaaaucaagauggcaacaaggcaaugucuuuucauguucaguuaugcacgaagcccuacauaaucacuauacucaaaaaucauuaucacuaagccccggcaaa

SEQ ID NO: 61265 - RNA, 642 nt, Artificial Sequence
  derived and/or modified sequence opt6 from CDS (LC) w/o signal peptide encoded by mRNA R1965, R2999, R3012
gacauacaaaugacacaaucaccaucaucauuaagcgcaucaguaggagacagaguaacaauaacaugcagagcaucccaagacguaaacacagcuguagcaugguaccaacaaaaaccaggaaaagcacccaaacuauuaauauacagcgcauccuuccuauacucaggaguaccaucaagauucucaggaucaagaucaggcacagacuucacacuaacaauauccucacuacaaccagaagacuucgcaacauacuacugccaacaacauuacacaacuccacccacauucggacaaggaacaaaaguagaaaucaaaagaacaguagcagcaccaucaguauucauauucccaccaucagacgaacaacuaaaaucaggaacugcaucaguaguaugcuuacuaaacaacuucuacccaagagaagcaaaaguacaauggaaaguagacaacgcacuccaaagcggaaacucacaagaaucaguaacagaacaagacucaaaagacuccacauacucccuauccucaacacuaacacuaagcaaagcagacuacgaaaaacauaaaguauacgcaugcgaaguaacccaccaaggauuaagcucaccaguaacaaaaucauucaacagaggagaaugc

SEQ ID NO: 61266 - RNA, 1371 nt, Artificial Sequence
  derived and/or modified sequence opt11 from CDS (HC) w/o signal peptide encoded by mRNA R1965, R2999, R3012
gaaguccaacucgucgagagcggcggaggccucguccaacccggcggcagccugcgccucuccugcgccgcauccggauucaacaucaaagacaccuacauccacuggguccgacaagcccccggcaaaggccucgaaugggucgcccgaauauaccccaccaacggauauacacgcuaugccgacagcgucaaaggccgcuucaccaucuccgcggacaccuccaaaaacaccgccuaccuccaaaugaacucacuacgcgcagaagacaccgccguauacuacugcucaagauggggcggcgacggauucuacgcaauggacuacuggggccaaggcacccuuguuacagucuccucagcaucuaccaaaggccccucugucuucccccuugcaccauccagcaaaucaaccagcggaggcaccgccgcccuaggcugccuaguuaaagacuacuuccccgaacccgucacggucuccuggaacuccggugcccucaccucgggcguccacacauuuccagcagugcuccaauccucaggccucuacucccuaucaagcgucguaacuguccccagcucaucucucggaacccaaacauacaucugcaacguaaaccacaaacccuccaacacaaaaguagacaagaaagucgaaccgcccaaaucaugcgacaaaacccacaccuguccucccugccccgcacccgaacuccuaggcggccccuccguauuccuauucccaccaaagccaaaagacacccuaaugaucucccgcacacccgaaguaacaugcgucguaguggacgucucccacgaagaccccgaggucaaauucaacugguacgucgacggcgucgaaguccauaaugcaaagaccaaaccacgagaagaacaauacaacucaaccuaccgcguagucucaguacucaccguccuacaccaagacuggcucaacgguaaagaauacaaaugcaaagucucgaacaaagcacucccagcccccaucgagaaaaccauaucaaaggccaaaggccaaccccgcgaaccacaagucuacacccuacccccaucccgcgacgaacucaccaaaaaucaagucucacuaacaugccucgucaaaggcuucuaccccucugacaucgccgucgaaugggaauccaacggacagcccgaaaacaacuacaaaaccaccccucccguccucgacucagacggcuccuuuuuccucuauuccaaacucaccgucgacaaauccagauggcaacaaggcaacguauucuccugcuccgucaugcacgaagcccuacacaaccacuacacccagaagucacucucacucucacccggaaaacaccaccaccaccaccac

SEQ ID NO: 61267 - RNA, 1353 nt, Artificial Sequence
  derived and/or modified sequence opt11 from CDS (HC) w/o signal peptide & his-tag encoded by mRNA R1965, R2999, R3012
gaaguccagcucguagaauccggaggcggccucguacaacccgguggaucacuacgccucucaugugccgccucaggcuucaacaucaaagacacauacauccacuggguccgccaagcccccggaaaaggucuugaaugggucgcccgcaucuaccccaccaacggauacacccgcuacgccgacuccguaaaaggccgcuucacaauuucagcagacaccuccaaaaacacagcuuaccuccaaaugaacucccuacgcgccgaagacaccgcagucuacuacugcucccgcuggggcggcgacggcuucuacgcaauggauuacuggggccaagguacccuagucacagucagcagcgcauccaccaaagguccaucagucuucccccucgcccccuccuccaaaucuacauccggaggaacagccgcccuaggcugccuagucaaagacuacuucccggaacccgucacaguuuccuggaacuccggagcacuaaccuccggcguccacaccuuuccagccguacuccaguccuccggccucuacucccuaucuucagucguaaccguccccuccucuucacucggcacccaaaccuacaucugcaacgucaaccacaaacccuccaacaccaaaguagauaagaaaguggaaccgccaaaauccugcgacaaaacccacacuugcccucccugccccgcccccgaauuacucggaggccccuccgucuuccuauucccacccaaacccaaagacacccucaugaucucccgcacucccgaaguaaccugcgucgucgucgacgucagccacgaagacccagaagucaaauucaacugguacguugacggcguagaaguacacaacgcaaaaaccaaaccccgcgaagaacaauacaacuccaccuacagaguuguaagcguacucaccguacugcaccaagacuggcucaacggcaaggaauacaaaugcaaagucucgaacaaagcucuccccgccccaaucgagaaaaccaucuccaaagcuaaaggccaaccaagagaaccccaagucuauacacuacccccuucccgcgacgagcucaccaaaaaccaagucucccucaccugucucgucaaagguuucuacccauccgacauagcaguggaaugggaauccaacggacaacccgagaacaacuacaaaaccaccccacccguucucgacagugacggcuccuucuuccucuacucgaagcuaacaguagacaaaucccgauggcaacaaggcaacgucuucuccugcuccguaaugcacgaagcacuccacaaccacuacacacaaaaaucccucucccucucccccggcaaa

SEQ ID NO: 61268 - RNA, 642 nt, Artificial Sequence
  derived and/or modified sequence opt11 from CDS (LC) w/o signal peptide encoded by mRNA R1965, R2999, R3012
gacauacaaaugacccaaucccccuccucccucuccgccuccgucggcgaccgcgucaccaucaccugccgcgccucccaagacgucaacacagccgucgccugguaccaacaaaaacccggaaaagcccccaaacuacuaaucuacuccgccuccuuccucuacuccggcguccccucccgcuucuccggcucacgcucuggcaccgacuucacccucaccaucuccucccuccaaccagaagacuucgccacuuacuacugccaacaacacuacaccaccccccccaccuucggacaaggcaccaaagucgaaaucaaacgcaccgucgccgcccccuccgucuucaucuucccccccuccgacgaacaacucaaaucaggcaccgccucagucgucugccuacucaauaacuucuacccccgcgaagccaaaguccaauggaaagucgacaacgcccuccaauccggcaacucccaagaauccgucaccgaacaagacuccaaagacuccaccuacucccucuccuccacccuaacccucagcaaagccgacuacgaaaaacacaaagucuacgccugcgaagucacccaccaaggacuauccucccccgucaccaaaucauucaaccgaggcgaaugc

SEQ ID NO: 61269 - protein, 476 aa, Artificial Sequence
  Protein 1 (HC) w/o his-tag encoded by mRNA R1965, R2999, R3012
MAVMAPRTLVLLLSGALALTQTWAGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61270 - protein, 482 aa, Artificial Sequence
  Protein 1 (HC) encoded by mRNA R1965, R2999, R3012
MAVMAPRTLVLLLSGALALTQTWAGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61271 - protein, 239 aa, Artificial Sequence
  Protein 2 (LC) encoded by mRNA R1965, R2999, R3012
MAVMAPRTLVLLLSGALALTQTWAGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61272 - RNA, 1431 nt, Artificial Sequence
  CDS 1 (HC) w/o his-tag as RNA from mRNA R1965, R2999, R3012
auggccgugauggcgccgcggacccugguccuccugcugagcggcgcccucgcccugacgcagaccugggccggggaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccccgaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggaaguga

SEQ ID NO: 61273 - RNA, 1449 nt, Artificial Sequence
  CDS 1 (HC) as RNA from mRNA R1965, R2999, R3012
auggccgugauggcgccgcggacccugguccuccugcugagcggcgcccucgcccugacgcagaccugggccggggaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccccgaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggaagcaucaucaucaucaucauuga

SEQ ID NO: 61274 - RNA, 720 nt, Artificial Sequence
  CDS 2 (LC) as RNA from mRNA R1965, R2999, R3012
auggccgugauggcgccgcggacccugguccuccugcugagcggcgcccucgcccugacgcagaccugggccggggacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcuga

SEQ ID NO: 61275 - RNA, 2848 nt, Artificial Sequence
  CDS (HC)-IRES-CDS (LC) as RNA from mRNA R1965, R2999, R3012
auggccgugauggcgccgcggacccugguccuccugcugagcggcgcccucgcccugacgcagaccugggccggggaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccccgaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggaagcaucaucaucaucaucauugaccaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcuga

SEQ ID NO: 61276 - RNA, 3040 nt, Artificial Sequence
  R1965
gggagaaagcuuaccauggccgugauggcgccgcggacccugguccuccugcugagcggcgcccucgcccugacgcagaccugggccggggaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccccgaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggaagcaucaucaucaucaucauugaccaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61277 - RNA, 3052 nt, Artificial Sequence
  R2999
gggagaaagcuuaccauggccgugauggcgccgcggacccugguccuccugcugagcggcgcccucgcccugacgcagaccugggccggggaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccccgaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggaagcaucaucaucaucaucauugaccaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61278 - RNA, 3230 nt, Artificial Sequence
  R3012
ggggcgcugccuacggagguggcagccaucuccuucucggcaucaagcuuaccauggccgugauggcgccgcggacccugguccuccugcugagcggcgcccucgcccugacgcagaccugggccggggaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccccgaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggaagcaucaucaucaucaucauugaccaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61279 - protein, 453 aa, Artificial Sequence
  Protein (HC) w/o signal peptide encoded by mRNA R3001, R3484
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61280 - protein, 447 aa, Artificial Sequence; identical to SEQ ID NO: 877
  Protein (HC) w/o signal peptide & his-tag encoded by mRNA R3001, R3484

SEQ ID NO: 61281 - protein, 210 aa, Artificial Sequence; identical to SEQ ID NO: 878
  Protein (LC) w/o signal peptide encoded by mRNA R3001, R3484

SEQ ID NO: 61282 - RNA, 1359 nt, Artificial Sequence
  CDS (HC) w/o signal peptide encoded by mRNA R3001, R3484
caggccuaccugcagcagagcggcgcggagcucgugcggccgggggccucggucaagaugagcugcaaggccagcggcuacaccuucacgagcuacaacaugcacugggugaagcagaccccgcgccaggggcuggaguggaucggcgccaucuaccccgggaacggcgacaccagcuacaaccagaaguucaagggcaaggcgacccugacgguggacaagucgagcagcaccgccuacaugcagcucagcagccugaccucggaggacagcgccgucuacuucugcgcccgggugguguacuacagcaacagcuacugguacuucgacgucugggggaccggcacgaccgugaccgugagcgggcccagcgucuucccccuggcccccucgagcaagagcaccagcggcggcacggcggcccucgggugccuggugaaggacuacuuccccgagcccgugaccgucagcuggaacucgggcgcccugaccagcggggugcacaccuucccggccgugcuccagagcagcggccuguacagccugagcucggucgugacggugcccagcagcagccucgggacccagaccuacaucugcaacgucaaccacaagcccagcaacaccaagguggacaagaaggcggagcccaagucgugcgacaagacgcacaccugcccgcccugccccgcccccgagcugcugggcggcccgagcguguuccucuucccgcccaagcccaaggacacccugaugaucagccgcacccccgaggucacgugcgugguggucgacgugagccacgaggaccccgaggugaaguucaacugguacgucgacgggguggaggugcacaacgccaagaccaagccccgggaggagcaguacaacagcaccuaccgcgucgugagcgugcugaccguccuccaccaggacuggcugaacggcaaggaguacaagugcaaggugucgaacaaggcccugccggcccccaucgagaagacgaucagcaaggcgaaggggcagccccgggagccccagguguacacccucccgcccagccgcgacgagcugaccaagaaccaggucagccugaccugccucgugaagggcuucuaccccagcgacaucgccguggagugggagucgaacgggcagcccgagaacaacuacaagacgaccccgcccguccuggacagcgacggcagcuucuuccuguacagcaagcucaccguggacaagagccgguggcagcagggcaacguguucagcugcucggucaugcacgaggcccugcacaaccacuacacccagaagagccugagccucagccccgggaagcaucaucaucaucaucau

SEQ ID NO: 61283 - RNA, 1341 nt, Artificial Sequence
  CDS (HC) w/o signal peptide & his-tag encoded by mRNA R3001, R3484
caggccuaccugcagcagagcggcgcggagcucgugcggccgggggccucggucaagaugagcugcaaggccagcggcuacaccuucacgagcuacaacaugcacugggugaagcagaccccgcgccaggggcuggaguggaucggcgccaucuaccccgggaacggcgacaccagcuacaaccagaaguucaagggcaaggcgacccugacgguggacaagucgagcagcaccgccuacaugcagcucagcagccugaccucggaggacagcgccgucuacuucugcgcccgggugguguacuacagcaacagcuacugguacuucgacgucugggggaccggcacgaccgugaccgugagcgggcccagcgucuucccccuggcccccucgagcaagagcaccagcggcggcacggcggcccucgggugccuggugaaggacuacuuccccgagcccgugaccgucagcuggaacucgggcgcccugaccagcggggugcacaccuucccggccgugcuccagagcagcggccuguacagccugagcucggucgugacggugcccagcagcagccucgggacccagaccuacaucugcaacgucaaccacaagcccagcaacaccaagguggacaagaaggcggagcccaagucgugcgacaagacgcacaccugcccgcccugccccgcccccgagcugcugggcggcccgagcguguuccucuucccgcccaagcccaaggacacccugaugaucagccgcacccccgaggucacgugcgugguggucgacgugagccacgaggaccccgaggugaaguucaacugguacgucgacgggguggaggugcacaacgccaagaccaagccccgggaggagcaguacaacagcaccuaccgcgucgugagcgugcugaccguccuccaccaggacuggcugaacggcaaggaguacaagugcaaggugucgaacaaggcccugccggcccccaucgagaagacgaucagcaaggcgaaggggcagccccgggagccccagguguacacccucccgcccagccgcgacgagcugaccaagaaccaggucagccugaccugccucgugaagggcuucuaccccagcgacaucgccguggagugggagucgaacgggcagcccgagaacaacuacaagacgaccccgcccguccuggacagcgacggcagcuucuuccuguacagcaagcucaccguggacaagagccgguggcagcagggcaacguguucagcugcucggucaugcacgaggcccugcacaaccacuacacccagaagagccugagccucagccccgggaag

SEQ ID NO: 61284 - RNA, 630 nt, Artificial Sequence
  CDS (LC) w/o signal peptide encoded by mRNA R3001, R3484
cagaucgugcugagccagucgccggccauccucagcgcgagccccggcgagaaggucaccaugacgugccgggccagcagcucggugagcuacaugcacugguaccagcagaagcccgggagcagccccaagccguggaucuacgcccccagcaaccuggccucgggcgugcccgcgcgcuucagcgggagcggcagcgggaccagcuacagccugaccaucucgcgggucgaggccgaggacgccgccaccuacuacugccagcaguggagcuucaacccgcccacguucggcgccggcaccaagcucgagcugaagcgcaccguggcggcccccagcguguucaucuucccgcccagcgacgagcagcugaagagcgggaccgccucggucgugugccuccugaacaacuucuacccccgggaggccaaggugcaguggaaggucgacaacgcgcugcagagcggcaacagccaggagagcgugacggagcaggacagcaaggacagcaccuacucgcucagcagcacccugacccugagcaaggccgacuacgagaagcacaagguguacgccugcgaggucacgcaccaggggcucagcucgcccgugaccaagagcuucaaccgc

SEQ ID NO: 61285 - RNA, 1359 nt, Artificial Sequence
  derived and/or modified sequence opt2 from CDS (HC) w/o signal peptide encoded by mRNA R3001, R3484
caggccuaccuccagcaguccggcgccgagcucguccgccccggcgccuccgucaagauguccugcaaggccuccggcuacaccuucaccuccuacaacaugcacugggucaagcagaccccccgccagggccucgaguggaucggcgccaucuaccccggcaacggcgacaccuccuacaaccagaaguucaagggcaaggccacccucaccgucgacaaguccuccuccaccgccuacaugcagcucuccucccucaccuccgaggacuccgccgucuacuucugcgcccgcgucgucuacuacuccaacuccuacugguacuucgacgucuggggcaccggcaccaccgucaccgucuccggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggccgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaagcaccaccaccaccaccac

SEQ ID NO: 61286 - RNA, 1341 nt, Artificial Sequence; identical to SEQ ID NO: 16161
  derived and/or modified sequence opt2 from CDS (HC) w/o signal peptide & his-tag encoded by mRNA R3001, R3484

SEQ ID NO: 61287 - RNA, 630 nt, Artificial Sequence; identical to SEQ ID NO: 16162
  derived and/or modified sequence opt2 from CDS (LC) w/o signal peptide encoded by mRNA R3001, R3484

SEQ ID NO: 61288 - RNA, 1359 nt, Artificial Sequence
  derived and/or modified sequence opt3 from CDS (HC) w/o signal peptide encoded by mRNA R3001, R3484
caggccuaccugcaacagagcggcgcugagcucgugagacccggggcauccgucaagaugucuugcaaagccucaggauauaccuucacaaguuacaacaugcacuggguuaagcagacuccuaggcagggucuugaauggaucggcgcgauuuauccagggaauggagacacgagcuacaaccaaaaauuuaagggcaaagcuacccugacaguggauaaguccucuucgacugccuauaugcaguugagcucauuaaccagugaggacuccgcaguauacuucugugcccggguggucuauuacucuaauagcuacugguauuuugaugugugggguacagggaccacuguuacaguguccggaccgucagucuucccccuggcuccuaguagcaagucuaccuccggcggcacggcagcccuagggugccucgugaaagacuacuuuccagaacccguaacuguuucauggaacagcggagcucugaccaguggugugcauacauucccugccguccuucagucuuccggccuguauagcuugucgucuguggugacugucccauccucaagucucgggacccagacauacauauguaauguuaaccacaagcccagcaauaccaaaguggauaagaaagcggagccuaaguccugcgacaagacgcauacuuguccaccgugccccgcaccugaacugcugggaggcccaucuguauuucucuuucccccuaaaccaaaggauacauuaaugaucagccgcacccccgaggugacuugugucgugguugacgugucacacgaggauccggaagucaaauucaacugguauguggacgguguagagguucauaaugccaagacaaaaccucgagaagaacaauacaacaguaccuaucguguggucuccgugcugacgguccuucaccaggauugguugaaugggaaggaguacaaaugcaaggugagcaacaaggcucugcccgccccaauugagaaaaccaucucuaaggcaaaaggacagccuagagagccccagguuuacacacuaccacccucaagggacgaacucacuaagaaucaagugagucugaccugucuuguaaaaggcuucuauccuagcgauauugcugucgagugggaauccaacggccagccagagaauaacuacaagacaacuccgcccgugcuggacucugacgggucguuuuucuuguauagcaagcucaccguugauaaaucccgguggcagcaaggaaacguguuuucaugcagugucaugcacgaggcccugcauaaucacuacacacagaagucuuuaagccuguccccugguaaacaucaccaccaucaccau

SEQ ID NO: 61289 - RNA, 1341 nt, Artificial Sequence; identical to SEQ ID NO: 23803
  derived and/or modified sequence opt3 from CDS (HC) w/o signal peptide & his-tag encoded by mRNA R3001, R3484

SEQ ID NO: 61290 - RNA, 630 nt, Artificial Sequence; identical to SEQ ID NO: 23804
  derived and/or modified sequence opt3 from CDS (LC) w/o signal peptide encoded by mRNA R3001, R3484

SEQ ID NO: 61291 - RNA, 1359 nt, Artificial Sequence
  derived and/or modified sequence opt4 from CDS (HC) w/o signal peptide encoded by mRNA R3001, R3484
caggccuaccugcagcagagcggcgccgagcuggugagacccggcgccagcgugaagaugagcugcaaggccagcggcuacaccuucaccagcuacaacaugcacugggugaagcagacccccagacagggccuggaguggaucggcgccaucuaccccggcaacggcgacaccagcuacaaccagaaguucaagggcaaggccacccugaccguggacaagagcagcagcaccgccuacaugcagcugagcagccugaccagcgaggacagcgccguguacuucugcgccagagugguguacuacagcaacagcuacugguacuucgacguguggggcaccggcaccaccgugaccgugagcggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggccgagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaagcaccaccaccaccaccac

SEQ ID NO: 61292 - RNA, 1341 nt, Artificial Sequence; identical to SEQ ID NO: 31445
  derived and/or modified sequence opt4 from CDS (HC) w/o signal peptide & his-tag encoded by mRNA R3001, R3484

SEQ ID NO: 61293 - RNA, 630 nt, Artificial Sequence; identical to SEQ ID NO: 31446
  derived and/or modified sequence opt4 from CDS (LC) w/o signal peptide encoded by mRNA R3001, R3484

SEQ ID NO: 61294 - RNA, 1359 nt, Artificial Sequence
  derived and/or modified sequence opt5 from CDS (HC) w/o signal peptide encoded by mRNA R3001, R3484
caggcuuaccugcaacagagcggcgcugagcucgugagacccggggccuccgucaagaugucuugcaaagcgagcggauauaccuucacauccuacaacaugcacuggguuaagcagacgccucggcagggccuggaauggaucggggcuauuuauccgggaaauggcgacaccucuuacaaccaaaaauuuaaggggaaagccacacuuaccguggauaagagcuccucuacagccuauaugcagcugagcucccucaccagcgaggacucugcuguguacuucugugcccgcgucguguauuacuccaauagcuacugguauuuugauguuuggggaacaggcaccacggugaccgucucuggccccuccguguucccucuggcucccagcucuaaguccacaagcgggggaaccgccgcgcuuggcugccugguuaaagacuacuuuccugaacccgugacagucuccuggaacucuggggcccucaccagcggagugcauacguucccugcugugcugcaguccagcggccuguauucucucuccagcgucguuacagugccgucuagcucccuggggacccagacauacaucuguaaugugaaccacaagcccucuaauaccaaagucgauaagaaagccgagccuaagagcugcgacaagacccauacaugucccccuugccccgcuccggaacuucugggaggcccuuccguguuucucuuucccccuaaacccaaggauacgcugaugauuagcagaacccccgagguuacauguguggucguggacguuucucacgaggauccugaagugaaauuuaacugguaugucgacggcguggagguccauaaugccaagaccaaaccgcgggaagaacaauacaacuccacauaucgcgugguuagcgugcuuaccguccugcaccaggauuggcucaaugggaaggaguacaaaugcaaggugucuaacaaggcgcugcccgccccuaucgagaaaacgauuuccaaggcuaaaggacagcccagagagccucagguuuacacacugcccccgagccgggacgaacucaccaagaaucaagugucccugaccugucuugucaaaggcuucuauccuucugauaucgccguggagugggaaagcaacgggcagcccgagaauaacuacaagacaaccccucccgugcuggacuccgacggaucuuucuuccucuauagcaagcugacaguugauaaaucccgcuggcagcaaggcaacgucuuuagcugcucugugaugcacgaggcccuucauaaucacuacacgcagaagucccugagccucucuccugggaaacaucaccaccaucaccau

SEQ ID NO: 61295 - RNA, 1341 nt, Artificial Sequence; identical to SEQ ID NO: 39087
  derived and/or modified sequence opt5 from CDS (HC) w/o signal peptide & his-tag encoded by mRNA R3001, R3484

SEQ ID NO: 61296 - RNA, 630 nt, Artificial Sequence; identical to SEQ ID NO: 39088
  derived and/or modified sequence opt5 from CDS (LC) w/o signal peptide encoded by mRNA R3001, R3484

SEQ ID NO: 61297 - RNA, 1359 nt, Artificial Sequence
  derived and/or modified sequence opt6 from CDS (HC) w/o signal peptide encoded by mRNA R3001, R3484
caagcauacuuacaacaaucaggagcagaauuaguaagaccaggagccucaguaaaaauguccugcaaagcauccggauauacauucacaucauacaacaugcacugggucaaacaaacuccuagacaaggccuagaauggauaggagcaaucuauccagguaacggagauacauccuacaaucaaaaauucaaaggaaaagcaacacuaacaguugacaaaucaucaucuacagcuuauaugcaacucuccucauuaacaucagaagacuccgcaguauacuucugcgcacgagucguuuacuacucaaauuccuacugguacuucgacgucuggggaacaggcacaacaguaacagucucaggaccaucaguauuucccuuagcaccaucuucaaaaucaacauccggaggaacugccgcacucggaugccuaguaaaagacuauuuuccagaaccaguaacagucuccuggaacucaggagcacuaacaucaggaguacacacauuuccagcaguuuuacaaucauccggacuauauucauuaucauccguaguaacaguaccuucaucaucacuaggaacacaaacauacaucugcaacguaaaccauaaaccauccaauacaaaaguagacaaaaaagcagaaccuaaaucaugcgauaaaacacacacaugucccccaugcccagccccagaacuacuaggaggccccucagucuuccuuuuuccaccaaaaccaaaagacacucuaaugaucucacgaacaccagaaguaacaugcguaguaguagacgucucacacgaagaucccgaagucaaauuuaacugguacguagacggaguagaaguucacaacgcaaaaacaaaaccaagagaagaacaauauaacucaacauauagaguaguaucaguacuaacaguacuacaccaagacuggcuaaacgguaaagaauacaaauguaaagucucaaauaaagcauuaccagccccaauagaaaaaacuauaucaaaagccaaaggucaaccaagagaaccacaaguauauacauuaccuccauccagagaugaacuaacaaaaaaccaaguaucucuuaccugucuaguaaaagguuuuuacccaucagauauagcaguagaaugggaauccaacggccaaccagaaaacaacuacaaaacaaccccaccaguacuagauuccgacggaucauucuuucuuuacucaaaacuuaccguagacaaaucaagauggcaacaaggaaacguauucucaugcucaguaaugcaugaagcccuacauaaucauuauacccaaaaaucacuaagucuaucaccaggaaaacaccaucaccaccaccau

SEQ ID NO: 61298 - RNA, 1341 nt, Artificial Sequence
  derived and/or modified sequence opt6 from CDS (HC) w/o signal peptide & his-tag encoded by mRNA R3001, R3484
caagcauauuuacaacaaucuggagccgaauuaguaagaccaggagccuccgucaaaaugagcuguaaagcaucaggauacacauucacaucauauaacaugcauugggucaaacaaacuccaagacaaggacuagaauggauaggagcaauuuauccugguaacggagauaccagcuacaaucaaaaauucaaaggaaaagcuacucuaacaguagauaaaucaucaucaacagcuuacaugcaauuaucaucccuaacuucagaagacuccgcaguauauuucugcgcaagaguaguauauuacuccaacucauacugguauuucgacguauggggaaccggaacaacuguaacaguauccggcccuuccgucuuuccucucgccccaucaucaaaaucaacaucaggaggaaccgcagcacuaggcugucuaguaaaagacuacuucccagaaccagucacaguaucauggaacucaggugcacuaaccucuggaguacacaccuuuccagcaguacuacaaucaucaggacuauauucauuauccucaguuguaacuguaccaucaucgucacucggaacccaaacguauaucuguaacguaaaccacaaaccaucaaacaccaaaguugacaaaaaagcagaaccuaaaucaugcgauaaaacacauacuugcccaccaugcccagcaccagaacuucuaggaggaccauccguguuccuauucccaccaaaaccaaaagauacauuaaugauaucucgaaccccugaaguuacaugcguaguaguagacguaucacacgaagauccagaaguuaaauucaacugguauguagacggaguagaaguacacaaugccaaaacaaaaccaagagaagaacaauauaacuccacauaucgagucguaucaguccuaaccguacuacaccaagauugguuaaacggaaaagaauacaaauguaaaguauccaacaaagcacuaccagcaccuauagaaaaaacaauaucaaaagcaaaaggacaaccaagagaaccacaagucuauacccucccaccaucaagagacgaauuaaccaaaaaccaaguuucauuaacaugccuaguuaaaggauucuauccauccgauauagcagucgaaugggaauccaacggacaaccagaaaacaauuacaaaacaacuccacccguauuagauucagacggaucauucuuccuuuacuccaaacuaacagucgacaaaucaagauggcaacaaggaaauguauucucuuguucaguaaugcacgaagccuuacauaaccacuacacacaaaaaucccuaucauuauccccaggaaaa

SEQ ID NO: 61299 - RNA, 630 nt, Artificial Sequence
  derived and/or modified sequence opt6 from CDS (LC) w/o signal peptide encoded by mRNA R3001, R3484
caaauaguauuaucacaaucacccgcaauccuaucagcaucaccaggcgaaaaagucacaaugacaugcagagcauccucaucaguaucauacaugcauugguaccaacaaaaaccaggaucaucaccaaaaccauggauauacgcaccauccaaccuagcaucaggaguaccagcaagauucucaggaucaggaucaggaacaucauacucacuaacaauaucaagaguagaagccgaagacgcagcaacauacuacugccaacaauggucauucaacccaccaacauucggagcaggaacaaaacucgaacuaaaaagaacaguagcagcaccaucaguauucauauucccacccucagacgaacaacuaaaaucaggaacagcaucaguaguaugccuacuaaacaacuucuacccaagagaagcaaaaguacaauggaaaguagacaacgcacuacaaucaggaaacucccaagaaucaguaacagaacaagacucaaaagacucaacauacucauuaucaucuacccuaacacuaucaaaagcagacuacgaaaaacacaaaguauacgcuugcgaaguaacacaccaaggacucuccucaccaguaacaaaaucauucaacaga

SEQ ID NO: 61300 - RNA, 1359 nt, Artificial Sequence
  derived and/or modified sequence opt11 from CDS (HC) w/o signal peptide encoded by mRNA R3001, R3484
caagcauaccuccaacaaucaggcgcagaacuuguucgccccggcgcauccgucaaaaugucaugcaaagccuccggcuacaccuucaccuccuauaacaugcacugggucaaacaaacaccccgccaaggccuagaauggaucggcgcaaucuaccccggcaacggcgauaccucguacaaucaaaaauucaaaggcaaagccacccucaccguugacaagucgaguucaaccgccuacaugcaacucagcucccucaccagcgaagacuccgccgucuacuucugcgcaagagucgucuacuacucuaacuccuacugguacuucgauguauggggcaccgguaccaccgucaccgucuccggcccaucggucuucccccucgcaccaucuucaaaauccaccucaggcggcacagccgcccuagggugccucgucaaagacuacuucccugaaccaguaaccguuuccuggaacuccggcgcacucaccucuggcguucacaccuuccccgccguccuacaauccucaggccucuacucccucucguccgucgucaccgucccgucauccucacucggcacccaaaccuacaucugcaacguaaaucacaagcccucaaacaccaaaguugacaagaaagccgaaccaaaaucaugcgacaaaacccacacaugcccacccugccccgcacccgagcuucuaggcggccccuccgucuuccucuucccacccaaacccaaagacacccucaugaucucccgaacacccgaggucacuugcguagucgucgacgucucccacgaagaccccgaaguaaaauucaacugguacgucgacggcgucgaaguucacaacgccaaaacaaaaccccgagaggaacaguacaacagcacauacagagucgucucaguccuaaccguucuccaccaagacuggcuuaacggcaaagaauacaaaugcaaagucuccaacaaagcucugcccgccccuaucgagaaaaccaucuccaaagccaaaggccaaccccgcgaaccccaaguauacacccuaccacccucccgcgacgaacuuaccaaaaaccaaguaucucuuacaugccucgucaaaggauucuacccaagcgacaucgccguagaaugggaauccaacggccaacccgagaacaacuacaaaaccaccccacccguccuagacuccgacggauccuucuuccucuacagcaaacucaccgucgacaaaucacgcuggcaacaaggcaacguauucuccugcucaguaaugcacgaagcacuccacaaccacuacacucaaaaaucacucucccucucccccggcaaacaccaccaccaccaccac

SEQ ID NO: 61301 - RNA, 1341 nt, Artificial Sequence
  derived and/or modified sequence opt11 from CDS (HC) w/o signal peptide & his-tag encoded by mRNA R3001, R3484
caagccuaccuccaacaauccggagccgaacucguucgacccggcgccuccguaaaaauguccugcaaagccuccggcuacaccuucaccuccuacaacaugcacugggucaaacaaacaccccgccaaggccuugaauggaucggcgccauauaccccggcaacggggacaccuccuacaaccaaaaauucaagggaaaggccacacucacugucgauaaauccucauccaccgccuauaugcaacuuuccucccucaccucagaagacuccgccgucuacuucugcgcccgagucgucuacuacuccaacuccuacugguacuucgacguuuggggcacuggaacaaccgucaccguauccggccccuccguauucccacucgccccauccuccaaauccaccucuggcggaaccgccgcacucggaugccucgucaaagacuacuuccccgaaccagucaccgucuccuggaacucaggcgcacucaccuccggcguacacaccuuccccgccguccuucaauccuccggacucuacucccucucaagcgucgucaccguccccuccucaucacuaggcacccaaacauacaucuguaacguaaaccacaaaccgagcaacaccaaagucgacaagaaagcugagcccaaaucaugcgacaaaacccacacaugucccccaugcccagcaccagaacuccuaggcggcccguccguauuccuauucccacccaaacccaaagacacccucaugaucucccgcacccccgaaguaaccugcgucgucgucgacgucucccacgaggaccccgaggucaaauucaacugguacgucgacggcgucgaaguccacaacgccaaaaccaaaccccgcgaggaacaauacaacuccacauaucguguaguauccguccucaccguccuccaccaagacuggcucaacggcaaagaauacaaaugcaaaguauccaacaaagcccuaccggccccaaucgagaaaacgaucagcaaagcuaaaggacaaccccgagaaccccaaguuuacacucugcccccaucacgcgacgaacucaccaaaaaccaagucucacucacaugccuagucaaaggcuucuaccccucagacaucgccguagaaugggaauccaacggccaaccagaaaacaacuacaaaaccaccccacccguccucgacucagacggauccuucuuccucuacuccaaacuaaccguagacaaaucccgcuggcaacaaggaaacguauuuuccugcucagucaugcacgaagccuuacauaaccacuacacccagaaaagccucucccucucacccggaaaa

SEQ ID NO: 61302 - RNA, 630 nt, Artificial Sequence
  derived and/or modified sequence opt11 from CDS (LC) w/o signal peptide encoded by mRNA R3001, R3484
caaaucguccucucccaaucccccgccauccucuccgcaucccccggcgaaaaagucaccaugaccugccgcgccuccuccuccgucuccuacaugcacugguaccaacaaaaacccggcuccucccccaaacccuggaucuacgcccccucaaaccucgccuccggcguccccgcccgcuucuccggcuccggcuccggcaccuccuacucccucaccaucucacgcgucgaagccgaagacgccgccaccuacuacugccaacaaugguccuuuaacccccccaccuucggcgccggcaccaaacucgaacucaaacgcaccgucgcagcccccuccgucuucaucuucccccccucagacgaacaacuaaaauccggcaccgccuccgucgucugccuccucaacaacuucuacccccgagaagccaaaguccaauggaaagucgacaacgcccuccaaucuggaaacucacaagaauccgucaccgaacaagacuccaaagacuccaccuacucccucuccuccacacucacccucuccaaagccgacuacgaaaaacacaaagucuaugccugcgaagucacacaccaaggccucucaucccccgucaccaaaucauucaaccgc

SEQ ID NO: 61303 - protein, 478 aa, Artificial Sequence
  Protein 1 (HC) encoded by mRNA R3001, R3484
MAVMAPRTLVLLLSGALALTQTWAGQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61304 - protein, 472 aa, Artificial Sequence
  Protein 1 (HC) w/o his-tag encoded by mRNA R3001, R3484
MAVMAPRTLVLLLSGALALTQTWAGQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61305 - protein, 235 aa, Artificial Sequence
  Protein 2 (LC) encoded by mRNA R3001, R3484
MAVMAPRTLVLLLSGALALTQTWAGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 61306 - RNA, 1437 nt, Artificial Sequence
  CDS 1 (HC) as RNA from mRNA R3001, R3484
auggccgugauggcgccgcggacccugguccuccugcugagcggcgcccucgcccugacgcagaccugggccgggcaggccuaccugcagcagagcggcgcggagcucgugcggccgggggccucggucaagaugagcugcaaggccagcggcuacaccuucacgagcuacaacaugcacugggugaagcagaccccgcgccaggggcuggaguggaucggcgccaucuaccccgggaacggcgacaccagcuacaaccagaaguucaagggcaaggcgacccugacgguggacaagucgagcagcaccgccuacaugcagcucagcagccugaccucggaggacagcgccgucuacuucugcgcccgggugguguacuacagcaacagcuacugguacuucgacgucugggggaccggcacgaccgugaccgugagcgggcccagcgucuucccccuggcccccucgagcaagagcaccagcggcggcacggcggcccucgggugccuggugaaggacuacuuccccgagcccgugaccgucagcuggaacucgggcgcccugaccagcggggugcacaccuucccggccgugcuccagagcagcggccuguacagccugagcucggucgugacggugcccagcagcagccucgggacccagaccuacaucugcaacgucaaccacaagcccagcaacaccaagguggacaagaaggcggagcccaagucgugcgacaagacgcacaccugcccgcccugccccgcccccgagcugcugggcggcccgagcguguuccucuucccgcccaagcccaaggacacccugaugaucagccgcacccccgaggucacgugcgugguggucgacgugagccacgaggaccccgaggugaaguucaacugguacgucgacgggguggaggugcacaacgccaagaccaagccccgggaggagcaguacaacagcaccuaccgcgucgugagcgugcugaccguccuccaccaggacuggcugaacggcaaggaguacaagugcaaggugucgaacaaggcccugccggcccccaucgagaagacgaucagcaaggcgaaggggcagccccgggagccccagguguacacccucccgcccagccgcgacgagcugaccaagaaccaggucagccugaccugccucgugaagggcuucuaccccagcgacaucgccguggagugggagucgaacgggcagcccgagaacaacuacaagacgaccccgcccguccuggacagcgacggcagcuucuuccuguacagcaagcucaccguggacaagagccgguggcagcagggcaacguguucagcugcucggucaugcacgaggcccugcacaaccacuacacccagaagagccugagccucagccccgggaagcaucaucaucaucaucauuga

SEQ ID NO: 61307 - RNA, 1419 nt, Artificial Sequence
  CDS 1 (HC) w/o his-tag as RNA from mRNA R3001, R3484
auggccgugauggcgccgcggacccugguccuccugcugagcggcgcccucgcccugacgcagaccugggccgggcaggccuaccugcagcagagcggcgcggagcucgugcggccgggggccucggucaagaugagcugcaaggccagcggcuacaccuucacgagcuacaacaugcacugggugaagcagaccccgcgccaggggcuggaguggaucggcgccaucuaccccgggaacggcgacaccagcuacaaccagaaguucaagggcaaggcgacccugacgguggacaagucgagcagcaccgccuacaugcagcucagcagccugaccucggaggacagcgccgucuacuucugcgcccgggugguguacuacagcaacagcuacugguacuucgacgucugggggaccggcacgaccgugaccgugagcgggcccagcgucuucccccuggcccccucgagcaagagcaccagcggcggcacggcggcccucgggugccuggugaaggacuacuuccccgagcccgugaccgucagcuggaacucgggcgcccugaccagcggggugcacaccuucccggccgugcuccagagcagcggccuguacagccugagcucggucgugacggugcccagcagcagccucgggacccagaccuacaucugcaacgucaaccacaagcccagcaacaccaagguggacaagaaggcggagcccaagucgugcgacaagacgcacaccugcccgcccugccccgcccccgagcugcugggcggcccgagcguguuccucuucccgcccaagcccaaggacacccugaugaucagccgcacccccgaggucacgugcgugguggucgacgugagccacgaggaccccgaggugaaguucaacugguacgucgacgggguggaggugcacaacgccaagaccaagccccgggaggagcaguacaacagcaccuaccgcgucgugagcgugcugaccguccuccaccaggacuggcugaacggcaaggaguacaagugcaaggugucgaacaaggcccugccggcccccaucgagaagacgaucagcaaggcgaaggggcagccccgggagccccagguguacacccucccgcccagccgcgacgagcugaccaagaaccaggucagccugaccugccucgugaagggcuucuaccccagcgacaucgccguggagugggagucgaacgggcagcccgagaacaacuacaagacgaccccgcccguccuggacagcgacggcagcuucuuccuguacagcaagcucaccguggacaagagccgguggcagcagggcaacguguucagcugcucggucaugcacgaggcccugcacaaccacuacacccagaagagccugagccucagccccgggaaguga

SEQ ID NO: 61308 - RNA, 708 nt, Artificial Sequence
  CDS 2 (LC) as RNA from mRNA R3001, R3484
auggccgugauggcgccgcggacccugguccuccugcugagcggcgcccucgcccugacgcagaccugggccgggcagaucgugcugagccagucgccggccauccucagcgcgagccccggcgagaaggucaccaugacgugccgggccagcagcucggugagcuacaugcacugguaccagcagaagcccgggagcagccccaagccguggaucuacgcccccagcaaccuggccucgggcgugcccgcgcgcuucagcgggagcggcagcgggaccagcuacagccugaccaucucgcgggucgaggccgaggacgccgccaccuacuacugccagcaguggagcuucaacccgcccacguucggcgccggcaccaagcucgagcugaagcgcaccguggcggcccccagcguguucaucuucccgcccagcgacgagcagcugaagagcgggaccgccucggucgugugccuccugaacaacuucuacccccgggaggccaaggugcaguggaaggucgacaacgcgcugcagagcggcaacagccaggagagcgugacggagcaggacagcaaggacagcaccuacucgcucagcagcacccugacccugagcaaggccgacuacgagaagcacaagguguacgccugcgaggucacgcaccaggggcucagcucgcccgugaccaagagcuucaaccgcuga

SEQ ID NO: 61309 - RNA, 2824 nt, Artificial Sequence
  CDS (HC)-IRES-CDS (LC) as RNA from mRNA R3001, R3484
auggccgugauggcgccgcggacccugguccuccugcugagcggcgcccucgcccugacgcagaccugggccgggcaggccuaccugcagcagagcggcgcggagcucgugcggccgggggccucggucaagaugagcugcaaggccagcggcuacaccuucacgagcuacaacaugcacugggugaagcagaccccgcgccaggggcuggaguggaucggcgccaucuaccccgggaacggcgacaccagcuacaaccagaaguucaagggcaaggcgacccugacgguggacaagucgagcagcaccgccuacaugcagcucagcagccugaccucggaggacagcgccgucuacuucugcgcccgggugguguacuacagcaacagcuacugguacuucgacgucugggggaccggcacgaccgugaccgugagcgggcccagcgucuucccccuggcccccucgagcaagagcaccagcggcggcacggcggcccucgggugccuggugaaggacuacuuccccgagcccgugaccgucagcuggaacucgggcgcccugaccagcggggugcacaccuucccggccgugcuccagagcagcggccuguacagccugagcucggucgugacggugcccagcagcagccucgggacccagaccuacaucugcaacgucaaccacaagcccagcaacaccaagguggacaagaaggcggagcccaagucgugcgacaagacgcacaccugcccgcccugccccgcccccgagcugcugggcggcccgagcguguuccucuucccgcccaagcccaaggacacccugaugaucagccgcacccccgaggucacgugcgugguggucgacgugagccacgaggaccccgaggugaaguucaacugguacgucgacgggguggaggugcacaacgccaagaccaagccccgggaggagcaguacaacagcaccuaccgcgucgugagcgugcugaccguccuccaccaggacuggcugaacggcaaggaguacaagugcaaggugucgaacaaggcccugccggcccccaucgagaagacgaucagcaaggcgaaggggcagccccgggagccccagguguacacccucccgcccagccgcgacgagcugaccaagaaccaggucagccugaccugccucgugaagggcuucuaccccagcgacaucgccguggagugggagucgaacgggcagcccgagaacaacuacaagacgaccccgcccguccuggacagcgacggcagcuucuuccuguacagcaagcucaccguggacaagagccgguggcagcagggcaacguguucagcugcucggucaugcacgaggcccugcacaaccacuacacccagaagagccugagccucagccccgggaagcaucaucaucaucaucauugaccaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccgggcagaucgugcugagccagucgccggccauccucagcgcgagccccggcgagaaggucaccaugacgugccgggccagcagcucggugagcuacaugcacugguaccagcagaagcccgggagcagccccaagccguggaucuacgcccccagcaaccuggccucgggcgugcccgcgcgcuucagcgggagcggcagcgggaccagcuacagccugaccaucucgcgggucgaggccgaggacgccgccaccuacuacugccagcaguggagcuucaacccgcccacguucggcgccggcaccaagcucgagcugaagcgcaccguggcggcccccagcguguucaucuucccgcccagcgacgagcagcugaagagcgggaccgccucggucgugugccuccugaacaacuucuacccccgggaggccaaggugcaguggaaggucgacaacgcgcugcagagcggcaacagccaggagagcgugacggagcaggacagcaaggacagcaccuacucgcucagcagcacccugacccugagcaaggccgacuacgagaagcacaagguguacgccugcgaggucacgcaccaggggcucagcucgcccgugaccaagagcuucaaccgcuga

SEQ ID NO: 61310 - RNA, 3028 nt, Artificial Sequence
  R3001
gggagaaagcuuaccauggccgugauggcgccgcggacccugguccuccugcugagcggcgcccucgcccugacgcagaccugggccgggcaggccuaccugcagcagagcggcgcggagcucgugcggccgggggccucggucaagaugagcugcaaggccagcggcuacaccuucacgagcuacaacaugcacugggugaagcagaccccgcgccaggggcuggaguggaucggcgccaucuaccccgggaacggcgacaccagcuacaaccagaaguucaagggcaaggcgacccugacgguggacaagucgagcagcaccgccuacaugcagcucagcagccugaccucggaggacagcgccgucuacuucugcgcccgggugguguacuacagcaacagcuacugguacuucgacgucugggggaccggcacgaccgugaccgugagcgggcccagcgucuucccccuggcccccucgagcaagagcaccagcggcggcacggcggcccucgggugccuggugaaggacuacuuccccgagcccgugaccgucagcuggaacucgggcgcccugaccagcggggugcacaccuucccggccgugcuccagagcagcggccuguacagccugagcucggucgugacggugcccagcagcagccucgggacccagaccuacaucugcaacgucaaccacaagcccagcaacaccaagguggacaagaaggcggagcccaagucgugcgacaagacgcacaccugcccgcccugccccgcccccgagcugcugggcggcccgagcguguuccucuucccgcccaagcccaaggacacccugaugaucagccgcacccccgaggucacgugcgugguggucgacgugagccacgaggaccccgaggugaaguucaacugguacgucgacgggguggaggugcacaacgccaagaccaagccccgggaggagcaguacaacagcaccuaccgcgucgugagcgugcugaccguccuccaccaggacuggcugaacggcaaggaguacaagugcaaggugucgaacaaggcccugccggcccccaucgagaagacgaucagcaaggcgaaggggcagccccgggagccccagguguacacccucccgcccagccgcgacgagcugaccaagaaccaggucagccugaccugccucgugaagggcuucuaccccagcgacaucgccguggagugggagucgaacgggcagcccgagaacaacuacaagacgaccccgcccguccuggacagcgacggcagcuucuuccuguacagcaagcucaccguggacaagagccgguggcagcagggcaacguguucagcugcucggucaugcacgaggcccugcacaaccacuacacccagaagagccugagccucagccccgggaagcaucaucaucaucaucauugaccaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccgggcagaucgugcugagccagucgccggccauccucagcgcgagccccggcgagaaggucaccaugacgugccgggccagcagcucggugagcuacaugcacugguaccagcagaagcccgggagcagccccaagccguggaucuacgcccccagcaaccuggccucgggcgugcccgcgcgcuucagcgggagcggcagcgggaccagcuacagccugaccaucucgcgggucgaggccgaggacgccgccaccuacuacugccagcaguggagcuucaacccgcccacguucggcgccggcaccaagcucgagcugaagcgcaccguggcggcccccagcguguucaucuucccgcccagcgacgagcagcugaagagcgggaccgccucggucgugugccuccugaacaacuucuacccccgggaggccaaggugcaguggaaggucgacaacgcgcugcagagcggcaacagccaggagagcgugacggagcaggacagcaaggacagcaccuacucgcucagcagcacccugacccugagcaaggccgacuacgagaagcacaagguguacgccugcgaggucacgcaccaggggcucagcucgcccgugaccaagagcuucaaccgcugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61311 - RNA, 3016 nt, Artificial Sequence
  R3484
gggagaaagcuuaccauggccgugauggcgccgcggacccugguccuccugcugagcggcgcccucgcccugacgcagaccugggccgggcaggccuaccugcagcagagcggcgcggagcucgugcggccgggggccucggucaagaugagcugcaaggccagcggcuacaccuucacgagcuacaacaugcacugggugaagcagaccccgcgccaggggcuggaguggaucggcgccaucuaccccgggaacggcgacaccagcuacaaccagaaguucaagggcaaggcgacccugacgguggacaagucgagcagcaccgccuacaugcagcucagcagccugaccucggaggacagcgccgucuacuucugcgcccgggugguguacuacagcaacagcuacugguacuucgacgucugggggaccggcacgaccgugaccgugagcgggcccagcgucuucccccuggcccccucgagcaagagcaccagcggcggcacggcggcccucgggugccuggugaaggacuacuuccccgagcccgugaccgucagcuggaacucgggcgcccugaccagcggggugcacaccuucccggccgugcuccagagcagcggccuguacagccugagcucggucgugacggugcccagcagcagccucgggacccagaccuacaucugcaacgucaaccacaagcccagcaacaccaagguggacaagaaggcggagcccaagucgugcgacaagacgcacaccugcccgcccugccccgcccccgagcugcugggcggcccgagcguguuccucuucccgcccaagcccaaggacacccugaugaucagccgcacccccgaggucacgugcgugguggucgacgugagccacgaggaccccgaggugaaguucaacugguacgucgacgggguggaggugcacaacgccaagaccaagccccgggaggagcaguacaacagcaccuaccgcgucgugagcgugcugaccguccuccaccaggacuggcugaacggcaaggaguacaagugcaaggugucgaacaaggcccugccggcccccaucgagaagacgaucagcaaggcgaaggggcagccccgggagccccagguguacacccucccgcccagccgcgacgagcugaccaagaaccaggucagccugaccugccucgugaagggcuucuaccccagcgacaucgccguggagugggagucgaacgggcagcccgagaacaacuacaagacgaccccgcccguccuggacagcgacggcagcuucuuccuguacagcaagcucaccguggacaagagccgguggcagcagggcaacguguucagcugcucggucaugcacgaggcccugcacaaccacuacacccagaagagccugagccucagccccgggaagcaucaucaucaucaucauugaccaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccgggcagaucgugcugagccagucgccggccauccucagcgcgagccccggcgagaaggucaccaugacgugccgggccagcagcucggugagcuacaugcacugguaccagcagaagcccgggagcagccccaagccguggaucuacgcccccagcaaccuggccucgggcgugcccgcgcgcuucagcgggagcggcagcgggaccagcuacagccugaccaucucgcgggucgaggccgaggacgccgccaccuacuacugccagcaguggagcuucaacccgcccacguucggcgccggcaccaagcucgagcugaagcgcaccguggcggcccccagcguguucaucuucccgcccagcgacgagcagcugaagagcgggaccgccucggucgugugccuccugaacaacuucuacccccgggaggccaaggugcaguggaaggucgacaacgcgcugcagagcggcaacagccaggagagcgugacggagcaggacagcaaggacagcaccuacucgcucagcagcacccugacccugagcaaggccgacuacgagaagcacaagguguacgccugcgaggucacgcaccaggggcucagcucgcccgugaccaagagcuucaaccgcugaccacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61312 - protein, 451 aa, Artificial Sequence; identical to SEQ ID NO: 766
  Protein (HC) w/o signal peptide encoded by mRNA R3917, R4128, R5910

SEQ ID NO: 61313 - RNA, 1353 nt, Artificial Sequence
  CDS (HC) w/o signal peptide encoded by mRNA R3917, R4128, R5910
caggugcagcugcagcagcccggggcggagcuggucaagccgggcgccagcgugaagauguccugcaaggccagcggguacaccuucacguccuacaacaugcacugggugaagcagacccccggccgggggcucgaguggaucggcgccaucuaccccggcaacggggacaccagcuacaaccagaaguucaagggcaaggccacccugacggcggacaaguccagcuccaccgccuacaugcagcugagcucccucaccagcgaggacuccgccgucuacuacugcgcccgcagcaccuacuacgggggcgacugguacuucaacguguggggcgcggggacgaccgugaccgucuccgccgccagcaccaagggccccuccguguucccgcuggcccccagcuccaagagcacgagcgggggcaccgccgcgcuggggugccucgugaaggacuacuuccccgagcccgucaccguguccuggaacagcggcgcccugaccuccggcgugcacacguucccggccguccugcagagcuccgggcucuacagccuguccagcguggugaccguccccuccagcucccugggcacccagaccuacaucugcaacgugaaccacaagcccagcaacacgaagguggacaagaagguggagcccaaguccugcgacaagacccacaccugcccgcccugccccgccccggagcuccugggcgggccgagcgucuuccuguucccgcccaagcccaaggacacccucaugaucucccggacgcccgaggugaccugcguggucguggacgucagccacgaggaccccgaggugaaguucaacugguacguggacggggucgaggugcacaacgcgaagaccaagccccgcgaggagcaguacaacuccaccuaccggguggucagcgugcugacggugcugcaccaggacuggcucaacggcaaggaguacaagugcaaggucuccaacaaggcccugcccgccccgaucgagaagaccaucagcaaggccaagggccagccccgcgagccccagguguacacccugcccccgagccgggacgagcucaccaagaaccaggugucccugacgugccuggucaagggguucuaccccagcgacaucgccguggagugggaguccaacggccagcccgagaacaacuacaagaccaccccgcccgugcucgacagcgacggguccuucuuccuguacagcaagcugaccgucgacaagucccgcuggcagcagggcaacguguucagcugcuccgugaugcacgaggcgcuccacaaccacuacacgcagaagagccugucccugagccccgggaag

SEQ ID NO: 61314 - RNA, 1353 nt, Artificial Sequence; identical to SEQ ID NO: 16050
  derived and/or modified sequence opt2 from CDS (HC) w/o signal peptide encoded by mRNA R3917, R4128, R5910

SEQ ID NO: 61315 - RNA, 1353 nt, Artificial Sequence; identical to SEQ ID NO: 23692
  derived and/or modified sequence opt3 from CDS (HC) w/o signal peptide encoded by mRNA R3917, R4128, R5910

SEQ ID NO: 61316 - RNA, 1353 nt, Artificial Sequence; identical to SEQ ID NO: 31334
  derived and/or modified sequence opt4 from CDS (HC) w/o signal peptide encoded by mRNA R3917, R4128, R5910

SEQ ID NO: 61317 - RNA, 1353 nt, Artificial Sequence; identical to SEQ ID NO: 38976
  derived and/or modified sequence opt5 from CDS (HC) w/o signal peptide encoded by mRNA R3917, R4128, R5910

SEQ ID NO: 61318 - RNA, 1353 nt, Artificial Sequence
  derived and/or modified sequence opt6 from CDS (HC) w/o signal peptide encoded by mRNA R3917, R4128, R5910
caaguacaacuacaacaaccuggagcagaauuaguaaaaccaggagcaucagucaaaaugucaugcaaagccucaggauauacuuuuacuucauacaauaugcacuggguaaaacaaacaccaggacgaggccuagaauggauaggagcaaucuaccccggcaauggggacacaucauacaaucaaaaauuuaaaggaaaagcaacucuaacagcagacaaaucuucaucaacagcauauaugcaacuaagcucacuaacaagcgaagacucagcaguauacuacugugcacgauccacauacuacggaggugacugguauuucaacguauggggagcaggaaccacaguaaccguaucagcagcaucaacaaaaggacccuccguauuuccacuagcaccaucaaguaaaucaacauccggaggaacagcagcauuaggcugucuaguaaaagacuacuuuccagaaccaguaaccguaucauggaacucaggagcacuaaccuccggcguacacacauucccagcaguccuucaaucaucaggacuauacaguuuauccucaguaguaaccguacccucaucuucuuuaggaacacagacauacauaugcaaugucaaccacaaacccuccaauaccaaaguagacaagaaaguagaaccaaaaagcugugacaaaacacauaccuguccaccaugucccgcaccagaauuauuaggagggccaucaguauuccuauucccaccaaaaccaaaagacacacuaaugaucucacgaacaccagaaguaacaugcguugugguagacguaucacaugaagaccccgaaguaaaauucaacugguacguagacggaguagaaguacauaaugccaaaacaaaaccccgcgaagaacaauauaauucaaccuauagggucgucaguguauuaacaguacuacaucaagacuggcuaaacggaaaagaauacaaaugcaaaguaucuaacaaagcauuaccagcaccaauagagaaaacaaucucaaaagcaaaaggacaaccaagagaaccacaaguuuacacucucccaccaucaagagacgaacuaaccaaaaaccaagucucauuaacaugucuaguaaaaggauucuaccccucagacauagcugucgaaugggaaucaaauggacaaccagaaaauaacuacaaaaccacaccaccaguucuugauucagacggaucauucuuccuauacucaaaacuaacaguagauaaaucuagauggcaacaaggaaacguauucucaugcucaguaaugcacgaagcauuacacaaccacuauacccaaaaaucacuaucacuaucuccaggaaaa

SEQ ID NO: 61319 - RNA, 1353 nt, Artificial Sequence
  derived and/or modified sequence opt11 from CDS (HC) w/o signal peptide encoded by mRNA R3917, R4128, R5910
caaguacaacuacaacaacccggcgccgaacucgucaaacccggcgccagcgucaaaauguccugcaaagccuccggcuacacuuucaccucauacaacaugcacuggguaaaacaaacccccggucgaggacucgaauggaucggcgcaaucuaucccggcaacggagacaccuccuacaaccagaaauucaaaggcaaagccacccucacagcagacaaauccuccucaacagccuacaugcaacucuccucccugaccuccgaagacagcgccgucuacuacugcgcccgcuccaccuacuacggcggagacugguacuucaacguauggggagcuggcaccacagucaccgucucagccgcuucaacaaaaggccccagugucuucccccucgcacccucauccaaauccaccuccggagggaccgcagcccucggcugucugguaaaagacuacuuccccgaacccgucaccgucuccuggaacucaggugcacucaccuccggaguccacaccuuccccgccguccuccaaagcuccggccucuacucccucuccuccguagucaccgugcccucaagcucacucgggacacagacauacaucugcaacgucaaccauaaaccauccaacaccaaagucgacaagaaagucgaacccaaauccugcgacaaaacccacaccuguccacccugccccgcccccgaauuacucggcggacccuccgucuuccucuucccaccaaaacccaaagacacacuaaugauaagccgcaccccugaaguaaccugcgucgucguagacgucucacacgaagacccagaagucaaauucaacugguacgucgauggcgucgaaguccacaacgcaaaaacaaaaccccgggaagaacaauauaacuccacauaccgagucgucuccguccuuaccguucuccaccaagacuggcuaaacggcaaagaauacaaaugcaaaguaucaaacaaagcacuccccgcccccauagagaaaaccaucuccaaagccaaaggacaaccccgcgaaccccaaguauacacccucccacccucccgcgacgaacucacgaaaaaccaagucucucuaaccugccucguaaaaggcuucuaccccuccgacauagccgucgaaugggaauccaacggccaacccgaaaacaacuacaaaacaaccccacccguccucgacucagacggcuccuucuuucuauacucaaaacucaccguggauaagucuagauggcagcaaggaaacgucuuuuccugcagcguaaugcacgaagcacuacacaaccacuacacccaaaaaucccucagcuuaagccccggaaaa

SEQ ID NO: 61320 - protein, 475 aa, Artificial Sequence
  Protein (HC) encoded by mRNA R3917, R4128, R5910
MAVMAPRTLVLLLSGALALTQTWAQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61321 - RNA, 1428 nt, Artificial Sequence
  CDS (HC) encoded by mRNA R3917, R4128, R5910
auggccgugauggccccgcggacccugguccuccugcugagcggcgcgcucgcccugacccagacgugggcccaggugcagcugcagcagcccggggcggagcuggucaagccgggcgccagcgugaagauguccugcaaggccagcggguacaccuucacguccuacaacaugcacugggugaagcagacccccggccgggggcucgaguggaucggcgccaucuaccccggcaacggggacaccagcuacaaccagaaguucaagggcaaggccacccugacggcggacaaguccagcuccaccgccuacaugcagcugagcucccucaccagcgaggacuccgccgucuacuacugcgcccgcagcaccuacuacgggggcgacugguacuucaacguguggggcgcggggacgaccgugaccgucuccgccgccagcaccaagggccccuccguguucccgcuggcccccagcuccaagagcacgagcgggggcaccgccgcgcuggggugccucgugaaggacuacuuccccgagcccgucaccguguccuggaacagcggcgcccugaccuccggcgugcacacguucccggccguccugcagagcuccgggcucuacagccuguccagcguggugaccguccccuccagcucccugggcacccagaccuacaucugcaacgugaaccacaagcccagcaacacgaagguggacaagaagguggagcccaaguccugcgacaagacccacaccugcccgcccugccccgccccggagcuccugggcgggccgagcgucuuccuguucccgcccaagcccaaggacacccucaugaucucccggacgcccgaggugaccugcguggucguggacgucagccacgaggaccccgaggugaaguucaacugguacguggacggggucgaggugcacaacgcgaagaccaagccccgcgaggagcaguacaacuccaccuaccggguggucagcgugcugacggugcugcaccaggacuggcucaacggcaaggaguacaagugcaaggucuccaacaaggcccugcccgccccgaucgagaagaccaucagcaaggccaagggccagccccgcgagccccagguguacacccugcccccgagccgggacgagcucaccaagaaccaggugucccugacgugccuggucaagggguucuaccccagcgacaucgccguggagugggaguccaacggccagcccgagaacaacuacaagaccaccccgcccgugcucgacagcgacggguccuucuuccuguacagcaagcugaccgucgacaagucccgcuggcagcagggcaacguguucagcugcuccgugaugcacgaggcgcuccacaaccacuacacgcagaagagccugucccugagccccgggaaguga

SEQ ID NO: 61322 - RNA, 1632 nt, Artificial Sequence
  R4128
gggagaaagcuuaccauggccgugauggccccgcggacccugguccuccugcugagcggcgcgcucgcccugacccagacgugggcccaggugcagcugcagcagcccggggcggagcuggucaagccgggcgccagcgugaagauguccugcaaggccagcggguacaccuucacguccuacaacaugcacugggugaagcagacccccggccgggggcucgaguggaucggcgccaucuaccccggcaacggggacaccagcuacaaccagaaguucaagggcaaggccacccugacggcggacaaguccagcuccaccgccuacaugcagcugagcucccucaccagcgaggacuccgccgucuacuacugcgcccgcagcaccuacuacgggggcgacugguacuucaacguguggggcgcggggacgaccgugaccgucuccgccgccagcaccaagggccccuccguguucccgcuggcccccagcuccaagagcacgagcgggggcaccgccgcgcuggggugccucgugaaggacuacuuccccgagcccgucaccguguccuggaacagcggcgcccugaccuccggcgugcacacguucccggccguccugcagagcuccgggcucuacagccuguccagcguggugaccguccccuccagcucccugggcacccagaccuacaucugcaacgugaaccacaagcccagcaacacgaagguggacaagaagguggagcccaaguccugcgacaagacccacaccugcccgcccugccccgccccggagcuccugggcgggccgagcgucuuccuguucccgcccaagcccaaggacacccucaugaucucccggacgcccgaggugaccugcguggucguggacgucagccacgaggaccccgaggugaaguucaacugguacguggacggggucgaggugcacaacgcgaagaccaagccccgcgaggagcaguacaacuccaccuaccggguggucagcgugcugacggugcugcaccaggacuggcucaacggcaaggaguacaagugcaaggucuccaacaaggcccugcccgccccgaucgagaagaccaucagcaaggccaagggccagccccgcgagccccagguguacacccugcccccgagccgggacgagcucaccaagaaccaggugucccugacgugccuggucaagggguucuaccccagcgacaucgccguggagugggaguccaacggccagcccgagaacaacuacaagaccaccccgcccgugcucgacagcgacggguccuucuuccuguacagcaagcugaccgucgacaagucccgcuggcagcagggcaacguguucagcugcuccgugaugcacgaggcgcuccacaaccacuacacgcagaagagccugucccugagccccgggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61323 - RNA, 1830 nt, Artificial Sequence
  R5910
gggucccgcagucggcguccagcggcucugcuuguucgugugugugucguugcaggccuuauucaagcuuaccauggccgugauggccccgcggacccugguccuccugcugagcggcgcgcucgcccugacccagacgugggcccaggugcagcugcagcagcccggggcggagcuggucaagccgggcgccagcgugaagauguccugcaaggccagcggguacaccuucacguccuacaacaugcacugggugaagcagacccccggccgggggcucgaguggaucggcgccaucuaccccggcaacggggacaccagcuacaaccagaaguucaagggcaaggccacccugacggcggacaaguccagcuccaccgccuacaugcagcugagcucccucaccagcgaggacuccgccgucuacuacugcgcccgcagcaccuacuacgggggcgacugguacuucaacguguggggcgcggggacgaccgugaccgucuccgccgccagcaccaagggccccuccguguucccgcuggcccccagcuccaagagcacgagcgggggcaccgccgcgcuggggugccucgugaaggacuacuuccccgagcccgucaccguguccuggaacagcggcgcccugaccuccggcgugcacacguucccggccguccugcagagcuccgggcucuacagccuguccagcguggugaccguccccuccagcucccugggcacccagaccuacaucugcaacgugaaccacaagcccagcaacacgaagguggacaagaagguggagcccaaguccugcgacaagacccacaccugcccgcccugccccgccccggagcuccugggcgggccgagcgucuuccuguucccgcccaagcccaaggacacccucaugaucucccggacgcccgaggugaccugcguggucguggacgucagccacgaggaccccgaggugaaguucaacugguacguggacggggucgaggugcacaacgcgaagaccaagccccgcgaggagcaguacaacuccaccuaccggguggucagcgugcugacggugcugcaccaggacuggcucaacggcaaggaguacaagugcaaggucuccaacaaggcccugcccgccccgaucgagaagaccaucagcaaggccaagggccagccccgcgagccccagguguacacccugcccccgagccgggacgagcucaccaagaaccaggugucccugacgugccuggucaagggguucuaccccagcgacaucgccguggagugggaguccaacggccagcccgagaacaacuacaagaccaccccgcccgugcucgacagcgacggguccuucuuccuguacagcaagcugaccgucgacaagucccgcuggcagcagggcaacguguucagcugcuccgugaugcacgaggcgcuccacaaccacuacacgcagaagagccugucccugagccccgggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61324 - protein, 213 aa, Artificial Sequence; identical to SEQ ID NO: 768
  Protein (LC) w/o signal peptide encoded by mRNA R3917, R4129, R5911

SEQ ID NO: 61325 - RNA, 639 nt, Artificial Sequence
  CDS (LC) w/o signal peptide encoded by mRNA R3917, R4129, R5911
cagaucgugcugagccagucccccgccauccugagcgcguccccgggggagaaggugaccaugaccugccgggccagcuccagcgucuccuacauccacugguuccagcagaagcccggcagcucccccaagcccuggaucuacgccacgagcaaccucgccuccggggugccggugcgcuucagcggcuccgggagcggcaccuccuacagccugaccaucagccgggucgaggccgaggacgcggccaccuacuacugccagcaguggacguccaacccgcccaccuucggcgggggcaccaagcuggagaucaagcgcaccguggccgcccccagcguguucaucuucccgcccuccgacgagcagcucaagagcgggacggcguccgucgugugccugcugaacaacuucuacccccgggaggccaaggugcaguggaaggucgacaacgcccuccagagcggcaacucccaggagagcgugaccgagcaggacuccaaggacagcaccuacucccugagcuccacccugacgcucagcaaggccgacuacgagaagcacaagguguacgccugcgaggucacccaccaggggcuguccagccccgugaccaaguccuucaaccgcggcgagugc

SEQ ID NO: 61326 - RNA, 639 nt, Artificial Sequence; identical to SEQ ID NO: 16052
  derived and/or modified sequence opt2 from CDS (LC) w/o signal peptide encoded by mRNA R3917, R4129, R5911

SEQ ID NO: 61327 - RNA, 639 nt, Artificial Sequence; identical to SEQ ID NO: 23694
  derived and/or modified sequence opt3 from CDS (LC) w/o signal peptide encoded by mRNA R3917, R4129, R5911

SEQ ID NO: 61328 - RNA, 639 nt, Artificial Sequence; identical to SEQ ID NO: 31336
  derived and/or modified sequence opt4 from CDS (LC) w/o signal peptide encoded by mRNA R3917, R4129, R5911

SEQ ID NO: 61329 - RNA, 639 nt, Artificial Sequence; identical to SEQ ID NO: 38978
  derived and/or modified sequence opt5 from CDS (LC) w/o signal peptide encoded by mRNA R3917, R4129, R5911

SEQ ID NO: 61330 - RNA, 639 nt, Artificial Sequence
  derived and/or modified sequence opt6 from CDS (LC) w/o signal peptide encoded by mRNA R3917, R4129, R5911
caaaucguccuaucacaaucaccagcaauacuaucagcaucaccaggagaaaaaguaacaaugacaugcagagcaucaucaucaguaucauacauacacugguuccaacaaaaaccaggauccucacccaaaccauggauauacgcaacaagcaaccuagcaucaggaguaccaguaagauucucaggcucaggaucuggaacaucauacucacuaacaauauccagaguagaagcagaagacgcagcaacauacuacugccaacaauggacaucaaacccaccaacauucggaggcggaacaaaauuagaaauaaaaagaacaguagcagcaccaucaguauucauauucccaccaucagacgaacaacuaaaaucaggaacagcauccguaguaugccuacuaaacaacuucuaccccagagaagcaaaaguccaauggaaaguagacaacgcacuacaaucaggaaacucccaagaaucaguaacagaacaagacaguaaagacucaacauauucauuaucaucaacauuaacacuaucaaaagcagacuacgaaaaacacaaaguauacgccugcgaaguaacacaccaaggacuauccucaccaguaacaaaaucauucaacagaggcgaaugc

SEQ ID NO: 61331 - RNA, 639 nt, Artificial Sequence
  derived and/or modified sequence opt11 from CDS (LC) w/o signal peptide encoded by mRNA R3917, R4129, R5911
caaaucguacucucccaaucccccgcuauccucucagccucccccggcgaaaaagucaccaugacaugccgcgcaucauccuccgucuccuacauccacugguuccaacaaaaacccggcucaucccccaaacccuggaucuacgccaccuccaaccuagcaucaggcguccccguccgcuucuccggcuccggcuccggcacauccuacucacucaccaucucccgcgucgaagccgaagacgccgccaccuacuacugccaacaauggaccuccaacccccccaccuucggcggcggcaccaaacuagaaaucaaacgcaccguagcagcacccuccgucuucaucuucccccccuccgacgaacaacucaaaucaggcaccgccucagucgucugccuccucaacaacuucuaccccagagaagccaaaguccaauggaaagucgacaacgcucuccaauccggcaacucacaagaauccgucaccgaacaagacucaaaagacucaaccuacucccucuccuccacccucacccuauccaaagccgacuacgaaaaacacaaaguauacgcaugcgaagucacccaccaaggccucuccucccccgucaccaaauccuucaaccgcggcgaaugc

SEQ ID NO: 61332 - protein, 237 aa, Artificial Sequence
  Protein (LC) encoded by mRNA R3917, R4129, R5911
MAVMAPRTLVLLLSGALALTQTWAQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61333 - RNA, 714 nt, Artificial Sequence
  CDS (LC) encoded by mRNA R3917, R4129, R5911
auggccgugauggccccgcggacccugguccuccugcugagcggcgcgcucgcccugacccagacgugggcccagaucgugcugagccagucccccgccauccugagcgcguccccgggggagaaggugaccaugaccugccgggccagcuccagcgucuccuacauccacugguuccagcagaagcccggcagcucccccaagcccuggaucuacgccacgagcaaccucgccuccggggugccggugcgcuucagcggcuccgggagcggcaccuccuacagccugaccaucagccgggucgaggccgaggacgcggccaccuacuacugccagcaguggacguccaacccgcccaccuucggcgggggcaccaagcuggagaucaagcgcaccguggccgcccccagcguguucaucuucccgcccuccgacgagcagcucaagagcgggacggcguccgucgugugccugcugaacaacuucuacccccgggaggccaaggugcaguggaaggucgacaacgcccuccagagcggcaacucccaggagagcgugaccgagcaggacuccaaggacagcaccuacucccugagcuccacccugacgcucagcaaggccgacuacgagaagcacaagguguacgccugcgaggucacccaccaggggcuguccagccccgugaccaaguccuucaaccgcggcgagugcuga

SEQ ID NO: 61334 - RNA, 918 nt, Artificial Sequence
  R4129
gggagaaagcuuaccauggccgugauggccccgcggacccugguccuccugcugagcggcgcgcucgcccugacccagacgugggcccagaucgugcugagccagucccccgccauccugagcgcguccccgggggagaaggugaccaugaccugccgggccagcuccagcgucuccuacauccacugguuccagcagaagcccggcagcucccccaagcccuggaucuacgccacgagcaaccucgccuccggggugccggugcgcuucagcggcuccgggagcggcaccuccuacagccugaccaucagccgggucgaggccgaggacgcggccaccuacuacugccagcaguggacguccaacccgcccaccuucggcgggggcaccaagcuggagaucaagcgcaccguggccgcccccagcguguucaucuucccgcccuccgacgagcagcucaagagcgggacggcguccgucgugugccugcugaacaacuucuacccccgggaggccaaggugcaguggaaggucgacaacgcccuccagagcggcaacucccaggagagcgugaccgagcaggacuccaaggacagcaccuacucccugagcuccacccugacgcucagcaaggccgacuacgagaagcacaagguguacgccugcgaggucacccaccaggggcuguccagccccgugaccaaguccuucaaccgcggcgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61335 - RNA, 1116 nt, Artificial Sequence
  R5911
gggucccgcagucggcguccagcggcucugcuuguucgugugugugucguugcaggccuuauucaagcuuaccauggccgugauggccccgcggacccugguccuccugcugagcggcgcgcucgcccugacccagacgugggcccagaucgugcugagccagucccccgccauccugagcgcguccccgggggagaaggugaccaugaccugccgggccagcuccagcgucuccuacauccacugguuccagcagaagcccggcagcucccccaagcccuggaucuacgccacgagcaaccucgccuccggggugccggugcgcuucagcggcuccgggagcggcaccuccuacagccugaccaucagccgggucgaggccgaggacgcggccaccuacuacugccagcaguggacguccaacccgcccaccuucggcgggggcaccaagcuggagaucaagcgcaccguggccgcccccagcguguucaucuucccgcccuccgacgagcagcucaagagcgggacggcguccgucgugugccugcugaacaacuucuacccccgggaggccaaggugcaguggaaggucgacaacgcccuccagagcggcaacucccaggagagcgugaccgagcaggacuccaaggacagcaccuacucccugagcuccacccugacgcucagcaaggccgacuacgagaagcacaagguguacgccugcgaggucacccaccaggggcuguccagccccgugaccaaguccuucaaccgcggcgagugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61336 - RNA, 2819 nt, Artificial Sequence
  CDS (HC)-IRES-CDS (LC) as RNA from mRNA R3917
auggccgugauggccccgcggacccugguccuccugcugagcggcgcgcucgcccugacccagacgugggcccaggugcagcugcagcagcccggggcggagcuggucaagccgggcgccagcgugaagauguccugcaaggccagcggguacaccuucacguccuacaacaugcacugggugaagcagacccccggccgggggcucgaguggaucggcgccaucuaccccggcaacggggacaccagcuacaaccagaaguucaagggcaaggccacccugacggcggacaaguccagcuccaccgccuacaugcagcugagcucccucaccagcgaggacuccgccgucuacuacugcgcccgcagcaccuacuacgggggcgacugguacuucaacguguggggcgcggggacgaccgugaccgucuccgccgccagcaccaagggccccuccguguucccgcuggcccccagcuccaagagcacgagcgggggcaccgccgcgcuggggugccucgugaaggacuacuuccccgagcccgucaccguguccuggaacagcggcgcccugaccuccggcgugcacacguucccggccguccugcagagcuccgggcucuacagccuguccagcguggugaccguccccuccagcucccugggcacccagaccuacaucugcaacgugaaccacaagcccagcaacacgaagguggacaagaagguggagcccaaguccugcgacaagacccacaccugcccgcccugccccgccccggagcuccugggcgggccgagcgucuuccuguucccgcccaagcccaaggacacccucaugaucucccggacgcccgaggugaccugcguggucguggacgucagccacgaggaccccgaggugaaguucaacugguacguggacggggucgaggugcacaacgcgaagaccaagccccgcgaggagcaguacaacuccaccuaccggguggucagcgugcugacggugcugcaccaggacuggcucaacggcaaggaguacaagugcaaggucuccaacaaggcccugcccgccccgaucgagaagaccaucagcaaggccaagggccagccccgcgagccccagguguacacccugcccccgagccgggacgagcucaccaagaaccaggugucccugacgugccuggucaagggguucuaccccagcgacaucgccguggagugggaguccaacggccagcccgagaacaacuacaagaccaccccgcccgugcucgacagcgacggguccuucuuccuguacagcaagcugaccgucgacaagucccgcuggcagcagggcaacguguucagcugcuccgugaugcacgaggcgcuccacaaccacuacacgcagaagagccugucccugagccccgggaagugaaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggcccagaucgugcugagccagucccccgccauccugagcgcguccccgggggagaaggugaccaugaccugccgggccagcuccagcgucuccuacauccacugguuccagcagaagcccggcagcucccccaagcccuggaucuacgccacgagcaaccucgccuccggggugccggugcgcuucagcggcuccgggagcggcaccuccuacagccugaccaucagccgggucgaggccgaggacgcggccaccuacuacugccagcaguggacguccaacccgcccaccuucggcgggggcaccaagcuggagaucaagcgcaccguggccgcccccagcguguucaucuucccgcccuccgacgagcagcucaagagcgggacggcguccgucgugugccugcugaacaacuucuacccccgggaggccaaggugcaguggaaggucgacaacgcccuccagagcggcaacucccaggagagcgugaccgagcaggacuccaaggacagcaccuacucccugagcuccacccugacgcucagcaaggccgacuacgagaagcacaagguguacgccugcgaggucacccaccaggggcuguccagccccgugaccaaguccuucaaccgcggcgagugcuga

SEQ ID NO: 61337 - RNA, 3023 nt, Artificial Sequence
  R3917
gggagaaagcuuaccauggccgugauggccccgcggacccugguccuccugcugagcggcgcgcucgcccugacccagacgugggcccaggugcagcugcagcagcccggggcggagcuggucaagccgggcgccagcgugaagauguccugcaaggccagcggguacaccuucacguccuacaacaugcacugggugaagcagacccccggccgggggcucgaguggaucggcgccaucuaccccggcaacggggacaccagcuacaaccagaaguucaagggcaaggccacccugacggcggacaaguccagcuccaccgccuacaugcagcugagcucccucaccagcgaggacuccgccgucuacuacugcgcccgcagcaccuacuacgggggcgacugguacuucaacguguggggcgcggggacgaccgugaccgucuccgccgccagcaccaagggccccuccguguucccgcuggcccccagcuccaagagcacgagcgggggcaccgccgcgcuggggugccucgugaaggacuacuuccccgagcccgucaccguguccuggaacagcggcgcccugaccuccggcgugcacacguucccggccguccugcagagcuccgggcucuacagccuguccagcguggugaccguccccuccagcucccugggcacccagaccuacaucugcaacgugaaccacaagcccagcaacacgaagguggacaagaagguggagcccaaguccugcgacaagacccacaccugcccgcccugccccgccccggagcuccugggcgggccgagcgucuuccuguucccgcccaagcccaaggacacccucaugaucucccggacgcccgaggugaccugcguggucguggacgucagccacgaggaccccgaggugaaguucaacugguacguggacggggucgaggugcacaacgcgaagaccaagccccgcgaggagcaguacaacuccaccuaccggguggucagcgugcugacggugcugcaccaggacuggcucaacggcaaggaguacaagugcaaggucuccaacaaggcccugcccgccccgaucgagaagaccaucagcaaggccaagggccagccccgcgagccccagguguacacccugcccccgagccgggacgagcucaccaagaaccaggugucccugacgugccuggucaagggguucuaccccagcgacaucgccguggagugggaguccaacggccagcccgagaacaacuacaagaccaccccgcccgugcucgacagcgacggguccuucuuccuguacagcaagcugaccgucgacaagucccgcuggcagcagggcaacguguucagcugcuccgugaugcacgaggcgcuccacaaccacuacacgcagaagagccugucccugagccccgggaagugaaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggcccagaucgugcugagccagucccccgccauccugagcgcguccccgggggagaaggugaccaugaccugccgggccagcuccagcgucuccuacauccacugguuccagcagaagcccggcagcucccccaagcccuggaucuacgccacgagcaaccucgccuccggggugccggugcgcuucagcggcuccgggagcggcaccuccuacagccugaccaucagccgggucgaggccgaggacgcggccaccuacuacugccagcaguggacguccaacccgcccaccuucggcgggggcaccaagcuggagaucaagcgcaccguggccgcccccagcguguucaucuucccgcccuccgacgagcagcucaagagcgggacggcguccgucgugugccugcugaacaacuucuacccccgggaggccaaggugcaguggaaggucgacaacgcccuccagagcggcaacucccaggagagcgugaccgagcaggacuccaaggacagcaccuacucccugagcuccacccugacgcucagcaaggccgacuacgagaagcacaagguguacgccugcgaggucacccaccaggggcuguccagccccgugaccaaguccuucaaccgcggcgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61338 - protein, 451 aa, Artificial Sequence; identical to SEQ ID NO: 515
  Protein (HC) w/o signal peptide encoded by mRNA R4126, R3985

SEQ ID NO: 61339 - RNA, 1353 nt, Artificial Sequence
  CDS (HC) w/o signal peptide encoded by mRNA R4126, R3985
gaggugcagcugguccagagcggcgggggcguggagcgccccgggggcucccuccggcugagcugcgccgccuccggguucaccuucgacgacuacggcaugagcugggugcgccaggcgccgggcaaggggcuggagugggucuccggcaucaacuggaacgggggcagcaccggguacgccgacuccgugaagggccgggugacgaucagccgcgacaacgccaagaacucccucuaccugcagaugaacagccugcgggccgaggacaccgccgucuacuacugcgcgaagauccucggcgccgggcgcggcugguacuucgaccugugggggaagggcaccaccgugacgguguccagcgccuccaccaagggccccagcgucuucccccuggcccccuccagcaaguccaccagcgggggcaccgcggcccucgggugccuggugaaggacuacuuccccgagcccgugacggucuccuggaacagcggcgcccugaccagcggggugcacaccuuccccgccgugcuccaguccagcggccuguacucccugagcuccgucgugaccgugcccagcuccagccucggcacgcagaccuacaucugcaacgucaaccacaagccguccaacaccaagguggacaagcggguggagcccaagagcugcgacaagacccacacgugcccgcccugcccggcccccgagcugcugggcgggcccuccgucuuccucuucccgccgaagcccaaggacacccugaugaucagccgcacccccgaggugaccugcguggucguggacgucucccacgaggaccccgaggugaaguucaacugguacguggacggggucgaggugcacaacgcgaagacgaagccccgggaggagcaguacaacagcaccuaccgcguggucuccgugcugaccgugcuccaccaggacuggcugaacggcaaggaguacaagugcaaggucagcaacaaggcccugcccgcccccaucgagaagaccaucuccaaggccaaggggcagccccgggagccgcagguguacacgcucccgcccagccgcgaggagaugaccaagaaccaggugucccugaccugccuggucaagggcuucuaccccagcgacaucgccguggagugggagagcaacggccagccggagaacaacuacaagaccacgccgcccgugcucgacuccgacgggagcuucuuccuguacuccaagcugaccgucgacaagagccgguggcagcagggcaacguguucuccugcagcgugaugcacgaggcgcuccacaaccacuacacccagaagucccugagccuguccccggggaag

SEQ ID NO: 61340 - RNA, 1353 nt, Artificial Sequence; identical to SEQ ID NO: 15799
  derived and/or modified sequence opt2 from CDS (HC) w/o signal peptide encoded by mRNA R4126, R3985

SEQ ID NO: 61341 - RNA, 1353 nt, Artificial Sequence; identical to SEQ ID NO: 23441
  derived and/or modified sequence opt3 from CDS (HC) w/o signal peptide encoded by mRNA R4126, R3985

SEQ ID NO: 61342 - RNA, 1353 nt, Artificial Sequence; identical to SEQ ID NO: 31083
  derived and/or modified sequence opt4 from CDS (HC) w/o signal peptide encoded by mRNA R4126, R3985

SEQ ID NO: 61343 - RNA, 1353 nt, Artificial Sequence; identical to SEQ ID NO: 38725
  derived and/or modified sequence opt5 from CDS (HC) w/o signal peptide encoded by mRNA R4126, R3985

SEQ ID NO: 61344 - RNA, 1353 nt, Artificial Sequence
  derived and/or modified sequence opt6 from CDS (HC) w/o signal peptide encoded by mRNA R4126, R3985
gaaguacaauuaguacaaucaggaggaggaguagaaagacccggagguucacuacgauuaucuugcgcagcaaguggauucacauuugaugacuauggaauguccuggguaagacaagcaccaggaaaaggacucgaauggguuucuggaauaaacuggaauggaggauccacaggcuacgcagacucaguaaaaggaagaguaacaaucucaagagauaaugccaaaaacagccuauauuuacaaaugaacucauuacgagcagaagauacagcaguauauuauugugcaaaaauucuaggugcaggaagaggcugguacuuugaucuuuggggaaaaggaacaacaguaacaguauccucagcaucaacaaaaggcccaaguguuuuuccauuagcaccaucaucaaaauccacaagcggaggaacagcagcuuuaggcugcuuagugaaagacuauuucccugaaccaguaacaguaucauggaauagcggagcauuaacaucaggaguacacacauucccugcaguauuacaaucaagcggacucuauucccuaucuagcguggugacgguacccucaucuagcuuaggaacacaaaccuacauaugcaauguaaaucacaaaccuucaaacacaaaaguugauaaaagaguagaacccaaaucaugcgacaaaacacacacaugucccccuugcccagcaccagaauuacuaggaggcccauccguauuccuauuuccaccaaaaccaaaagauacacucaugauuagucgaacaccagaaguaacuuguguaguaguagacguaucacaugaagacccagaagucaaauuuaacugguacguagacggaguagaaguucauaacgcaaaaaccaaaccuagagaagaacaauauaauagcaccuaccgagucguaagcguauuaacaguauuacaccaagacuggcuaaauggaaaagaauauaaauguaaaguaucaaauaaagcacuaccagcaccaauagaaaaaacuauuucaaaagcaaaaggacaaccaagagaaccacaaguauauacauuaccaccauccagagaagaaaugaccaaaaaucaaguaaguuuaacaugcuuaguuaaagguuucuauccaucagauauagcaguagaaugggaaucuaacggacaaccagaaaauaauuacaaaacaacuccaccaguauuagauagcgauggaucauuuuuucuauauagcaaauuaacuguagauaaaucuagauggcaacaaggcaauguauuuucauguucaguaaugcacgaagcccuucauaaucauuauacacaaaaaucauuaucuuuaucaccuggaaaa

SEQ ID NO: 61345 - RNA, 1353 nt, Artificial Sequence
  derived and/or modified sequence opt11 from CDS (HC) w/o signal peptide encoded by mRNA R4126, R3985
gaaguccaacucguccaauccgguggaggcgucgaacgcccaggcggcagccuccgacuauccugcgcagcaagcggcuucacauucgaugacuacggcaugagcuggguccgccaagccccaggaaaaggccuagaauggguaucaggcauaaacuggaacggaggcagcaccggcuacgcagacucagucaaaggacgaguuaccaucucacgcgacaacgccaaaaacucccuauaccuacaaaugaacucccuccgagccgaagacaccgcagucuacuacugcgccaaaauccucggcgccggccgcggaugguacuucgaccucuggggcaaaggcaccaccguaacggucuccuccgccucaacaaagggaccaagcgucuuuccccuagcccccucaagcaaaucaaccucaggcggcaccgccgcccucggcugccuagucaaagacuacuucccagaacccgucacuguauccuggaacuccggagcccucaccucaggcguccacacauucccagcaguccuccagucaucaggacuauauucucuauccucaguaguaaccgucccaucaagcagccuaggcacacaaacuuacauauguaauguaaaccacaaacccucuaacaccaaaguagacaaacgcgucgaacccaaauccugcgacaaaacacacacaugcccucccugccccgcccccgaacucuuaggcggccccuccgucuuccucuucccgcccaaacccaaagacacccugaugaucucccgaacccccgaaguaacaugcgucgucguagacgucucacacgaagaccccgaagucaaauuuaacugguacgucgacggcgucgaaguacacaacgccaaaaccaaaccgagagaagaacaguacaacucaaccuaccgcgucguuagcguacuaaccgugcuccaccaagacuggcucaacggaaaagaauacaaaugcaaagucagcaacaaagcccuccccgcccccaucgagaaaaccaucucaaaagcaaaaggucaaccacgagaaccccaaguauacacccuaccacccucacgcgaagaaaugacuaaaaaccaggucucccugaccugccucgucaagggcuucuaccccucagacaucgccgucgaaugggaaucaaacggccaacccgaaaacaacuacaaaaccacacccccaguacucgacuccgacggauccuucuuccucuauuccaagcuaaccguagacaaaucccgcuggcaacaaggcaacguuuuuagcugcucaguaaugcacgaagcccuccauaaccacuacacccaaaaaucccucucacucuccccuggcaaa

SEQ ID NO: 61346 - protein, 476 aa, Artificial Sequence
  Protein (HC) encoded by mRNA R4126, R3985
MAVMAPRTLVLLLSGALALTQTWAGEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61347 - RNA, 1431 nt, Artificial Sequence
  CDS (HC) encoded by mRNA R4126, R3985
auggccgugauggccccgcggacccugguccuccugcugagcggcgcgcucgcccugacccagacgugggccggggaggugcagcugguccagagcggcgggggcguggagcgccccgggggcucccuccggcugagcugcgccgccuccggguucaccuucgacgacuacggcaugagcugggugcgccaggcgccgggcaaggggcuggagugggucuccggcaucaacuggaacgggggcagcaccggguacgccgacuccgugaagggccgggugacgaucagccgcgacaacgccaagaacucccucuaccugcagaugaacagccugcgggccgaggacaccgccgucuacuacugcgcgaagauccucggcgccgggcgcggcugguacuucgaccugugggggaagggcaccaccgugacgguguccagcgccuccaccaagggccccagcgucuucccccuggcccccuccagcaaguccaccagcgggggcaccgcggcccucgggugccuggugaaggacuacuuccccgagcccgugacggucuccuggaacagcggcgcccugaccagcggggugcacaccuuccccgccgugcuccaguccagcggccuguacucccugagcuccgucgugaccgugcccagcuccagccucggcacgcagaccuacaucugcaacgucaaccacaagccguccaacaccaagguggacaagcggguggagcccaagagcugcgacaagacccacacgugcccgcccugcccggcccccgagcugcugggcgggcccuccgucuuccucuucccgccgaagcccaaggacacccugaugaucagccgcacccccgaggugaccugcguggucguggacgucucccacgaggaccccgaggugaaguucaacugguacguggacggggucgaggugcacaacgcgaagacgaagccccgggaggagcaguacaacagcaccuaccgcguggucuccgugcugaccgugcuccaccaggacuggcugaacggcaaggaguacaagugcaaggucagcaacaaggcccugcccgcccccaucgagaagaccaucuccaaggccaaggggcagccccgggagccgcagguguacacgcucccgcccagccgcgaggagaugaccaagaaccaggugucccugaccugccuggucaagggcuucuaccccagcgacaucgccguggagugggagagcaacggccagccggagaacaacuacaagaccacgccgcccgugcucgacuccgacgggagcuucuuccuguacuccaagcugaccgucgacaagagccgguggcagcagggcaacguguucuccugcagcgugaugcacgaggcgcuccacaaccacuacacccagaagucccugagccuguccccggggaaguga

SEQ ID NO: 61348 - RNA, 1635 nt, Artificial Sequence
  R4126
gggagaaagcuuaccauggccgugauggccccgcggacccugguccuccugcugagcggcgcgcucgcccugacccagacgugggccggggaggugcagcugguccagagcggcgggggcguggagcgccccgggggcucccuccggcugagcugcgccgccuccggguucaccuucgacgacuacggcaugagcugggugcgccaggcgccgggcaaggggcuggagugggucuccggcaucaacuggaacgggggcagcaccggguacgccgacuccgugaagggccgggugacgaucagccgcgacaacgccaagaacucccucuaccugcagaugaacagccugcgggccgaggacaccgccgucuacuacugcgcgaagauccucggcgccgggcgcggcugguacuucgaccugugggggaagggcaccaccgugacgguguccagcgccuccaccaagggccccagcgucuucccccuggcccccuccagcaaguccaccagcgggggcaccgcggcccucgggugccuggugaaggacuacuuccccgagcccgugacggucuccuggaacagcggcgcccugaccagcggggugcacaccuuccccgccgugcuccaguccagcggccuguacucccugagcuccgucgugaccgugcccagcuccagccucggcacgcagaccuacaucugcaacgucaaccacaagccguccaacaccaagguggacaagcggguggagcccaagagcugcgacaagacccacacgugcccgcccugcccggcccccgagcugcugggcgggcccuccgucuuccucuucccgccgaagcccaaggacacccugaugaucagccgcacccccgaggugaccugcguggucguggacgucucccacgaggaccccgaggugaaguucaacugguacguggacggggucgaggugcacaacgcgaagacgaagccccgggaggagcaguacaacagcaccuaccgcguggucuccgugcugaccgugcuccaccaggacuggcugaacggcaaggaguacaagugcaaggucagcaacaaggcccugcccgcccccaucgagaagaccaucuccaaggccaaggggcagccccgggagccgcagguguacacgcucccgcccagccgcgaggagaugaccaagaaccaggugucccugaccugccuggucaagggcuucuaccccagcgacaucgccguggagugggagagcaacggccagccggagaacaacuacaagaccacgccgcccgugcucgacuccgacgggagcuucuuccuguacuccaagcugaccgucgacaagagccgguggcagcagggcaacguguucuccugcagcgugaugcacgaggcgcuccacaaccacuacacccagaagucccugagccuguccccggggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61349 - protein, 214 aa, Artificial Sequence; identical to SEQ ID NO: 517
  Protein (LC) w/o signal peptide encoded by mRNA R4127, R3985

SEQ ID NO: 61350 - RNA, 642 nt, Artificial Sequence
  CDS (LC) w/o signal peptide encoded by mRNA R4127, R3985
agcuccgagcugacccaggaccccgccgugagcgucgcccucggccagaccgugcgcaucacgugccagggggacucccugcggagcuacuacgcguccugguaccagcagaagccgggccaggcccccgugcuggucaucuacgggaagaacaaccgccccagcggcauccccgaccgguucuccgggagcuccagcggcaacaccgccucccucaccaucaccggcgcccaggccgaggacgaggcggacuacuacugcaacagccgcgacuccagcgggaaccacgugguguucggcgggggcacgaagcugaccguccuggggcagcccaaggccgccccguccgugacccucuucccgcccagcuccgaggagcugcaggccaacaaggcgacccuggugugccucaucagcgacuucuacccgggcgccgucacgguggccuggaaggccgacuccagccccgugaaggccggcgucgagaccaccacccccagcaagcaguccaacaacaaguacgcggccagcuccuaccugagccugacgcccgagcaguggaagucccaccggagcuacuccugccaggugacccacgaggggagcaccguggagaagaccgucgccccgacggagugcucc

SEQ ID NO: 61351 - RNA, 642 nt, Artificial Sequence; identical to SEQ ID NO: 15801
  derived and/or modified sequence opt2 from CDS (LC) w/o signal peptide encoded by mRNA R4127, R3985

SEQ ID NO: 61352 - RNA, 642 nt, Artificial Sequence; identical to SEQ ID NO: 23443
  derived and/or modified sequence opt3 from CDS (LC) w/o signal peptide encoded by mRNA R4127, R3985

SEQ ID NO: 61353 - RNA, 642 nt, Artificial Sequence; identical to SEQ ID NO: 31085
  derived and/or modified sequence opt4 from CDS (LC) w/o signal peptide encoded by mRNA R4127, R3985

SEQ ID NO: 61354 - RNA, 642 nt, Artificial Sequence; identical to SEQ ID NO: 38727
  derived and/or modified sequence opt5 from CDS (LC) w/o signal peptide encoded by mRNA R4127, R3985

SEQ ID NO: 61355 - RNA, 642 nt, Artificial Sequence
  derived and/or modified sequence opt6 from CDS (LC) w/o signal peptide encoded by mRNA R4127, R3985
ucaucagaauuaacacaagacccagcaguaucagucgcacuaggacaaacagucagaauaacaugccaaggagacagcuuacgaucauacuacgccucaugguaccaacaaaaaccaggacaagcaccaguauuaguaauauacggaaaaaacaacagaccaucaggaauaccagacagauucucaggaucaucaucaggaaacacagcaucacuaaccauaaccggcgcacaagcagaagacgaagcagauuacuacuguaacucaagagacucaucaggaaaccacguaguauuuggaggaggaacaaaacuaacaguacuaggacaaccaaaagcagcaccaucaguaacacuauucccaccauccucagaagaauuacaagcaaacaaagcaacacuagucugcuuaauaucagacuucuacccaggagcaguaacaguagcauggaaagcagacagcucaccaguaaaagcaggaguagaaaccacaacaccaucaaaacaaucaaacaacaaauacgcagcaucuagcuaccuaaguuuaaccccagaacaauggaaaucacacagaucauacucaugccaaguaacacacgaaggaagcacaguagaaaaaacaguagcaccaacagaaugcuca

SEQ ID NO: 61356 - RNA, 642 nt, Artificial Sequence
  derived and/or modified sequence opt11 from CDS (LC) w/o signal peptide encoded by mRNA R4127, R3985
uccuccgaacucacccaagaccccgcagucuccgucgcacucggccaaaccguccgcauaaccugccaaggcgacucccuccgcuccuacuacgccuccugguaccaacaaaaacccggacaagcccccguccuaguaaucuacggcaaaaacaaccgacccucuggcauccccgaccgcuucucuggcagcucauccggcaacaccgccucccucaccaucacaggcgcccaagccgaagacgaagccgacuacuacugcaacucccgcgacuccuccggcaaccacguagucuucggcggcggcaccaaacucacaguacucggacaacccaaagccgcacccuccgucacccuauucccacccuccucagaagaacuccaagcaaacaaagccacccuagucugccucaucucagacuucuaccccggcgcaguaaccgucgcauggaaagccgacucaucccccgucaaagccggcgucgaaaccaccacccccuccaaacaaucaaacaacaaauacgccgccuccucauaccucucccucacccccgaacaauggaaaucccaccgcucauacagcugccaagucacacacgaaggcuccaccgucgagaaaacagucgcacccacagaaugcucc

SEQ ID NO: 61357 - protein, 239 aa, Artificial Sequence
  Protein (LC) encoded by mRNA R4127, R3985
MAVMAPRTLVLLLSGALALTQTWAGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 61358 - RNA, 720 nt, Artificial Sequence
  CDS (LC) encoded by mRNA R4127, R3985
auggccgugauggccccgcggacccugguccuccugcugagcggcgcgcucgcccugacccagacgugggccgggagcuccgagcugacccaggaccccgccgugagcgucgcccucggccagaccgugcgcaucacgugccagggggacucccugcggagcuacuacgcguccugguaccagcagaagccgggccaggcccccgugcuggucaucuacgggaagaacaaccgccccagcggcauccccgaccgguucuccgggagcuccagcggcaacaccgccucccucaccaucaccggcgcccaggccgaggacgaggcggacuacuacugcaacagccgcgacuccagcgggaaccacgugguguucggcgggggcacgaagcugaccguccuggggcagcccaaggccgccccguccgugacccucuucccgcccagcuccgaggagcugcaggccaacaaggcgacccuggugugccucaucagcgacuucuacccgggcgccgucacgguggccuggaaggccgacuccagccccgugaaggccggcgucgagaccaccacccccagcaagcaguccaacaacaaguacgcggccagcuccuaccugagccugacgcccgagcaguggaagucccaccggagcuacuccugccaggugacccacgaggggagcaccguggagaagaccgucgccccgacggagugcuccuga

SEQ ID NO: 61359 - RNA, 924 nt, Artificial Sequence
  R4127
gggagaaagcuuaccauggccgugauggccccgcggacccugguccuccugcugagcggcgcgcucgcccugacccagacgugggccgggagcuccgagcugacccaggaccccgccgugagcgucgcccucggccagaccgugcgcaucacgugccagggggacucccugcggagcuacuacgcguccugguaccagcagaagccgggccaggcccccgugcuggucaucuacgggaagaacaaccgccccagcggcauccccgaccgguucuccgggagcuccagcggcaacaccgccucccucaccaucaccggcgcccaggccgaggacgaggcggacuacuacugcaacagccgcgacuccagcgggaaccacgugguguucggcgggggcacgaagcugaccguccuggggcagcccaaggccgccccguccgugacccucuucccgcccagcuccgaggagcugcaggccaacaaggcgacccuggugugccucaucagcgacuucuacccgggcgccgucacgguggccuggaaggccgacuccagccccgugaaggccggcgucgagaccaccacccccagcaagcaguccaacaacaaguacgcggccagcuccuaccugagccugacgcccgagcaguggaagucccaccggagcuacuccugccaggugacccacgaggggagcaccguggagaagaccgucgccccgacggagugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61360 - RNA, 2828 nt, Artificial Sequence
  CDS (HC)-IRES-CDS (LC) as RNA from mRNA R3985
auggccgugauggccccgcggacccugguccuccugcugagcggcgcgcucgcccugacccagacgugggccggggaggugcagcugguccagagcggcgggggcguggagcgccccgggggcucccuccggcugagcugcgccgccuccggguucaccuucgacgacuacggcaugagcugggugcgccaggcgccgggcaaggggcuggagugggucuccggcaucaacuggaacgggggcagcaccggguacgccgacuccgugaagggccgggugacgaucagccgcgacaacgccaagaacucccucuaccugcagaugaacagccugcgggccgaggacaccgccgucuacuacugcgcgaagauccucggcgccgggcgcggcugguacuucgaccugugggggaagggcaccaccgugacgguguccagcgccuccaccaagggccccagcgucuucccccuggcccccuccagcaaguccaccagcgggggcaccgcggcccucgggugccuggugaaggacuacuuccccgagcccgugacggucuccuggaacagcggcgcccugaccagcggggugcacaccuuccccgccgugcuccaguccagcggccuguacucccugagcuccgucgugaccgugcccagcuccagccucggcacgcagaccuacaucugcaacgucaaccacaagccguccaacaccaagguggacaagcggguggagcccaagagcugcgacaagacccacacgugcccgcccugcccggcccccgagcugcugggcgggcccuccgucuuccucuucccgccgaagcccaaggacacccugaugaucagccgcacccccgaggugaccugcguggucguggacgucucccacgaggaccccgaggugaaguucaacugguacguggacggggucgaggugcacaacgcgaagacgaagccccgggaggagcaguacaacagcaccuaccgcguggucuccgugcugaccgugcuccaccaggacuggcugaacggcaaggaguacaagugcaaggucagcaacaaggcccugcccgcccccaucgagaagaccaucuccaaggccaaggggcagccccgggagccgcagguguacacgcucccgcccagccgcgaggagaugaccaagaaccaggugucccugaccugccuggucaagggcuucuaccccagcgacaucgccguggagugggagagcaacggccagccggagaacaacuacaagaccacgccgcccgugcucgacuccgacgggagcuucuuccuguacuccaagcugaccgucgacaagagccgguggcagcagggcaacguguucuccugcagcgugaugcacgaggcgcuccacaaccacuacacccagaagucccugagccuguccccggggaagugaaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccgggagcuccgagcugacccaggaccccgccgugagcgucgcccucggccagaccgugcgcaucacgugccagggggacucccugcggagcuacuacgcguccugguaccagcagaagccgggccaggcccccgugcuggucaucuacgggaagaacaaccgccccagcggcauccccgaccgguucuccgggagcuccagcggcaacaccgccucccucaccaucaccggcgcccaggccgaggacgaggcggacuacuacugcaacagccgcgacuccagcgggaaccacgugguguucggcgggggcacgaagcugaccguccuggggcagcccaaggccgccccguccgugacccucuucccgcccagcuccgaggagcugcaggccaacaaggcgacccuggugugccucaucagcgacuucuacccgggcgccgucacgguggccuggaaggccgacuccagccccgugaaggccggcgucgagaccaccacccccagcaagcaguccaacaacaaguacgcggccagcuccuaccugagccugacgcccgagcaguggaagucccaccggagcuacuccugccaggugacccacgaggggagcaccguggagaagaccgucgccccgacggagugcuccuga

SEQ ID NO: 61361 - RNA, 3020 nt, Artificial Sequence
  R3985
gggagaaagcuuaccauggccgugauggccccgcggacccugguccuccugcugagcggcgcgcucgcccugacccagacgugggccggggaggugcagcugguccagagcggcgggggcguggagcgccccgggggcucccuccggcugagcugcgccgccuccggguucaccuucgacgacuacggcaugagcugggugcgccaggcgccgggcaaggggcuggagugggucuccggcaucaacuggaacgggggcagcaccggguacgccgacuccgugaagggccgggugacgaucagccgcgacaacgccaagaacucccucuaccugcagaugaacagccugcgggccgaggacaccgccgucuacuacugcgcgaagauccucggcgccgggcgcggcugguacuucgaccugugggggaagggcaccaccgugacgguguccagcgccuccaccaagggccccagcgucuucccccuggcccccuccagcaaguccaccagcgggggcaccgcggcccucgggugccuggugaaggacuacuuccccgagcccgugacggucuccuggaacagcggcgcccugaccagcggggugcacaccuuccccgccgugcuccaguccagcggccuguacucccugagcuccgucgugaccgugcccagcuccagccucggcacgcagaccuacaucugcaacgucaaccacaagccguccaacaccaagguggacaagcggguggagcccaagagcugcgacaagacccacacgugcccgcccugcccggcccccgagcugcugggcgggcccuccgucuuccucuucccgccgaagcccaaggacacccugaugaucagccgcacccccgaggugaccugcguggucguggacgucucccacgaggaccccgaggugaaguucaacugguacguggacggggucgaggugcacaacgcgaagacgaagccccgggaggagcaguacaacagcaccuaccgcguggucuccgugcugaccgugcuccaccaggacuggcugaacggcaaggaguacaagugcaaggucagcaacaaggcccugcccgcccccaucgagaagaccaucuccaaggccaaggggcagccccgggagccgcagguguacacgcucccgcccagccgcgaggagaugaccaagaaccaggugucccugaccugccuggucaagggcuucuaccccagcgacaucgccguggagugggagagcaacggccagccggagaacaacuacaagaccacgccgcccgugcucgacuccgacgggagcuucuuccuguacuccaagcugaccgucgacaagagccgguggcagcagggcaacguguucuccugcagcgugaugcacgaggcgcuccacaaccacuacacccagaagucccugagccuguccccggggaagugaaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccgggagcuccgagcugacccaggaccccgccgugagcgucgcccucggccagaccgugcgcaucacgugccagggggacucccugcggagcuacuacgcguccugguaccagcagaagccgggccaggcccccgugcuggucaucuacgggaagaacaaccgccccagcggcauccccgaccgguucuccgggagcuccagcggcaacaccgccucccucaccaucaccggcgcccaggccgaggacgaggcggacuacuacugcaacagccgcgacuccagcgggaaccacgugguguucggcgggggcacgaagcugaccguccuggggcagcccaaggccgccccguccgugacccucuucccgcccagcuccgaggagcugcaggccaacaaggcgacccuggugugccucaucagcgacuucuacccgggcgccgucacgguggccuggaaggccgacuccagccccgugaaggccggcgucgagaccaccacccccagcaagcaguccaacaacaaguacgcggccagcuccuaccugagccugacgcccgagcaguggaagucccaccggagcuacuccugccaggugacccacgaggggagcaccguggagaagaccgucgccccgacggagugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61362 - protein, 451 aa, Artificial Sequence
  Protein (HC) w/o signal peptide encoded by mRNA R5319
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61363 - RNA, 1353 nt, Artificial Sequence
  CDS (HC) w/o signal peptide encoded by mRNA R5319
cagguccagcuggugcaguccggcgggcagaugaagaagcccggcgagagcaugcgcaucuccugccgggccagcggguacgaguucaucgacugcacccugaacuggauccgccucgcgccgggcaagcggcccgaguggaugggcuggcugaagccccgcgggggcgccgugaacuacgcccggccccugcaggggcgcgucaccaugacgcgggacguguacuccgacaccgccuuccucgagcugcgcagccugaccguggacgacaccgccgucuacuucugcacgcggggcaagaacugcgacuacaacugggacuucgagcacugggggcgcggcaccccggugaucguguccagcgcguccaccaagggccccagcgucuucccccucgcccccuccagcaaguccaccagcgggggcacggccgcccuggggugccuggugaaggacuacuucccggagcccgugaccgucuccuggaacagcggcgcgcucaccuccggcgugcacaccuuccccgccgugcugcagagcuccgggcuguacagccucagcuccgucgugacggugcccagcuccagccugggcacccagaccuacaucugcaacgucaaccacaagcccuccaacaccaagguggacaagaagguggagcccaagagcugcgacaagacgcacacgugcccgcccugcccggcccccgagcugcucgggggccccuccgucuuccuguucccgcccaagcccaaggacacccugaugaucagccggacccccgaggugacgugcguggucguggacgucucccacgaggaccccgaggugaaguucaacugguacguggacggggucgaggugcacaacgccaagaccaagccgcgcgaggagcaguacaacagcaccuaccggguggucuccgugcucaccgugcugcaccaggacuggcugaacggcaaggaguacaagugcaaggucagcaacaaggcccuccccgcgcccaucgagaagacgaucuccaaggccaagggccagccccgcgagccgcaggucuacacccugccgcccagccgggacgagcugaccaagaaccaggugucccugaccugccuggucaagggguucuaccccagcgacaucgccguggagugggaguccaacggccagcccgagaacaacuacaagacgaccccgcccgugcuggacagcgacggguccuucuuccucuacagcaagcugaccgucgacaagagccgcuggcagcagggcaacguguucuccugcagcgugaugcacgaggcccugcacaaccacuacacccagaagucccucagccugucccccgggaag

SEQ ID NO: 61364 - RNA, 1353 nt, Artificial Sequence
  derived and/or modified sequence opt2 from CDS (HC) w/o signal peptide encoded by mRNA R5319
cagguccagcucguccaguccggcggccagaugaagaagcccggcgaguccaugcgcaucuccugccgcgccuccggcuacgaguucaucgacugcacccucaacuggauccgccucgcccccggcaagcgccccgaguggaugggcuggcucaagccccgcggcggcgccgucaacuacgcccgcccccuccagggccgcgucaccaugacccgcgacgucuacuccgacaccgccuuccucgagcuccgcucccucaccgucgacgacaccgccgucuacuucugcacccgcggcaagaacugcgacuacaacugggacuucgagcacuggggccgcggcacccccgucaucgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 61365 - RNA, 1353 nt, Artificial Sequence
  derived and/or modified sequence opt3 from CDS (HC) w/o signal peptide encoded by mRNA R5319
caggugcaacugguccagagcggcgggcagaugaagaaacccggagaguccaugagaaucucuugcagggccucagguuacgaguucauugacuguacccucaacuggauacggcuugcuccuggcaagcgcccagaauggaugggguggcugaaaccgcgaggaggcgcaguuaauuaugcccgucccuugcaggguagagugacaaugacuagggauguauacagugacacggcguuuuuagaacugcggagccuaaccguggaugacacagcugucuauuucugcacucgcgggaagaacugugauuacaauugggacuuugagcacuggggaagaggcaccccugugaucguuuccucugccucgacaaaaggcccaucaguguucccccucgcaccuagcaguaaguccaccucugggggaacugccgcucuggguugccuugucaaggauuauuuuccagaacccgugacaguaagcuggaacuccggcgcacugaccucagggguucauacguucccugccguguugcaaaguagcggacucuacucucuguccucagucgugacugugccaagcaguucucugggcacccagacauauauuuguaaugucaaccacaaaccguccaauacuaagguugacaaaaagguggagcccaaaagcugcgauaagacccauacauguccuccaugccccgcuccugagcucuuaggugggccaucgguauuucuguuucccccgaagccuaaagacacccuuaugaucucuaggacgcccgaagugacuugugucgugguugaugugucccacgaggacccagaagucaaguucaacugguacguggauggaguagagguucauaaugccaaaacaaagccucgggaggaacaguacaacucaaccuaucgcguggucaguguguugacuguccugcaccaggacuggcuaaauggcaaagaguacaagugcaaagugagcaacaaggcgcuccccgcaccaauugaaaagacaaucuccaaagccaagggccaaccccgagagccucagguuuauacccugccaccgucuagagacgaacuuacgaaaaaucaggugagccugaccuguuugguaaagggguucuaccccucagauauagcugucgagugggagaguaacggacagccugaaaauaacuauaaaacaacuccacccgugcucgacuccgaugguagcuuuuuccuguacucuaaguuaaccguugacaagucaagguggcaacagggcaacguguuuaguugcagcgucaugcacgaggcccugcauaaucacuauacacagaaaucccucucucuuucgccugggaag
